United States Patent 7,332,281 (THERAPEUTIC TARGETS IN CANCER) - sequence listing, part 2

SEQ ID NO: 77 - DNA, 1320443 bp, Mus musculus
  misc_feature (1)  (1320443): n = A, C, G, or T/U
cagacacctctgctgattgactcactcctggcttgatacatctgccttggggacacgaatccggaatctagtttccatcccccagccccctgattttggatgttcttttgattctccacagacctgggaaggtaaccgcaagccataccatctgcagctcacagcacctcttggaggttactactgacagttttcattacacaggcttctgtgagtgcttatgtgtttgtatgtgttcctgcgtgtgggtgcctgcttcctcgtaaaagagattgtgtgagtgtccgtactgtgtgtggggatttgtgagacaagcaaaggaggtataccgtacaagaggagatctaaacagcgtgataaaaatctccaggcactggggctcacaatctctagccccccctcctcacaccgccccttctttgccctactcccccggctcctttcgtctttgatgagtttttggctcactttttggcggagtctcttggacatgttctgctgttgctgaaggatcaaataaatggaacctttgaaagttgattatttttctcttatgtgacaaacacacacagagagagcgcgaagaggaaggaaattagagtgctgtatgacaagctagaggatttaaatttttccttggtgaactttgaggatccgctgagaaggtaagtcaccaggttacttagctctggtaccttctttttttacaacgtttgtttgtttttttttttttttctgggctgttttcagaaatccatatgaggttcataagcgctcacttccagattgtaatgcagagaggaaccagtgtgtggcattcggggttattctcatgccaaggagggtatttccatctgtatgggcccctcttactattttatacccctcttcttggtgttttcttggtgaattcggagaacatgaaatctgcaaattcgtgataaaaattaaaaccccagcctatttcgaaataaatctcctaaactgggggtttggttgggaaggagggggatcattcaggttaactgctctcagaagctctgagacagacgcaaacctgaacctactcagagactgccatgagatgtcagtgggggtgtaattcagagttttatgacaacttaaaagtagaccccttgcagattttctttcttcctttcctttcctttctttttttcttttcttttcttttcttttcttttcttttcttttcttttctttctttctttctttttttttctttttctctttctttctttctttttttttttttttaagaacagttttgtgtgctctgggaagtggtggctgtgttcccacagcttctaataggagcaaatgagaacaaagtgggaattgttttgtgttttcagcctcgcttttggattgacttttccctattgcatctcattaaccccctttgaactctactgtcccccttattaaggactagaagtgcctgtcattttggaacatcttctcaccccatgcagtccctagagaagggagtgcggctgcaaattgctcataactgtgcagtcttggctgtaaaagcaagcagcgtcagaattcatgtgacttcagtcacacatcttaccgaaatcagcctcctctacgttccctggtgggtccacgggcttcaaagctttaacccccccccatctccttagaactgaaatgcagatagcactttacttttctcttctgtttgtttatttattttttgatgtcaagaaacgaaaatactgtttcactgtgacagcatctgcatctctgtattcgtgaatagatttatctctagattggcacctagcagggaaaattagctgtaagtgtttttccaaaacgctgaaatccgcaagtgaaagtggctagaaggttaatcttcctggtgaacatcagtggtggtgtatctgaagcggagtggtgatgttctttgggctgttcgccaactctaagagctgttgtgatcatgttcaatgtagagatgacaagtatgctaactagggagaggagggcacacctaggtaattctttccgactactgaggactatatttaactacaagatgctaattgcagcatagaaaatctattcagacatgactgatctagtcaaagatttatcagtgtatccaagtttggagatgtcagacctcatactagaagcactgatatttcgtctttcctaaaaggtgaattactaaaagagcaaacaaacaaaacgttgatatgaggttatctaacgatccttgcacggggatgttggaggaacagaactgcagctgttaagagaagttcccgtccctagctggctccgtgactgccactcaacacagtaacctgatggacacaatgtgggaaaaattttgagacacaagtcatgatatgcccttctggcagggtatttttgacttatgtatttttcccctagacttcagctctggtttcatgatcagcaaaagaacatttcctttgttttactttttattttcatttttctttaagtgtctggaacataagcagacatcaatataatttctttttttttcttttcattacttttttctttctttctttctttcttttttcttgagacaagaatgagctaagaatcaccaaacgcagagtcagggatggatacaaaattaagaaacatgaactataagaagagaaagacaaggaagctgcagatgccagcaagtcacagcaggccatcaaaggtctcctcgactctgtgtggatatggattaatcttattgttttcagctgcccactcacctggagattctgataactagtcctaaggagagaaggcagtgttttaggtcatctacttgatattagaaccacttagagtaaagagaggttcttcataaatgtcattttgtaagttggcaaacttatgcctcttttctttgagattgcttgactttaactgccccctaccaattcatattttcatgtagaatgaatatgtacttagactggtagtatggggaaattaattacatagactgtcaacactgtctgaaaacagaaggatagtattttatcttttatgtatttgagtcttcataattgcaatgagtgaatcttctggcagcagcaatactttccttatcagttcttttaggttaataatagcagtggggtgccagccaacccagaatgctctgacaccagctcatacaatatgtaaagcaaatcctttgcatctcaggggctccagatgctgtttgcacatctgcagcttgacatctctatgtttagctgaggtgtagcagtggtaaacagcttatgctcacacttgactccaggacctaacgtggactgtcttgaactttgtttcttggtagagagtgttttgaggtttaacagtcttagtttgctaccttagtgaattcagcagcaaagaaagcaaggaaaagggagtgcaaacttccatttccatagggatataggatgtcagagtggccaatgaagagactgatgttccttcaaagagatagacaagattacttctatagaatgaatccataaagtgctcctttgaatttattaggggagaataagggaacctccatctcctcctcagtttagttccagtcagtgggcaggcctttctctggctctttgctcaactcagccaaccagacccaacactctccagtgtgtttctatgcttttaagacccaagacacttaacacatgaatagttccttccttttcaaaaagacaaagctgacagctggaaagttagctactgagattctttaaaggaagccaggaagattatccagtaagttcaagaagaactctcttttgattctttaggtttgctagacttaaagttctttgggcttttggttctctagccctggcagtgaagataaaccaagtgtcctgcacttgaagttttgattactgcatcattgctacaacttagaaagaaatatcttaggctgatcctaacaatggtgatgggtcagaacatcagtctatggaatgaaatgcaaagtcttggatcttggcttgaagtaaatattatagagcaacagatgctttatgtgtccttcatgttgttccctaccacttacaaacaattgctctgggacctctgtgattacagaagaaaagctgattaaggttatgtgaactggataggaactttgaagtatgcaatagactaaataaacccactccatcatctataattgcacttgagactgatgcatgtgtgtgtgtatgtgcatgtatgtgcatgtatgtgcatgtgcatttatgcactggtagattttaagtgattaatcagggtatggaggccataacgattgattcataaaaaatagaaagctgtgcaatgaaaattggtcttggatttcagaaatgattgaaaagagaaggaaggaaggaaggaaggaaggaaggaaggaaggaaggaaggaaggaaggaaagaagggaggaagatggaaacaatcaaggaaagaagatggaaatgttaggaaagaaggaaaaaggcaaaggaggacacttggacatgctaactttcttggcaaagctacacagaccatgactgagtttgcaagctccaaaacctctagtccctaatgaaactcgaattttaatgacatctggaaactgtataaacaggatatttatctctaacaggcaggacataatgagaacaagcattgtcatactggaatgcatttatgagacagactagggttaaaaggcagagacgaagacattgataacagtattagttttgtagctgaacaaacaggatagatcatttctcagagcctcagttttctattagctaaaacatgaaaaggtaatcataaagatttctttgataagtgaataagagatgtataagtatagttagcaaaacctttcatatgaaattacattgatgttgacagctcacaaagatttttttcatccatcttaatctagtttaaggaagagaaaacccaacctaattcaggatatgtttagaattagacagagggctgaagtagaaaatataacttgagagttaggtaaaactgaagaaacgaaggtatgtttctgtcagtttgccttagagtttattcagaccctctcagagaagcctaagtgccttccagatgctgttgtactcatgttcaaaatttcaaaatgatactgattgtaagtagaatcatgtgcatccatccatatgtggttgcagaaacaattcgaatgtcagcaagtggtgttaacattgctttttctctactggctctttttgttcacagacaatgaaaggatatctgtttattagttcactatctggcaggtactggtacgatggttgattctgtgagaagtgcattaggtctctcttcatttctctaggctgccactccagcattttgacatggcatgctgcagtctgctggactgctccttagaattttgacttgatagttaaacagaattaagattcctcttccagcatctgacccatatggagctatgtcattgtgtatgacctttatttagttcaagaacatattgctaaagatgtaaaaagccttgttcctattaatgtagctagctgagctgtcagcgatgaggccaattctgctttgctaactctgcacggctggtaccacttgacccaggtatttctgttctgcctagtcagcctttctctgaacatgaagagagctgggttttgcccttcagtgtgtgggctctaacagtctgataatgaatggaagggctgtgccttatgatttgcatggaagcaataccaaatccaaactcacagcaatttaaattctttttataaaatccaggtctagggcagcaaaagaggaagaaaggataacaatgagtcacagtaacacacccatacacatactgcatctttaagtgccccaatctagggacaggtctctgcactgaactagaaaatcccccccccgccccaatcatacacagcacttcatgtagagagcacacataaagctgatgcaataagttacaattatcacaaataatcactggtcatatgccgtgtgccagacaagggaaatcatgtatgccctctgttaaaaagtagtgagtttgggggttggatcaacagatcagcagagcatactatttgctgctttttcacagaccggtgtttgatttccatcacttatatgttggctcataattgttagtaactccagttacagagggtgtgatgccctcttctgacctcctcaggcagtaggcacatggtacaaatacatgcatataggtacacatatatgcatataggcaaaacattcatacacataaactaaagataaatgaatttttaaaaaattagtgagataactatttttctcctaaataaacaaaaagagattaaattttgccatacacacacacacacacacacacacgatatcgattttgtttctaatagacctgaaaatttttctctttggaccagttaattcctgatactgtatgccattaatgttatatttttatggtacttagaagattctagagctttaggcaggtgtctgattcttttattattgcccaagacttgttggaatggttggccttagatggtacattatacttcagttgaaagtgtgaaagcaatgttgaaatgcataggcagtattactatgtgtaccaactttttagtgatggaactttgggcaggttgattttatatctgtacttcagtaccttgatttgcagagctattgtaaaataactaataaaacagtacttatgaagcacagagaagagagattgggtaaaatccatgctcagtaaatgtgattccattaaaatactaatggaattaaaatactaatggacccttatttacttataatcaccgctaatattctaagatattgtgatatcttagaattttagtttacataactatcttggtactttgaaggaaaaatagttaagtgataggaatgaataaaatactggatatttttgtctttctgagacatgatacaaaggataggaagaaaattctgattctagaatacaattaccagcttggctataaaaaggagggaaaaaaatcacattttataaacttttgcatttgtgtatatgtgtgtactcctgtctgtatggatgcacaagcatgagtacctgtataaattcgaacagccttgagtctcactcctcaggggcagttcaactttttttattcaaagtctttctatgtcctgatgctcaccaagtactcaagactgactggccagaaaacctcagattctctcctttatgccttccccaaaatgggtaacagtgtgtaccaccagacctcctaacattctaataggttttatagaatgagttcagaactgcttgccttacagggcaagcactttatcctaccaactgagccatcttcttaactgtagaagttttctagttaaaagacaagaggcagcagccttcttttgattcactgtgccaaagaaaacaataaaaattcatttttattctctcatccctgaaaaaaaaatacattttgagtataatgaaagtactctattacatttccatgtcattgttttaattatacctttatatgtatgtaggaatgtatatgtgtgagataacttagtcttttaatgctttgtagtaaactatccagtggtgacaagtttcactcatttatacaagactctatatgtatgtatgtatgtatgtatgtatgtatgtatcattctatctctctatcatcttttttctttctatctttctatcattcgatctatcactatcatctttttatctatcacctatcatctataatttttccttttacccatctttctatcatctatctttatatctatctatctatctatctatctatctatctatctatctatctttatatctatctatttttgaggtcaaagaagcaaaaattttcaaagcatatttatcaacattcccttaaaataaatccagtgaccatacattttgagaatctagtagacaatcaatatagaagatatgattaacttaaaaaatataacatcaatacaacatttgaataaaagaaaaatacaaaataaatattttgaataaacattctgaaaaaagaaaatcttgtgctgcaatcctagtagcaggcaaatggattttctgatttattttgcatggtgaagttataggtcatgatcataagcaatctggattaaagctttagagaatagcagaacccagtgcttccttatataaaggaaaagcatgtttaaatggtttgttcagatctttcatctaccaaagaatcctgactatcaggaagtattgagcatcatgttcataaatctattttgatcccagtgccaaaagtaacatatgaaaatacgtttgaaatgttttcatgtccacctggctaccagaattttcctgaaataaggtctgtccagcatagtaatagagaatctcttcatattttcctctgatggatgctacctccatcattcttttaaatcttctttgtcttcttgttctgcctggcctcccttccttattatgtctttgtatctctaagtctgacctcaatttttatcactgttatcagcctatctacattcaattcttctactccaacaagagtctgcaactttgttccacatatctgggatgttatctgggatgatatcaatttaatgggcaaccatttatttaaaaataatatatatatataaaaaatcaagttcttaaatctaaattccataactgaattctatctcagtaatcttagttgagatcattttacataagtaaatcaacactttcaatgagcatttttaatgagaatagtctattctccttttgtgatcattttgttagtgctatttactctgtacttgtttgttgaaaacatatatgtagtttaatgctatgcatatagaataccaaatataggcaatataaatgatccactaaaatatattgttttaattttgccattacattgataaaggggaagctaacatgatagccaaagtaagtcaaagctttgtagaagcaaaacggaggcattcatactgggagatgtttaagtacagaaggacagcttagcattagcactaaagagctcagtggtggagaaagtgaagaaatgtttggaattctgtggagtgctttaaaagagagagtccttaatataagcacagtgaatctgtaacaatgttgtgatagtacagatatactaagagcttcacagtcattcaaagagggacatctttattctggagacagtaacagaaaaactaagattcattccacttgtgattttcctaaagaaatgtatcattacaaactgaaaacatctgtgtcattgcatctggccacacagtccaggtgtccaactctttcgatttgaaactttagttggcctgaaacaaagtttagcactattatctattttccactctatttctcttttgaatttactgaagccattttggataacttttttttttttctgaattgatgggatttttttctgcataaaattatttttcaaaacttcctctttttaatgttgtaaaatgagaaattacaaataaaggtatacacagccacccatctagtttatcttctcttcctgcttacaatttgcttctgtccttttgtttctggaaagggttctagtaccttgaactgatggtctgttaactatcatcatctgatgtcatgttcttgaggaaagcatacctagacatctatggcttagaatggaaaacctttactaaagttggaatatctggttgaaggctagtccctgacctttctgtctttggcatgacactttggcttgtgttttgaaaaatataaggggtcctttctctgcttcaagaaattacaagtttcttttccaattaagctggaggcatggcaattgaacaatgagaaacttgcaaattagttaaattctttacatggtgacctgatgtttgaggtagggtctggattcaaggtcaacatctaggaaaaacagaggaaaagctttttgaaaagagggaagtatctattgtataataccacttacttgacaaactgaatgaggtttatttctattatcaaatacttctttttttttctccctgctgatctttatttttttttttcattttcttattaagtattttcctcaattacatttccaatgctatcccaaaagtcccccacaccccccccccactcccctacccacccattcccattttttggccctggcgttaccctgtactggggcatataaagtttgcctgaccaatgggcctctctttccagtgatggcctactaggccatcttttgatacatatgcagctagagtcaagagctctggggtactggttagttcataatgttgttccaccaatagggttgcagatctctttagctccttggatactttctctagctcctccattgggggccctgtgatccatccaatagttgactgtgagcatccacttctgtgtttgctaggccccagcctagtctcacaagggacagctatatcacggtccttgcaacaaaggcttgctagtgtatgcaatggtgtcatcgtttggaggctaattatgggatggatccctggatatggcagtctctagatggtccatccttttgtctcagctccaaactttgtctctgtaactccttccatgggtgattgtttccaattctaagaaggagcaaagtgtccacactttggtcttcgttcttcttcagtttcatgtgttttgaatcttgtaccttatatctcgctatactaagtttctgggctaatatccacttatcagtgagtgcatttcatttgagttcttttgtgattgacttacctcactcaggatgatgcccttcaggtccaaccatttgcctaggaatttcataaattcattccttttaatagctgagtagtactccattgtgtaaatgtaccacattttttgtatccattcctctgttgaggggcatctgggttctttccagcttctggctattataaataaggctgctatgaacatagtggagcatgtgtccttcttaccggttgggacatcttctggatatatgcccaggagaggtattgcgggatcctccggtagtactatgtccaattttctgaggaaccgccagactgatttccagagtggttgtacaagcctgcactcccaccaacaatggaggagtgttcctctttctccacatccttgccagcatctgctgtcacctgaatttttgatcttagccattctgactggtgtgagatggaatctcagggttgttttgatttgcgtttctctgatgactaaggatgttgaacattttttcaggtgtttctcagccatttggtattcctcgggtgagaattctttgttcagctctgagccccatcttttaagggggttatttgattttctggagtccaccctcttgagttctttatatatattggcaaatacttcttaatcagatataatttttgttcattgctgtcagtgttagtggaaatgctaatactgagtttcagaaacaggaagagtgtagaattaatttcttcctgtgtgcatgcccaggactagtttcaggtagattttccattataattaacctctttataatgcttggtaaattgtacatccagaatcagcagaaacctctctctacctctgttattttcctcatatctcctaccaagaacaccatccatgtgtcccacttactcagaagaccagttttcctcctggctatcaggatttcttacactttcagttttgtgctcagcttccactttccaaaattagctcaagttcactttctcataaggaggaatcattgaacctttcccaacctgcctcagagattataggcttgcatctgtacactcctggttttaagaacatcatagggcagcactgacttgcctggaaacagctcgcaaggctggtccctcagcttcttcagtgaggatgtaacactgattttctttccttcaagactgcaaagtcttccaagtctgcagacccatgccaagcgtttgacaactgcctcgctttgctgtcagtagatataaacattcttcagaagagacattgttttatctgccaaatcaacaactggcatatattctgtatttctcatttatctacaacttcatatttacttccaaatttattcattttggaaaaatacagagtatatatttttaaaaattgaaagatagagatagtgaatgaatgtcaaaaatctttgagcatgtgtctggataaattatatacctgtagtaggaaatatatttaaacagttcctttctaggtcatttaaaatatttaacaatttccttcttaaggaagtatgtgtgtgcttgtgtgtttcaatatatctttaaacagtgcataaactctaaagttctatgcaaatgatgattttgttatgttgtattctgaaattatttttgaattatatcacatatatttgtgtagcccagtaaaacaaacagctgattaaggggcaatcatttcccctattttaaatcacaaatattatggataattatgaaatagagctccagaaacagatgtgtgcagcagcgttgtttgtgtgtctggtgaggtacagtagaacctggctaaattacactaatgagctagcgacccattacaaatcatcacatttgcccaattaatgttggagcaacatagagaaaaaagatttttaagcaagtcagctgatagaaagggaagaaaaatcctaaaataaatttaaaagacatgagccatgtacacacatatatacacatgcagtatgatgcagtgtcaagttttaatttacccttttagggttgttctagtatcacaaggatgtcagaaagtactgccttgagggatcctgtctgttattgtgctctcacaattgctttgtttatagtctcaggaagccctagttcttttgttgttgctgttgttgttgttgttgttgttggtggtggtggtagcttttgagacaggttttctctgtgtagtcttcactcttctgtaacttgcagtgtagccttgacctcatagagattcacatacttctgtctccagagtactgagatgaaaggtgtgtgccactgccagtcaggaagaactactcttatctcacatttacttgagaaactttgtacacaaacgagaagagaggggggagagagagagagagagagagagagagagagagagagagagagagagagagagagagagaggaggggtaattatttttctaattccttgaggttataaaatttctttatttttttggaaatcaaaggacaatagtgcatttctgataattatgttatgtatggatttttttcaaacattgagtattaataaccatttggagcaggattttagacgatttccttcttatctcaaaggtggttttagtctctcagacatagactacatagacaagacattaattttatactttaggttaaaattatacctcccaaattatatctagatcttctacaaaattaatgtatagtttagtctttctgattttttcttcctttctcattgttattagattggttgcttgatcaacacaacaccattttcaccctttgctccatgatttcaaaatgtctttgcattttatttttaacctatataacctacttgttaacttgaaagcaaatgatccttctggaactgccatcttcttgccaaggatgtcgcatctgggttgtcttctagtttctagctttgttagactccatttgaaagttcttttatatatttgctaatgggcttatattgtactgtctacaactgcataatggaagatctaaagaacaaagtgcatcccccttcagtatttagtcactccttgctatgtaatagattgactatgtatgtattttgaattgctcaataagtttgttgatctgaaagtcaaacaagaaatttattcttggcatcctttaatatcaagtacaaggcatgttatttgtaagaagtctgttttccttccttccttccttccttccttccttccttccttccttccttccttccttcctttttctcccttcctctccttctttctctttctttctttctttctttctttctttctttctttctttctttctttctttctttctttctttctttctttctttcttcatgtagttctcctatgtctcacaagagtatgaacttgcataagacaacttcagtgtactatggtctttcactgccagatctagcataatctctatctgacatacaaatcaatgaattctttttcctaaaaatgtcatgaatagacaatctcagacacaaaatcattgattatgaagcattcatcataggaatgaagagattgtgtagctttcaaaggggcatggaggagagaactgtcaaaaggctggcagactgtgactgtatgaatttgcctttatttggcctttaacctccccagtgaatgcccacagacagttctgcactgtgggtgagtgcatgtaagactacatgtctgtgagaagatagaaagaaaaaaattacaagataacattgcaaacaataaatgagaattttaggtggcctaaaccatacagctaattcatgtgagccttatattttccaataagtttgactcttaacatttttattacattggaagaggtaaaggaagggtagagtgtgttgtcccgtactatcaaatctaagctttaatgattgtccattgctagagactaatctggaatggtatttgtgtcagcggtgaactgtatttagaaacagtattgcagtccccagcccagtggaaggattggagaggattgaatatttggggtcagaaggaagagattacttggcaaggttttcagatgcacagttacttttatctgtacacatttcatcaggtttggggatttatcagattcattgggttgtcaaatagaaagacattataggaaaggtattcgcgattggatcttccccctcttaaacactgcacattgaaaccacatttcaaagatactaattcttggaagtcttaaagtaagcgaagtgttttctactccacttatgggaaacactggaagagatcgtttggagctgggttgtgctgtgcatgggaaagtgatttgaagaagtagaattttatagcctgcatcccactggctgagcttcagaagtagaagctagtgttataaaataggctcgccatgatgattatggccacatataagatttctgtacatcaggcagtgaaagctggtgactcatttctgtaaaagactttctgctgttttaaaccaagttctgagaccttattgctgctatgagactttgtcgagttgaatttctttacccaagctgcttctccatggttgggtgtatgtctttgtgaagaagttctgacaatttaaaattgagataagctgcataacaactaaaaggataaaaataacttcattgccaggaatggggctgattaaacacggaagattagtcggggttggtttcagccttttagctgcctttcaagggtcaaagtcagggtctggcatggatgaagaagggttcaaatgacgtttgtggagcttctgacttctttaataacaattttcttccctggttcttttttggtttaacagtaaattctagtttgtttgtttgtttgcttgttttcttgaatgatttaaaagcaataggaattgcagaccggctaaaagaactataataaaaagaaatatacaatggggcctccctgtcttggcttctttaaaattatgtatatatatatcttacacaattgccatgaaaaagcatctaatatacttcaaaaatcaaaggcaaccatatatccaaggaataagatcttgttggatcacataggcctgtaaaatgtctcatactaatttttctttctttcaaatagtatgcaaagaataatatttgaagaattttggaagtcttctgtgaaacatctaggtttactttgatccaattcaatgtttttcaaatttattcaactatggaagactctttcatggaacatcagttaagacttagcaaattaatactgccccatgaaagctatgtgtcaacagcgacttaaataacagttgtactgtggatgggaatgtgcttattagtcaacactcacatgattcatacacgagtgtatacaaatgaaatcttgctttatgacagaagtcccttaggaatacaggtttggggtatttactcatcttaaatgaggcatggaaagcatgcaactggatgctttaatcacagttgaattacaaattcaagttgggaaaccaacctcttatcatactcttagaggtctgctcactctctttaatagtggaatatgtgaccatttgtccctggtaacagcattcacattttcataaaatatgattgtagggacatgttgatattgttcaaatacacatgttgtattgcatgtacaacaaccagtatgcaaacatattatattagatcaaaacattttttagttcgatatgctctccattacttttagtaattgacattgtactaaggggcagcatcaatagctgagtctgaatgaacacccaagaacacaaactctgtagacttttaatttccagagtcttttcagacaccagcagctctccgggaagaccaggtagcctctgcattgctgagggtggctgagaggatccagtggtttatagaatgcaggatggctatgaaatgcattcagatactgcttcttttcctaacacctcagcctcaaaacaaaacaaaacaaaacaaagagcaggcaagaatagaaagagtattcttagctgagccagcatgatatgaatgctgcattagcagctgctcactgagccgcagctgagcagatctgcagtcttcaagctgccccacatccttcctttaataccggctgcagaaattcccttgtgtcctttccaagcaggaagtctaacttcctcaggatgaatgatctttccaatctccttagaataggaactatcaggacatagatggtaagaatgcctttcggcacatcagaataataatgaagtcttatatttatataactcatgatcatggactcctcccctatgttttatatatatatatattacttaaaatcagaggtggtcttacataaatgtaggaggcagtgaagatctttagtctcattgatttcctttgaaagtaaaatcctcagagaagtctattaaactgacttccattccttatgcattttctttattcccaacagcagtgggaattctgctttcttcaggtaagacgtctcccacaatggaggagattgatgagatattctgtaacaataacttgtgagtcttgatatgctcactgagcaatctgggatgagagaagaggcttgtgaatgtacatttataggataagagcaaagacagttacaggcccatgggttattattgaataaccacggtggacctatgataacccatgcagagaaactctcttaaaggccattcatcagccatttatttagtacattcaatggcaagggtaacacatggaatgggtctgcttttaaatgaggatctaaacatgtagaattatgggatactaagaacaattaaaaaaatacataaaagccagatttacaattcaaattatttttcttctttcaaaatcagtggttttaatctaaacctatcatggaaattacagagaaatcagagtgacagcatttcaagagagaaaaaaggttacacatgattgagggtaacatttccccctaaaacttgtacttcaaattattaaataataaatggatatagaattcataattaaataatttctattaagtaatttcagggtataatttcccaaattcactgattttcataacatttactttttaccttttgttactctctaaacatttaccttaatgctgtcattgagaaattgtggcattatttggtcatatcaggatatttattattggtattattaaagtatcgggatatatattggagagttggagatacaatataaccatcccttcaaccacttatataacatcctaagaaacagctgatatgtcccactacttatgaaatatccaggttgagcaggacacagaatactacgatgatttgaagtacatcatgcagatagtaaggtttatttatttacccctcctccatcacaaagactaaaaaggtctccgtactggatttgctttcggtattttggaatgagattgcaatgaagcaaaaggatttaattttaaacctcatctgcataacattggccatggggacagcattttataagggatggagaggagtgtatctgtttatgtgcctgtgtttgggtggggataggacgagtgcatgtgtgtcttcagtgtgtatttccccccacattttctttgcttttatctttatttctttgtctattttgtaaactgtttttaaaattgttttaggttagctcccaagccatgtgttttcttggaactttgatgtaacagtcccattttattaattaaaagtcaggtcatgtctgatgttgctacagctctacgagagtagcacccctgttataatgccattctttttcttttcttacaaaaacataggacctagctatttccctccttaagcctagccccccccctcccgagtaactgagactataagtgtattatacttctatgccctgcttaaaagaaaaatgttgctttaaatattccatcaagtgtttctctggctcactcctgtcatcagtttcattccacagtgtgaataagtgtcctgattggtttttgtcaatttgacacacatttacacattccctggaagagggaagtttaactgagaaaatgcctccataagactggactgtagtcaagtctgcagggcattttcttcattaatatttgatgtggaattgtctagccatttgtatgtcttgccacccctgggcaggtggtcctgagttgtataagaaaacaaactgaacaagctatgaggagcaagttagcaagcagcattcctttatagcctatgcttttgttcctgatcccaggtttctgccctgagttccgtagctgatgcacctgtagcatgagacaatctccacaagttgctttggtcaatgtgttctatcacaatagaaaaaagacctggtagagcaatacactatgtcaccttttaagaaaatgttattggaaaccatatactaaagtttttatgcttaatgttgtcatttatgaaatgagaaattttgatgaggagtcctcttggcaatggtcagcacttcagatcaccttcttttcagtagatcaaaaatactgaaaacatacctaatataacttcttaacatttttaaaaaaaatattacttttttttcctcccaaagtttgccaactgcctgaacagaagaatcataccacttaatcaaaatagatcatttcaacccatcttttctcactgggtaccacttcatggactagagcctctgtggaaaggactcttctgtattattttttgtataatgttctcctgaagctgaccactagatgtctctgtgatcacatgctaggccaaatcagacacatgggtcaaccacttcagtgaagatgaacctcactgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagagagagagagagagagagagaaatagaaacaatctatcagaatatgcacatgaaaataagagatgatgcttagtgttcaaaatgaggcatggtaactatgggtagaattgttctaagatctctggacacaacttccccaatgtcccttggtttggggacctgttgttcttcatagtcctttctcacattttcattcttttatttatttttttctattttctctctcaaatgtaactttacctcagtaaagaccaagagcctatattggaaactgtttgtttttaacttaatgcttacaaagcagcctacatcacaagttattaggaaatgcttttgttggaatgttaccggatgagagaacaatccacttgcacagtagaaatgtaaaaaggaaggttaagataaattgttattaaagtacaaatcaattaatatgatttcatacttaaaattgttatgaatggagatatttaaattttaaaaataattttgtttgctcttaacattattaagcaatgcctatgtgtatgacaatacattttcagatcagccaaggaaagcatgagaatagatccttaaactctgacagtatccaccagcttctatctttgctttatatgaatcatacatatggtagtagtcatgtaaaaacaagttgagaggaaagactaagtaaatgttcttaatgatttgctctcacatgaaaatcataatttttagaaaatagtgctgtactcagactatctgtaaacattttggaattaagtcataattatattctttctacaaagagtaaaacaaaattgaactcaatttccatccatctcaaatggttacagactcccaatggataagaggatacaacactggctgtttgttgtgatttttaacagtcacttccagtgtatttggtcagtagttcagtagatcatgctgatctccttaaactgaggtgcagttatttcctgagggcaagaacaatagctgtaaggaattggcactcagctgtctgaatttactttttagccacttgaatgtgacaaaaaaatgcctacaaaggtttactagctcatgttatttccgagaatcaaagaagaaacagagaagcatggcattttcaattctgagtggtttaaaaatgggtgataataactaacaattacagatcttactatgagttgtaaattataagggactgtatctttaaaacaatagcttgcatttattaagtgccttttatataccagctgctgttctttgacctttgcaataaataaatcatttactcttcacatccaaccttattaccgttgctgggatctgaggcacagaaaggttaaaaaacttgttagtatctagaaaatcagacttgaacccagagagtttagcttggcgctccctggatcactagcttcttaggaaatttttgaatggtactggggttgctttaattggtgtgattgattctccctcactgcatatttcctaaacatcttcattggccagtttagccagagtaacagtaccattactttaagcctccctttttcttccatcgaaactctcaagaggccttttgatttcttaggtctgttgccttcatgatgttaggtaaatcagaagagttttttagttgcaacattttatttcttattattcatgtttaaccatgacaaatagtgcaagaactcataaggacatttacagatctcctcatggctatttcccttctatgcttaagttccctcttctattactttcattcattgcctagaaaactgcttctttctttctgtcaaatatacaaaaaatacttaagtatctttatataatttataaataaattccacaaacccagacactattgtggataccaagaagtgcatgctgaaaggagcctggtatggctgtctcctgagaggccctgccagagccttacaaacacagaggcatgtgttagcagccaaccattggactgtgcatggggtccctaatagaggagttagagaagggactgaaggagttgaaggggtttgcaacacctcaatgagggaacaccctcatagaagcagggggagggaggatgtgaaagggtgttctgggaggtagggaaacagggaaaggtgataacatttggaatgtaaacaaagaaaatatccaattacaaacaaagcaaaacatgtgaggtacatattttcaagtcaagtctgaattatttatttagtgagacaatttttatttgcatctttttttcatttctgtgatgtaatttcatttttatagccaaatatgtgcatgtgtatatgtataagtatgtgtgtgtatgtgtatacatgtagtacaatatataatatgtatgtatgtatgtatgtatgtatgtatgtatgtatgtatgcatgtatgtatttcctctctatacctcatttgagaggcttattaaaactttctgcttcctcattactgtacctacactctcgttacatttctcaagtgccgcagcgatgccctgaacttgggctacaggataacagctcaagcacatattcattgttcctacaaatcagagactcatcaggatttctaggctttgcttcaagctgtactgatgccaggtaacttcacaaaacctttgtcccagagtcctatctgatcatgcaattttctatttgcatacattttcctcttctacttggaccacccaattacatgaaagatgttcatggcttaataaagtaaaagatgtactgaacatcagtggtgtccctataagaccgcctggttctgtgcgcattgttcacattcttccctgcggtactcagtgctgcatgaatttcagctttatgggctgtgaggattatttaattccttaggcttcagtataggcttcagcaagtatgtgataatgtatacactatatttggcactctagtactatatttcatatacagtttcctattgtgttatgaatagttatgaaagaggaaaagaaagagagaaaaaaagtaaaacacaccattgccctgctctgctatgccatttgtcttgatgaaggaatgttattatctaccattatgacaaaactaacacttgaacgtatgcaaaagggcactcaagttgtccattgaattttcatggaatttcaaggtaatttctcttctaataacagcagtggtagcaagagaagcagcacaaccgccactaccataatcatcctcacagtcaccatcatcatcctgactaccacaacattccctatcactaccaccattatcatcatcaacactaccaatgccatcagcaccaaaaatcaccattactatgaccatcaccatcatcatcaccaccatcactaccattagcattatggtcatcactatcattacctccagcacaatcgctaccatcagagtaaccatcaacatccaccttattgtcatcaccactaccaacactaccatcattatcttcatcaatatcactatcaaaaccaccaagaataaaacagtagactttacctattctaaagacacannnnnnnnnnnnnnnnnnnngtgtctactcttgttaaaaatttactcaaaagtgatgaacaatacacttatctacatggtatggaatactcagttagccttaactattctttccttacctagcacatgcaggttactagctgaatcttcaagttggccttaaaaatataagttagaaaaatgcaagtcaatgaaacaaacaaacaatcaaaatacttaaacgagacttgaaatggcatcaccactcctggaaatttcctacaaatatctctgcaatcatgtcttagttactcttctttactttcccacaactttgtgtatgattttgggttgcatgtcattgacaaatagtacacttatctacaaggttatagaagagtcagggttaaacataactattcttttcttatggttgtgtgctctttccaaggcttgccagatgtatcattgtcttagggcttcacagaagctatcaccccgtcactcagacttttagatgaaatctctcttctttgcatgagctaactcagctttccaatcagcagtagataatctgttatgtgacttccttgaacaatttatcattttgttatttgatcacattgttcaattactgtctatggaccatggagtctagttctcataggaaaaacaaaacaaaacaaaacaaaacaaaacaaaacaaaacaaaacaaaacaaaacaaaaactctgctttctcttactcatcactgttacactgtcctaaaggtttgtgaggcattaggcaaatactctgcatcaataaataaactaactaacaagtaaaactaccaaaattgaaaatgtgatttctgatttcaaattaatataaaagacaaatgaatgagcactggagaacaacctaccttcagttccttccttttctgtgtctgtttgatttctatagtcagagggcaatgtggttctcttcttgaactattcattactctagtttgcattaataaaacaattgaagtagaattaagattctttctttgtctgatgggtttgttgttgtttcatttggtttgtttgatttgctatggatcaaatccagggtcatactaatgttttgggaccgagttccactcctaatccaaagacccaaacctagatttaaagaggactcagggcttccttttctgtcttggagtcacaggtagcaatgcttataaaagattgttattgaaaagacttaaatgttttgttatcatgaagggaaaggccaggaagataggcaacatatttagatatttcctcatgtctcacgacgaaatcatcataaggtcctcatcatataaattactccagactatatgatatggaataaataattaacaagttgtaacttaactaagggagtcttgtaaagttattgctttaagccactaaatttcagtacagtttgtttctcagcaagagatggctgaaatatacagatgatataaccacaatggatcagaaagaagttaggacaataggcactaagcctgcttgtttctggtggaaaataactcttgcctagttacaaagcctttgataacttaccactcactcccaaagcagccaaggaagctcataagtcaattaggtattgctgtccattcactgccgtagccctataatataagattactttgagggctatttgcatagtgatgcttcagcatagcattaaactaggagaagaaattcctggtaaaacgtgtcaacactgaggaaacagcagaggtagtacttgccgatctaatttgagctggaatgctaactcacagaaatagtccaacaaatcttcaaaggatgggccattagaaactaaacggtatgaagtaagctgaggaataggaagtagaatggaaatcagcattgtgatgcaacagacatctggaaaaaaaaaaaaaccaaacaggatgcgctgactatattttacctaatgctgtcatgggggaacaatacccatgtctgtccatgaaggaagatccaaaccatctcccttgttctgtacatgtcttctaatatgtagttctatttatgtgaattctgaagctactcagctatcaaagactttctttgtgaacttttgaaggatggactattgaccagttttctttttgttgtaaacatgtatctgaaacaaagaaatgcaaagaaaagtgtttatctgagcttgaggttcttgaagatgtagctgatcatggtgacaggaaaggaagggcatctggtcacactttatccatagttaagaagcagagaccaaacaggaggtgaagtggttccattttaaggcctgtccttccctcattacctatgtctcccagtgaggttcctctacttcctaaagatcccagaacctttctaagcagtgccattcacttgggaccaggtgagcacatgagattttggaggatatttgacatccaaacatcagcagacagtattttaattcaaaagtttaaaaaaccttcatactccaaaggctctaaaagatggtcaattgggatctctacccaacagagcccctttctattaccttctccccacaccttgtatcttatatcatgctatttcttttttttctctttttttattaggtattttcctcatttacatttccaatgctatcccaaaagtcccccatacccaaccccccaaccccctacccacccactccccctttttggctctggcgttcccctgtactggggcatataaagtttgcaagtccacagggcctctctttccagtgatggctgactaggccatcttttgatacatatgcagctagaatcttctttgtgtgaacacatcacctccccttagagttcaatactctcctttataaagctggaggagtaccctattgtcagcaggctacactgtaaattgaataaatagtattttttaaacactatttaataaatagtggggagaataagtattgttattatttgaagggtaatttactacttttgattcacttgtaatcactttatcaaagtgtcattcagtaagaactatttgatgcatcaaatgtcttataggccttttaaaagagattttcattatcaaaattgttaagaggatttaccaaatagaacagtttggcatccaaagtgtttccagccatataagcattagaccatacacaagcacattgggaactagcaaagaccagaatgtgagtttatccctgcatatgtctgcaataatcctttaccaaatatgtacaacaaagagttctacgtagtaacatggtcaaatattattttagccttcccttgaacctttgtatctctgtggcaattttagtcacctcattcttcgatttcaaaaaacagagttttatatcatattgaaagactggtgggatatagattgtttcttgagtgatgctatttctagttaccctctacttagagcagagtgactgaatagttagcttccatgacctgatatagtcaatgagaggaaagggcttttgatttttaaaaaatatactataacactatattccaaaagctaagtttaatattactcatgggttaaactattcatgggttaaagtatatagttcctaccacccacactttagctactggtttaaacatatcaattttatttatttattttttttgtttattttatttatgtttgttcaaacatactccaggaatatttgaacactttgtggagaagcgtggcgccagatgtaatctgtttaaagggcattttcaggtagctggtacctttcctcagggttttatggtgattaaaggaaaaacctcatcataaaaacaactgcttatcccttacctatgtaaatttaacaccctcaaaacccaaattggtatccactctcagccactccactagctttattttgttttgaatcccctccgtgcatgggtcttttttgaaacatgccacagactgtgagacattatgagctctggcctcaatctcaaccccagctttttagtactagtaaattctctagttttaattgcatttaaaaaatcattattcctttctgccatttatcttattaaatactttcttttcaggacaaatctctcagctgaaattcctttatataatacaggaaattttgttcttcaaacagacaaaatatggggatagagagtttcttttgactattgtaaggccatgaggaagtggcttcataatgtgaataatgctacaccacacttcttgaattctccctttcctaagactctttgttgttcagttgtatcttacttctcagtgttggagcagcatctggataagcttctaggcatgtatttcctcttcacttatctgaagttcctgcctttatttctttctttgtccacctatcattcataatatttccagaataatgtttctcagtcatcattaatttttttgccatttttataatcaaaccattagttgacacccccatggtccacaatgaccagctttcaaattttgctttatagatacaacctaacaactgttatctgttttaatgctatcagatataattttggttggagtaaaaaattatgaatagaaaaatgttgaagaaaacagtgaataaaattcaagttttatgacacaaacacaagcactcctagcattttaccccttgcccctactctgacatggtagctggccatctacagcccatgtttcctatctccattacacctgattgcttgtgaacatccaaactattcctttacctaccttgatatttctgcttctttgaaaatcctacagaatacctttaaaaatatttttcattgtgcaaagtccatcctaggtatttctacttgacatctcatcatttggtattgctactctggattacaattacaaagagatacgtttttcacaatacaactactcaacactacatctacttttccacaccattctgctattcacggctctctaaaagagagagttgagccttaaagaggttattttattgttgcacacacacacacatcttttattcactataaagtatagcatcaaaaagaatcctgctattttaaactctacttaagtgagtgtaatagtgttgaaaccaacaagatagcaaggaatggagagcacggttcttaattcccattgctagcaacaagcttccatgtgagctatgttatctaccacttgtgaatagtttatcttatttgaccatttttttgtcatctataaaagtaggaaattcctttcaggaaagctgctgctggtggtgtgtgtgtgtgtgtgtgtgtgtgtgtgtgtgtgtgtcacagaattatttttatattgcatattttgaataagatagtttaactgtgattagcagaaaattcattaaaaaattccctagaaatggtaagttatcttgtgtaagcagatgctcaggagtgagtagacctcactgtctaatgaatgggccagtcaacacctccatcaaaggttccactttctagtcttcttgtcatagacttttcaggattttgagaatcaacctagaacccatgacctgcagatggttgtagtaatctgaagatgagctttgcacaaagcttttcgtatactttttccttggaaaatatgggagttttaattagatgatattttagcagatttccctaaatgaccacagaaaactactacacctcaaggcctttcctatacccatctgtgtaaatagaaaatgatcatcaaagatgattggggttggttatgattgctgtgcctgtttagcagtttgttggctctttagaagacagtagccatagttagttggaacacagccagtatcttgtcaatgcaaaagcatcagagtacaaccaatagagcaagtatccaagacctcttctatcagccttatttttttcttctctcaacacccaactttaaagaataaaacattctactttctcaagaaggcagtttcttttatattgacccttcatcttcagccactgttggtatcattatatattcttcagtattctggtgagggcacacaatttgcaatgcttgtttcatgagcaatatgtaggaagagacatgaggggcaagtgggtcagttttcagcctcactctgctcctgtcctacagccccaaactccttcctgcttaattaaaactgcaggaggacagcaccactgcaagtcagttcagcttcctggatcgacaatgatgctgattccacattcataattaattctccccagtgttaagaatggagcttgggctgattaaggattcttggtggattattgcagatgtctgatttgctaaaacaacagcagccatgcggtgtcttcttgatctacataaacttgagatgcagaagacgagaagaggcattttatgtttccctccagaaatctcacttgacatttagcaagggacatttgttagaatgtcagtttgataaaactgtttgcaagagtcactcagaatttgctactgagctataacaattgttaagagccgtaattactccaggcaggtttaaggaacaaaatattattagaatacttgggccaaacaccccaagcaagtaaccatgcttcttctgtcttccagttgaattagtgtctccctgacacactccaaatattttggcagcaaagttacccacagtcaagaaggcaagtaggagtcagtaatgatcaccaagggatgagcagaaaggtctgctgacatagaactgcatatagaaaacaaatttggggagtgaattccgcatgtcatatcatgataaccaataattatatcgcaaataataatggcaatcaattggattttgtttactatgagcctctataatgttatataagcttcttatagcaacatttacttcactattccaatcctatcagggagggcaaataattatcaccacttacacattaggacatggataggcatattaccaaccatcatagtatggctaggccttcaacatattcattttataacccattcatagctgctgtatttcattaccttcttagtgtctgatgcttgtatactgtattgtataaattgcatggtacaagctattcactaatgtatggaaatgtagcaataagctaaaacttgttgacaaatctttaacacagtatagggcatgcattattatgagtaaaaactattctggttaattattaccatgatctcacacttggataggtatacctatcaacttcttaagtgcaaatggaggaagatacataccaactgaaaagctaaaaataagtagaatcaagaaatactacaaaagcctggatttgaaaagggaaatttttgataaaagaaacaacactgactaagataagatgtgtgctccattttggagaaagccaattaggataaatgtttattattgttaagtctttgttcattcattcatccaatcatagaaaaagtgttttgaaaatcaattttcagtggaggcatttatacagcactgtttgtagaaaggggaaaaatgacactcttctttttaaaggcaacattggaggggaaaagaaagccatggaattacacaggttagaataccatggtactctgagaggcaagatctattacttccttgcaagacttcttttgaactgcctcataggcttgttgtgcctctatttgttgcatagtatctgggagacagctatgttgcccccaaatcacttcggagaaatgtagacattcaaaaagggactcctgtggagtacttgaaagatttcaaggaaacttgtctcattattatttcaaggttctattattccaaaatgcctcctcaaatgctatcaaaaggctgctcttcagactttcagaactgctctgcacataaagtgagatgttcctggaaaagaacagcagtttctccttgccacatactactgtccctcacatcctttgtggcaacagaatgcctttttgggcttgtttttttctagttgagtcaagcaaggacacaacttagagtgtcaaaaggtggaggggctttgtatatgagtgtggaatgactgaggaggtacaggcttataattctagtgtttgtaattactgtgagattgacaccagccttggctatggagtgagatcctatcttggaaaatgaaaaatgatttatatatatatatatatacagagagagagagagagagagagagagagagagaagagggagtgttggaaatagaatcagcaaaggcaggcagggttaagtaatatgctagaggcaatactagagttggaatggaaatggagatgcaggaattggatattcagaaaacctttaacctatattacagactctaagctaaccatgagccacagaaccaccttgttatcctttctctgtattaatttataagtgttttaaatgagaaaagcgtatatagttagaagttagaagtcagtgtgatggtcacacagtttccttgtataatatttaaaagtctataacaagcatattttaaaaatattgacaaggtttacatctcatcctttctgggttgtgtcacgtgtttatgctcggctgtttcttgctgtcataaagtcagtataaacatagtattttaccttttcagcccggtctcttagagcctttcgttattagctacctttccagctgtactagtctcctcccactccttctcctcttccccttcttcttcctcttctttttatttatttcttcgtccaaatcctgaacaaaggaagcattttgataatggcctggagagatggcattgttgattaaagtgtgcatttaactaatttcccagcacctttgtacaaaactgtgtgtaactccagttgatctgacactctcttcttgtctctgctggcactgtattcacatgtaacccatacacacacagacacatagacacacacacacacatttacaaactaaataaatcttgaaatctcccaatcagacacaatttggatgaataaatatatttcagaatatacatatatatttccttgttacacatttttagcttaccttaaagccaggactgattcatattatttcttttgaactaagtgtaaaacaatattggccatattaaatgcttagatatacattaagtttttaactaaagatttataaaatgaatgaatatatactacaaattctctaacttacacagatatttaaaatttatgtagtcttttacttgtaaacactttaactaatttaattttagactctgtattatgtctttaatttatttcatatagtttaatttttctaatcaccctatagggtagaatttattgtttccacttaacatatgagaaactaagcactatgaaacaatctagttagattcatataatattaagccaaaaaaacaggtattttttaaatccccaaatacctaaagatatgtttgtttttttcatagttggagttatatcttaatcacaattatcttatatctgtataagtttacactaatatttagatcacttctttagtcatagagtatgtatccagtcttacatattattatttctttcaatgactgtgttatagaaaagttaatcatgagccttctatttaatgttacagggtaatgtataaaactccgtgattccatgtgtgtacatgtatgtattcatagacatttgcatgttttcaaatgttgttgcttttgttatatctgatagtcaaattctacccatatttccaaagaaattaatgccttttgactgggaaaaactgatcagattttagatatgcatttcaaaatcttgtaattcttagaaagtcttgttctctaatatagtttcatcaaaattccaggtggaataatatttgtgttcatgtgtgtatacaagtgtgtgtattttgtgtttgtgtgtgtgtgtgtgtgtgtgtgtgtatgtgagagagagagagagagagagagagagagagagagagagagagagagagagagagagagttggtcatagatcactaaatatcatctattgttatcttcctgtctgtctgtctatttatctatctatctatctatcacctatctattatatatctcatacctatctatcatctatctatctatctatctatctatctatctatctatctatcatctatcctatcataaatcctctctcagactctagctcataaatttagtaaggctagctaatcaaagaaatgccatgagtctcctgactcctccttcccagcactgtgattagaggcatacactatagtagtttttcatatggttattgaagatctgaactctggtcctcaagattgcatagcaagcacagtactaactgcaccatctcctgagatcaacattagatttttaagattagattgtgagggaaatgcagataagtctaattagaaatgtacatttagattaggtaggtaattttctaatagagtataagacatatagtccagcaagtatatgaggaacttgctgaaaatgatatatgtgataaaacaactacagaccaaaagggaaagatatgcattagggtatagcaatatatacagcgttcagaaagaggacatgtggggcacttattttatgcatataaaacattcatattgaagactgacttgcctagggttatttgttagtacagttagataatttgggattcaaggagctgaatgatggtgaaacccaaacaggattttccatttgatagaagctgaaatcttttggagtttgcttattaatttcaaattctggtcctgagagactgtgctcatttgctgatttgtagatttgcatgattaccagtcacaactgagaaaataagcgaagagctatgccaaactctcacatagtggatttcagtaagaaatttgctccttcaagatacttccatcgttacaaggatagaacacatgtcacatgcaaaatgtaagcacctctctgttcctaggtctaggcttgtacaggagacagtcctttttgttttccaaaaaagggactttgactcaggctgaagccctgcattattcgctctgagttttaaggacaaaacttagatttttttttcataagccagtactggaaccttccatagaatcctgaagcataacccactgtttctgccttatattcttcatatggatattaggaatgtgacaatattccctgtgatggccatagtggtaaaaacagtcaaatattgacagtatttcattatttttttctaatagctgtgctctttaattaccatgtcctgctagatagacatttactcagcttcagtgacctatttctattttaattcactgttgttattctctaaggaaatgacaatatgccttccatctggaattacgagtccttcctttatttttgttgcaaaaagctgtgcacttgggaacctcttaagtttggctcatcactccaatgttgtgctgcaggaaatggaaaacatcagaggctaaagcatcttaaatatcaacagggatgtgcgagttgtttttttaaagaaaaggaatgttaactatcagaaaagtgctacaatatatttaggtaggtattaataggaataaatacttacatatttttttaaacttatattttttaaacattcttttttagagagtcactgcattttcacaatgaggtagtgtggcttctaacctggagactattgttttactactgtgagaacttgaagggaagggaagtctttgcatgttgcacaattagcaccacatgcaagtagtaaattttttaaatttttttccattttttattagatatttagctcattaacatttccaatgctattccaaaagtcccccatacccacccccccactccccctttttggacctggtgttcccctgtactggggcatataaagtttgcaagtccaatgggcctctctttgcagtgatggccgactaggccatcttttgatacatatgcagctagagacaagagctccggggtactgcttagttcatattgttgttccacctatagggttgcagttccctttcgttccttgggtgctttctctagttcctccattgggggccctgtggtccattcaatagctgactgtgagcatccacttctgtgtttgctaggccctggcatagtctcacaagagacagctatatctgggtcctttcagcaaaatcttgctagtgtatgcaatggtgtcagcgtttggaagctgatcatgggatggatctccggatatggcaatcactagatggtccatcctttcgtcacacttccaaattttgtctctgtaactccttccatgggtgttttgtttcctattctaagaaggggcaaagtgtccacactttggtcttcattctcttgagtttaatgtgtttagcaaattgtatcttatatcttgggtatcctaagtttctgggctaatatccacttatcagtgagtacatattgtgagagttcctttgtgattgggttacctcactcaggatgatgccctccaggtccatccatttgcctaggaatttcataaattcattctttttaatagctgagtagtactccattgtgtaaatgtaccacattttctgtatccattcctctgttgaggggcatctggtttcttgttttctttgatgctcttgtgcttgatttctgttatatcaaaaggaagggaggtcagtgatggggaaagcagaagagttaagctaactcagcatggggttttataaaattgctcttttgacccatgcttctttgttttgtctttatgattactacaagtaatcaggataaataaaatgtgttagtcagaccagtttcgtaagctttactgtcagggaagaatactaaaagcaacctaattcttggtaaaaaaggtggctaaggtatttagggcaggcagaattatttgtgctaatccttctgtttatttttcttcttcttgaagactttgtagaatcctccccccacccaaagacacatgtatcaaactaaactaaaaccaagccaaacaaccaaacaacagaattactcatttctctttaaggggtatggcctttcatgatcaaagaaataatacaacgtaacagcagtacggaaagttcttcaagggttgtggcctgtggtatattatccatgatccaatggacagcttcacacccaggcatagacaggcagctctgattaaactaagggttagaagttttttgttgttgttgttgttgttttttttgttgttgttgttggtttgtttgtttgtttggtttggtttggtttttagaaggaaaggatatgaagttggtgaggcttttctagaagaggttaggggtgacaaccttggtagagatcctcaaaatacttcatacacatgaattatattctcaacaaattgataaatttcaaataatagcactaagaatatagtgaattcccctgcttgctccccattgaagaccacagagcttagatgatgaaaatcagagacccagaatcatgcaagcaatgtagaatggagaagaaaagggttgggggcatgaggttctctggtaacagttactgcatttctgatgggacagtttagacaaatgactttcctcatccttactctcaagcactaagggaccttgaggacactttctttaactttccttcctcctagaacattagtagttcaactgaaggtcatgtaagtgctcattgagacatatattatgagtttgtaaacactcataaagtcaaagaattacagaacttcggggaatttagagatcactctgaaggttttcttgacattgaacgattacaagatctcataaaaaaattccaacatctaaaacaaattaaattgttgctgatctcctgagcctgaagggagactcaaagcttttactcatcctcttctgggatgccctgtgccctcagaatatacttagaaaaccatggttctaatccaaacagctgagttcacactgaagaggctcaatccataaatagatagaatcattttctcaagctttgcagtgaattagtggttaaacttcaataaggacgtaaatcctcttccttctaacttagaacactttataattcatcacagtctttgctcagtcattctgggactcttctttgtaaatcaggttgctatgaagagagaaaccagagaccattgctcatttattcactcatggaactaatcatctttgctttagctgatatcatctccctataactgtctgacactcacagaatgtatttgccttcataaggtttatgaaaggcatggcagaagaaaagaatcagcatgcaggaagttgacatttgatttaaattccttaaatgcttcaagcctcacttctttctgcattaagtctcgctgattatttgtgggcaacttgttttcctgtgaacaacttctgcatagaaatcatggctaaagatgcatccccagcagatgcactgtacatggaaaaaagactgtgtctaaataggctactttttcaagttttaattggtctaattacttcatgtttgtaaagtgttttgaagaggaaaggtgctatattagtgtttcttgttattattttagttcccttggcagcacttactagaatcttcaattgcctttcttgaagtaacctaataatcaaattgccagtgaagatttattctttctttctcatcttctttctttctttttcccccaggaacattgtttaaacaggaggaaaactgggagactaatgacatataatgtaatcttttctttggttaactctgttcccaacatctttccagaattaaggaaggatgggatttatactccatcagtacttccagaataaatgttctaaagggttgaaccctagctatctcagagaccattgcctgccagtataatgatcttctgtggaccttttttaaagactaaggcttcttccagaacctgcagatagtaagacaatcttgtagacaagctgaaaaagcaaggtcttctccctttcagctcagttcttcctatgggggatggaagaggatgtacatacagacatctgcactggttagaaatttgcaaagattcactatcctagggagctgtcttctttcttgtaatgctggacttttatttcttcatatataaaatgaagcttgatttcttcccatatcatctgtctgcttttacataaaaagtttgattttcatgaggatattttcaaatcctttttctcatagccaatgtttttgctgtgccttttcaggttcttggtatctcattgcaagccttgaaataatggctcaaacagactaaaaattagcaaaagaagcaatggtctacacagaaatgtatcgactaccacctctagctaactgagaaagaaaaagagaggggataagagggagggagagggaggaagacggaaagagatgggaggagggagagggaggagcaagaggaaagggactggaagaggagggagaaggaagagatcatttctaaagttcactcatagaaagcagtttgttttcatgcaaattcaacccaagccagttcaggccagatcatttcatctcgcttcattgcagcaaatgtttgaggacaagtctgacttgaaatgcactgtgtcagaggactgcaaagaggaataaagtggttccaacagttatagcaggtaaatgtgcaacgtgttgttggaaaatctcaagttgccaatagatgactagatttactttaagaaaaggaatgtgggtacaatgtgtgtgcaggtgaggaaggatggcaaggctattgcttggaaagcaatatatatatatatatatatatatatatatatatatcccaaataaagtgtagttccacggtgctaaaccatttcctatacatataggactcattctttcccccctttttaattttcatagtttattttcccatacaaaatattatgaattcaatttcccttccctcttctgctcctacttcttccccactttctttcccatggatctctactccccctttgtctcttattagagaagaacagtgttctaggagaaagcaacaaaacataataaaatataataaggtaaaacaaaaagtatatcaaagttggtcaacacaagacaaatgaaaaataaaagagcctcaagagtaggctcaagagtagaagaaccactgatatgacatattctggagtcccatagaagtattaaaatgaaagctatagcatatatacaaagaacagtgtattctagttcctcttacacttacatctgtcatctttcttctatccccattccttccctccccctgctcctggttcttcatataaactccactactgcattcacttctttttgctttgctttctcttgagtttagtcagaactgtctactggagtcagatgggctccttctccagtgagcacacaactaaagacaaagcctctcccttcactagaattgtttagaagcattggtcctaaatgaggacccatgacttacagctgacagtacaagtcttgtgagggcctttgctggcagatggtgttgacctggaatggtgatggaaatggctttgccatgccatatagatagatctcaaccattagttctatcttcaagcatttacattttcttccctcatgttctgtaatgtttcttgagccttaaatgatgtaatacaagagtctgattttggacgagccaccatgaattcctgaatagccaccttttggttgaaaatagcagcatctctgattatagctgtgacagaggacctctcaccccctttgtttgtatatttattattacccatccagtctttatgatctaaaaacatatttcccagacttgtacaggcaaatcatctaattgccattagatattcacatagtgcttttcggagaatacatgattagaagattaattactgtctaggtcttttacttattcaaagattgaaactgatgatgacattaagatctggagaattggatcagtggttaagagcactgttcattctttcaaaagactaaggtctaattctctgtacccaaatggtgggttataaacatctgtagtttcaggactaatagttctgacattctctctgtttcattcaggttctgaactcatatggaatacagacatacattcaggaaaaatacaaatataaaatgtgttttaaaaaaacatacagattttacaattatataaaagtttaacatagattatcaattttattacataaacaacaaaactaaatcactctaataagtattatttcttaaaatttgaaataacaataatataatctatctagtattttctattcattaacctacaagaaaacatggtcctaatatttaatgattcctttaagactgaacatatgtccaaccagctctcagaacacaaattcccttccacactggcaaagtaagagtgtgagctcactagatcagaaatacctcctgccactttgtgtaagaagaagacaggtgtataaggagcaaatagggactgtatgtgtaacacagtgaatgttatagagtatgtagccagaagagaatccctgtgaaaacattccaattttcaaattataaaacatcatgttatagaaaaatgcactcgtgagtacgtcttctgattgcatcattgaggctgtttacttaaactgtgcaattgcttctagttcaataattagagaacaatgacctgtattttaaagttatacaatcacaaaagaactcaaataatatgtactcactgataagtggatattagcccagaaacttattgtagtgagatataaggtacaatttgcaaaacacatgaaactgaagaagaacgaagaccaaagtatggacactttgccccttcttagaattggaaacaatcacccatggaaggagttacagagacgaagtttgtagctgagacaaaaggatggaccatcaagagactgccatatccagggatccatcccataattagcctccaaacgatgacaccattgcatacactagcaagcttttgttgcaaggaccatgatatagctgtctcttgtgagactaggctggggcctagcaaacacagaagtggatgctcacagtcaactattggatggatcacagggcccccaatggaggagctagagaaagtatccaaggagctaaagagatctgcaaccctgtaggtgcaacattatgaactaaccagtaccccggagctcttgactctagctgcatatgtatcaaatgatggcctagtcgaccatcactggaaagagaggcccactggacaggcaaactttatatgccccagtacagggtaacgccagggccaaaaaatgggaatgggtgggtaggggagggggggagggtgtgggagacttttgggatagcattggaaatgtaattgaggaaaatacgtaataaaaaaataaagtcatacaaaagggagcagcatggcttgtcacaggctctagataattttttgctgttgttgtttcacagtggatcaccatcataagtgtcagactcacttctcattgacacatgtcttataaatgatgaagaaatgtgttaattatatagaacattgggaaagtcaagcaattctgaaatgctttctttctttcacaagattgttaagaataatgcttttcttcgggtcctcacctttggcttcctatgtgaaccccattaaagcccaacagttaaaaactattagatagtcttcctgcacctgagcttttgacacatggagaataaatgaagcatctccaaggctctgttttgcccagtgcaagatggttatttcaattgttaatatctggatatgtcactttagtaattaaataagaaaaacagaatgaaagaatgcatgtagtgtctttggcctttcattaagtaagcactgaacatgaattcttctcttatttatcacacaccgtaaattattctcttttcttagagctgtcctaacatgttaatgatttttacttggtgaggcttaggttttgcaaatatcttgcaatttaattggtagctgagatgtttcactcactttaaaggaaaatataatgtcccagaaatgtcattaactagaaaagcagtgtattttgttccacctttaaaaaggattctgagcttctgagctaatatctatttatcagtgagtgcatatcatgtgtgtttctttgtgatcgggttacctcacttaggatgatatccttcagacccatccatcacttaggatgatatcatccagatccatccatttgtctaagaattttgtaaattcattgttttaatagctgcataatattctattgtgtaaatgtgccacattttctgtatccattcctctgttgagagacatctgggttctttccagcttctggttattataaataagcctgctatgaacgtagtggagaatgtgtccttattaccagttggagaatcttctgggtatatgcccaggagtggtatttctggatcttctggtagaactatgtccaattttctgaggaatcaccaagctgatttatagagtgattgtaccagcttgcagtcacaccagcaatggaggagtgttcctctttctccacatcctcgccagcatctgctctcacctgaatttttgagcttagtcattctgactggtgagaggtggaatctcagggttattttgatttgtatttccctgatgattaagaatattgaacattttttggtgcttctcagccatttggcattcctcagttgagaattcttcgtttaactctgtaccccattttaaaaataggtttgtttggttttctggagtcaaaatactatggaagaagttacagagacaaagttcggagcagagactgaaggaacgaccatccagagactgccccacttgaggatccatcccataaacaaccaccacacccagatactatggcagatgccaacaagagcctgctgacaggagcctgatatagctatctcctgaggagctctgctaggaaaatacagaagtggatgctcacaatcatccactggacagagcacaaggtccccaatgaaggagctagagaaagcacccatggagctgaaagggtctgaagccccataggaggaacatcaatatgaactaatgaattctcccagagctccttgacactaaaccaccaatcaaagaaaacacatggtggaacgtgtggctctggctgtatatgtagcagagaatggcctagtcggtcatcaatgggaggagaggcccttggtcctgtgaagactctataccccagtattgggaaatggcagaaccaggaatgggagtgggtgggttggggagcaggggattggggaggtgataggggattttcagagagggaactaggtaaggggataacatttgaaatgtaaataaagaaaatatctaataaaataaaataaagaaaagcagtataaactccccagtgtaaagagatggtttcttgagttctcctagatgtgacaaagcacaaacaaaaaaagagaaggccagagtgtcgtcgtcctgaccaaacaagactgtggttttagctttgagatgctgaaaatggaatgacacatttaccagattgtcagtggagtgtttgcctgatggcatgctgcattgccatcattactttgaaatgatctggaattgcattttcgcctgggtttcatcagaggtattttgatgtggatcactcagtggttgaatccttacttatttacttaccaattgtgcagggaactgagtcactcactttgtgagacccagtttcttcatccaacgaaaggatctctctctgagaattgctatgacaaccaaatggtgcaatttacctataaaacttttggcaggtttatgttgaaataatacagacattattatttttaatttgtaacatgataaattgcctgtgcccttccaatgaaggtgtaaaggaccatgacagcttggtaactcccctcagatcttttcttggtagagtgctctgatctctttttataagggaaactgcagacaggctagttagatgcaaccaatcagctgtataaaaaacatttcctcaaaacatttacccacagtccaagcagagcaacaagatggaaggactatagataatggagaagtgggtaatgatgtctaacatgacagacagggtagctacactattaacttgttaatactcaacaagtttatatgctttttaacccagtgaaaatgtgactccctgctttcatcagttttagccattattgtaactcaccctatattgtatgatggaaatgcgttggaatctagaaatagaagtgggtttcaattctaattctgttattaaataaaagttgttacttttctgatcctatgcaaattcagcaagttctctgattttcttggctcttgactgtaaaaattaaatatgctttgctgataataatattagttgaaccaacaatcagagaagcataggaattaatgtcatgtctgccttgtagagggccagagtgtgcattacttttctcatgtccttggctcactggcaacttcctgtcaagacttaccagagattatcctcaccttgattcagacatgtattttgggccctgaaactgaacttaaacaatgctcagaagattcagctcctgtctcttatcaaccctgggccaacctgtggtgatgtcatccttgccagtcttaatcataatccttgccagatattttaaacagggaattactgaaacactataagcatagttttggtacttagcctagctgtagcttcacacaggtgtctcccataaaaataatatatgcccaacattttctcagtatggaagattttgtaatttagaaaaggtgactttgtaaagcagacctggatgcacccctatgtctgcagtattaaatcagcatgactctttaggttggaagtgttctattatctatagttttcctctttgtttgcaaactaataattactggtgtgagaataaaagcggcttctcaggctggtgagatgactcagcagttaagagcaatgactgctcttccaaaggtcctgagtccaaatctcagcaaccacatggtggctcacaaccatccataacaagatctgatgctctcttctggagtgtctgaagacagctacagtgtacttatatataataaataaataaatcttaaagcaagcaagcaaacaaacaaacaaacaaacaaacaaaagaaaagctgggcagtggtggcccatgcctttaatcccagcacttgggaggcagaggcaggcagatttctgagttcaaggccagcctggtctacagagtgagttccaggaaaaagcagcttccctcttgattggtagtgttaagaactaccacttttatacatgcatgaccacacacacacacacatcctttatccttactgaccagttttcttaataagtgttaggaaatctgaatatgtaaacaaacaaacaaataaaaaaaatttccactaccaagtgtggatcttccctctttccatcaggaaatatctttctttcttcaatctgtattttacatattaccaaaactttaggatttgagttagccatcactcacaatcaactgtggattaataaaaatgatgttttctcttacttaagaggtttgagttttattgtaaagaccaaagatgttgaatcacggacctttaaatcaagatatatgtaatgtctatacctggtatctgaactgttttctgtagttaaatatgcatgtgtatgtatgtgtgtggcgggggaggggcaggaggtacaaaacaggtactttgggaactagtgaaagacagcttgattggattctagcaaacacgcatgacctgagataactgcattcctgtactctgaaggaaggttagaaggagaagggtgcgttgtcaagtgatagaaaagaaaacgatttcagcatacagtaacttcctcaggaataggtctttctgtccgctttgctcctttgcaacgctgtagtaataactactgtaagatgcttgagaaagagaattgcaagtaaatgaagaaaatgactctagatgtaattcataatcccctctcgacaagagtgcatatgtgtagttttacatgtaataaatgtgtatttgtgcatgtggaagcataaggtttggtatactttccagtagctctcaactttattatttcagaaagtggctctcctagatttcattaagctgaactgggtagctaacaagcactagaaccctcctgtcttcttgcctccatgcagccaggattatatatgtgcagactgcagcaaatgtcttttcaagtggaaattgggcatgtgaactcacggccttatgactgcctggaagtaactaacctactaaagagcatcattgcctcatttttcctattctcagacatttgcaaaggcagaggcatagtaagtgccaaagaaatataaactattttcactagaagacacacagcctttgtacagacgagacttatgctcagtagaagataaacagctatacctctaagtcacttctacattttttaatcaactgtttgaattactttgatacttttgatttgtttatgaattgtgtaaacttttctttttgaacagccaagcagaggtggtagatgttaacttagtaagctagaggatatttatatttcaattgttattatttatagagtttatacattttgattcttattctttaatggttttttcttccacaacagagacaagaagctttctgaaaaaatttttcttgaaagtatgttggaagcattcatcttttcatttgtatgttttattgaaacttcacaaagcagtgataatttattttaatactattgtacttagtacttaatacttattgtattagtattattttaatagtaatgatataaataaataaaagtaaatttttatttatttatatcattattttcatatcaaatgttgtcccaacatctagtacccctttatcagagtttctctccctgttttcctccctttgcctcagagagggcagcccccacctggtcctccaactctggtgcatcaagtcattgcatgattttgtgcttcctctcccactgaggccagatgtagcatccctccactacatatgtgtcaggggcctcagacttagcccctttggtagctcagtctctgtgagctcccatgagtcctccttagctaacatgtcttttgttactaattggtgttctgaaacttctgagaatccttgaccaaatcccacttgacaaatggatcatttttgtcttaaaggctatctccagacggggtgcagaccaacacagtcgccatcatcatgactatttaaaacaatacccttgtaactgtggtggtgtaggtcctcattgaatccaacacaggaagaagtatatgtacatgtattttgcagcagaacatcccatgttatacacatcctgaaggttatccaaaaatgtctcacaaactgccgagaaccacattagagagattcaggccagttccactgataaaataattagtcacaactgaaaggtactaagattatgtgacagcttattagaaagtaagcctgacctttatagatctctactccatttagtgcggttaataggcaagagcttttttcttgggtaactgtagggaatctcataatgagttgttcaacttgaagggatgtcatgacagagaaaggttgacattaatcaatcagaagccaaggtaatgacagagtaggttgctttcaactttcaagatgtcagatattgaaattaatgaccataccctgttggtgtcaccaaaacatatcttctgatacctctgacaatttacctctcaactgtgttttattgatcatttccagccctatcttggcttctactcttgatgcagagttattgcctcatgtctgtgtttgtatgggtgggtgtcggtgtgggtttatataagcttacatacacacctgttgacaaatgcattcatgtgtgtatatatgattcttgcacttgagggaaaaaaacactatgtgtcattagttagtcctatttctctggcaaatatcgatttatttagaagtaaactaatgaatgagagggtaaaatggaaacaaacagtaaacaacagtggtgagtgctcaaaggactagggcaaggatgaagacaaaaatgaaccatagtaaaatgtgctaatgtccataatgtagagatacaataactggccttggcataatcatcctcaagaaagggccaagtctgtgttgacatccaaagccagtcttgaacataaattaactttgtgtctcaagtaagtttcttactttatttgctttaagtctatatttcttatattcaaaagcagtttgataatactcacagtgatgttgtttaggtataatgagtaagggtccagaaatggagctcaatagcagcttcagagcatctgtgtagccctggctgccctggaactcactctgtagaccaggcttgcctcgaactcagaaatccgcctgcctctgcctgccaagtgctgggattaaaggtgtgcgccaccaccgcccggctgagaaccaagtttcaattcccagcacacacatggaaaatcacagctatctgtaactcaaggtccagtggatccaggtccttcacatgacaaacacataggccaaacaccagatgtacataagaataaataaatacaattttctaaattgtgtataggtttttatgttaatgcttcaattctcttaggtctacacttctaagtgaaattcacagatcatacagtcattcaacacttaacgttgtgtgggacgacaaaactacttttaaatgcagctgtaccacttcacattttgagtgctggagataaactttaagatcaagacatgaaatggggtgggggtggggcagagagacagcttagctgcttagagtagattctgcacttgcagaggaccaaagtctgatgcccaggacctacttactacacagcggttatgaggttctttagcttcaggggatctggggctctcctctggctccacataccctgcatgtacatagtgtccatatatacgtgaacactcatatacatgaactaacaatattaaaaacagaatgagacaaagacaaaagaacaaagatgaacattttctttcagaacaccattacatatttattatttataggattttaagtttttaatgtgtttttttttttctttttctttttttgcctcccagatgctgggattaaaggcgtgtgccaccaccgcctggctagagcatctgtctcttaaaacacaaatcacgtactgggtttcactttgaacattattattcatggtatttcctctatttgtgaattcctctttttcctcttcctatagcatctaaatcttactagcatttccaaccccatttttttatgaataagtataggatagctttcctccttttattccttaaatcacactgacacctataacatttagacacagatataatttataaaataattttaaaagtttattagtgatatatatatatatattatatatatatgaacatatattacttaacactatgctattactgaatactcagtgcacacaagtaaaccaaaatagatgcatttaatcaatagataggaatatcagactacacatacattaatttagatggattctgttcaaccatagaagtaaaaatccttaacatgccttcaactctgatttttttttaattttctttcttccctaggggtgttgcatttgttggtgtggagctgattctcagttaatggattataattgatcatggctttatagagtgtgcaagaatttttatctttgcttgatgacagttagccaattaaatgaatcattccttggatgagtaatgaaaggaactatttcctttgaatgttaaatccttccattttattatatagaacttattgtccataccgctgtcacatagtactgcaatctttttgtacctttatttatcctcttagaaacatgtttggacaatgttcctttcttttcattcataagtttttaatgtggtgtgctatttgatgatgtgaattgaattattggttgaatcatgaataaatgaaatagttctattcacaatgaaaaagtctcttagttttctagcagcagcatgcactgagttagaaaaaccaatgcattccctcaggaacaatgaaatgtatcagaaagtatatattctggtggtacaagtgagaaggctctctggttaagaatattttctgttcttgcagtagaccagagtttgattcccagattcccagaaccatgttgggtaccttacaaccacatgtaactctattttgagaggatttagagccctcttctagtctaccaagaaagtgacttgcttctgaacatacacatacagaagacacacacacacacacacacacacattcattcctaactctttgaagttcatataatagacactcaaaaaaaagaatgaaataaaaacgtgtaaagaaatgaatgaatgaatgaacgaattgacatattaaacaacatatttgctattccacagatagtaattagctcaatataattagacttaccagccacatattacttatttctatgaagaaatataaaatataaactctacatatctaacacttgtgttctcaatgattgtgctatagttctgctaatgtttactttgcctgaaaatctcctcaaagaaagtataaactccatgagcccaaaaaagccatgactttgcttcagtcctctttgtgaattatcagggataaagggacagaagagagtcactgaaaaaatggtagaatatactctaacatactataattatagtctgtcatagactctagcaatgagctgtgcatggttacataaaactttcacacttcactggtgtgaataaggagcaaatgtttaatcatgttcatcttaattttaagtgtgaagagccaagcgcacaaactgatactttatcaaacaacacaactagtagaaagaaattaatttttttctactagtgcacatggtagaacttgaagagtttcctctagaatttttctatatttgttacatctcaatagtttatttttttacctgtgattctctcaacatagtgcttcattttctcaaaacattaactgtcttcttgaatgaattctgaaccaaatattgacctgaatcttctaacatgactatatttcaattgtcctgaagcatttttctcttgatatgtaaaaagatttcccataacaccaggttctgcttggaggacagttaagtggtgatagaaaaaagttcttaaagcctgtacttttgactgaacagaattctttgaatggattttattgtaacaaatttatcaatgagaaggaaaacacagctgagaaagaaatatgtacctactggtggtttggatcagatagtttaagaaaagggtacttattaaatgttacaggttaacctcaacacattaaaatgtgctgtagaaaaacacccagtttactctaagtgaatctaatgttcagaaaaccacagaaagctgtgcatagctgtcctaagaattggcactatacagtcttatccataacaagagtgttctaaacattcttgcatcagttgttctctctctctctctctctctctctctctctctctctctatatatatatatatatatatatatatatatatatatatataaacttttcttttttattagatattttcttcatttacgtttaaaatgttatccccaaagtcccctaaaccctccccccaccctgctccccaagccacccactcccacttcctggccctggcattcccctatactggggcataagatcttcacaagaccaagggcctctcctcccattgatggtctactaggccatcctctgccacatatgcaactagatacatagttaaggggggggggtattggtttctttatattgttgatcctcctatagggttgcagacccccttagctccttgggtacttcctctagcttcttcattaggggtcctgtgtttcatccaatagatgactgtgagcatccacttttgtatttgccaggcactggcatagcctcacaagaggtagctatatcagggtccagtcagcaagatcttgctggaatgtgcaatagtgtctgggttcggtggttatatatgggatggatccccaggtggggcagtttctggatggtcctttatctgtctcagctccaaactttgtctctgtaactccttccatgggtatcttgctccacattctaagaagaaacaagtattcactcattggtcttccttcttcttgagttttatatgacactgtgggcctctccccacattgatggccaactagaccattttctgctacatatgcaactagagacacaagctctggggggtactggttagttcatattgttgttcctcctatagggttgcaggcccctttagctccttgggtactttctctagctccttcactgagggcctggtgttccatccaatagatgactgtgagcatccacttctgtatttgccaggccctggcatagcctcacatgttatagcgatatcagcatcctgtcaacaaaatcttgctggcatatgcaatagtgcctgcctttggtagttgtttatgggatggatcccatagtgggtgagtctctggatggtcctttcttccatctcagctctgaactttgtctctgtgactccttccatgggtattttgtcccccattctaagaaggaatggagtatccacactttggtattccttcttcttgagtttcatgtgttttgcgaattgtatcttgggtagtctaaggttctgggctaatatccactagtcagtgagtgtatatcatgtgtgttcttttgtgattgggttacctcactcaggatgatatcctctagatccatccgattgcctaagaatttcataaattcattgtttttaatagctgagtagtactccattgtgtaaatgtatcacactttctgtatccattcctctgttgagggaaatctgggttctttccagcttctgcttattataaataaggctgatatgaacatagtagagcatgtgtccttattataagttggaacatcttctgggtatatgcccaggagagcaattgctggatcttccagtaatactatgtacaattttatgaggaactgtcagactgatttccagagtggtggtatcagtttgcaattccaccagcaattgaggaatattcctctttcttcacatcctctgttacctgaaatttttatcttagcccttggccttgagaagattatatgccccagtacaggggaattcgagggccaggaagtgggagtgggtcggttggggagcagggcaaggggagtgtataggggacttttggagaggaaactaggaaagggaatagcatttgaaatgtaaatgaagaaaatatctaataaaaaaataaaatatctttcagaagtgttacatcctgatagccatacctccaacaaatatcctgacacccaagacagagagagagcaagagagagagagagagagagagagagagagagagagagagagagagagagagagagagagagaagagatttctgtatttgctactaaattacattgaggacaactggattcttcttcattgatcttccccagaatttgacttgtatgttagcttcgaattctcaatctgtccatgtaccagaatattacaaatctaatgaaaagaactcatcagtatttttttttttggttgtttttttctttcagcaacacaacccaataccattaaacaggatcactgtaattctgtgaactttgccacaaataacaaatctttagttgatgtactaaaaattagtcatcaagaatcagccatctgcttctctaatctcctaaagtgccatatcaaattggcagataccattggattttaaggaaaaaaatctgtagtgtgaaaaactgacattaaaggtttatgcccccttctcatggcccaataaagaatattaatggtaaagcatgcaaaggattaatagctcttccctgaaagaggcccagttatagcaatcttgagaaattctgcaggctaaaatatgagccttacagtacttccaaagcataaattatttgttttttcttctctgtgaaggagagcctgtcattccaaaggcaatttttctctttgatcctttgtactgtaatttcatgccctggttgggatgtgcctgcccacgtagagtatgttcgtcttgcaagtcttagccttgaaatccactcctctgcatcagccatccttctaaaataaacatactactaagaaaattggccttttccatttgatgtgctaaaatatattcagtatcatcatatgaaaaaacgagatgaaagcaaggcattgtgtgaattataaagtttatatctctgttctaaacatactgttcttttaatgttattttatgtggatgcctgtgtgtggtgtggttgtatcttcatgtgcatttaagtgaccatggaagcggaagagaccatcattttacctggacatatagttacaggttgttgagtgttactcaactttggtatggggaaatacctcttcaagatcccgggaagagcaataagaagtcttttttttttccattttttattgggtatttagctcatttatatttccaatgctataccaaaagtcccccatacccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctgtgatccatccattagctgactgtgagcatcaacttctgtgtttgctaggccccagcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccacttctaaggaggggcatagtgtccacacttcagtcttcattnnnnnnnnnnnnnnnnnnnngggcatagtgtccacacttcagtcttcattcttcttgagtttcatgtgtttagcaaattgtatcttatatcttgggtatcctaggtttggggctaatatccacttatcagtgagtacatattgcgtgagtttctttgtgaatgtgttacctcactcaggatgatgccctccaggtccatccatttggctaggaatttcataaattcattctttttaatagctgagtagtactccattgtgtagatataccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgttcaattttctgaggaaccaccagactgatttccagagtggttgtacaagcctgcaatcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgtttctctgccatttggtattcctcaggtaagaattctttgttcagttctgagccccattttttaatggggttatttgattttctgaagtccaccttcttgagttctttatatatgttggatattagtcccctatctgatttaggataggtaatgatcccttcccaatctgttggtggtctttttgtcttactgacggtgtcttttgacttgcagaaactttggagtttcattaggtcccatttgtcaattctcgatcttacagtacaagccattgctgttctgttcaggaatttttcccctgtgcccatatcttcaaggcttttccccactttctcctctataagtttcagtgtctctggttttatgtgaagttacttgatccacttagatttgaccttagtacaaggagataagtatggatcgattcacattcttctacatgataacaaccagttgtgccagcaccaattgttgaaaatgctgtcttttttccactggatggttttagctccattgtcgaagatcaagtgaccataggtgtgtgggttcatttctgggtcttcaattctattccattggtctacttgtctgtctctataccagtaccatgcagtttttatcacaattgctctgtagtagagctttaggtcaggcatggtgattccaccagaggttcttttatccttgagaagactttttgctatcctagtttttttgttattccagatgaatttgcaaattgctccttctaattcattgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacttccttagttagagtcacaccaaggtattttatattatttgtgactattgagaagggtgttgtttccctaatttcattctcagcctgtttattctttgtatagagaaaggccattgacttgtttgagtttattttatgtccagctacttcaccgaagctgtttatcaggcttaggagttctctggtagaatttttagggtcacttatatatattatcatatcatctgcaaaaagtgatattttgacttcctcttttccaatttgtatccccttgatctccttttgttgtcgaattgctctggcgaatacttcaagtactatgttgaaaaggtagggagaaagtgggcagccttgtctagtccctgattttagtgggattgattccagcttctctccatttactttgatgttggctactggtttgctgtagattgcttttatcatgtttagttatgggccttgaattcctgatctttccaaaacttttatcatgaatgggtgttggatcttgtcaaatgctttttctgcatctaatgagatgatcatgtggtttttgtctttgagtttgtttatataatggattacattgatggattttcatatattaaaccatccctgcatccctggaataaaacctacttggtcaggatggatgattgctttaatatgttcttggattcggttagcgagaattttattgaggatttttgcatcgatatttataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatctttgaaggtctgatagaactctgcactaaaccagtctggtcctggcctttttttggttgggagactattaataactacttctatttctttaggtgatatgggtctgtttagatggtcaacttgatcctgattcaaatttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttccttttttctagagcttttagatgtgttgtcaagctgctagtatgtgctctctcccgtttcttcttggaggcactcagagctatgagtttccctcttagaaatgctttcattgtgtcccataggtttgggtacgttgtggcttcattttcattaaactctaaaaagtctttaatttctttctttattccttccttgaccaaggtatcattgagaagagtgttgttcagtttccacgtgaatgttggctttccgttatttatgttgttattgaaaataagtcttaggccatggtggtctgataggatacatgggacaatttcaatatttttgtatcttttgaggcctgctttgtgaccaattatatggtcaattttggataaggtcccgtgaggtgctgagaagaaggtatatccttttgttttaggataaaatgttctgtagatatctgtcaggtccatttgtttcataacttctgttagttttactgtgtccctgtttagtttctgtttccatgtccattggtgaaagtggtgtgttgaagtctcccactattattgtgtgaggtgcaacgtgtgctttgagctttactaaggtgtctttaatgaatgtggctgcccttgcatttggagcgtagatattcagaattgtgagttcctcttggaggattttacctttgatgagtatgaagtgtccctccttgtcttttttgataactttgggttggaagtcgattttatgcgatattaaaatggctactccagcttgtttcttcagacaatttgcttggaaaattgttttccagcctttcactctgaggtcgtgtctgtctttttccctgagatgggtttcctgtaagcagcagaatgttgggtcctgtttgtgtagccagtctgttagtctgtgtatttttattggggagttgagaccattgatattaagagatattaaggaaaagtaattgttgcttcctgttatttttgttgttaaagttggcattctgttcttgtggctgtcttcttttaggtttgttgagggattatcttcttgttttttctagggcgtggttcccgtccttgtattgtttttttttctgttattatcctttgaagggctggattcgtggagagataatgggtgaattttgttttgtcgtggaatactttattttctccatctatggtaattgagagtttggctgggtatagtagcctgggctggaatttgtgttctcttagtatctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatgggcatctctttctttagatttgggaagttttcttcaataattttgttgaagatgtttgctggtcctttgagttgaaaatcttcattctcatccactcctattatgcataggtttggttttctcattgtgtcctggatttcctggatgttttgagttaggatctttttgcattttccattttctttgattgttgtgccaatgttctctatggaatcttctgcacctgagattctctcttccatctcttattctgttgctgatgctggcatctatggttccagatttctttcctagggtttctatctccagcgttgcctcactttgggttttctttattgtgtctacttccctttttaggtctagtatagttttgttcatttctatcacctgtttcgatgtgttttcctgtttttctataaggacttctacctgtttggttgtgttttcctgtatttctttaaggacttgtaactctttagcactgttctcctgtatttccttatgtgagttattaaattccttctttatgtcctctaccatcatcatgagaaatgcttttaaatccaggtctaccttttcaggtgtgttaggatgtcctggactgggtgaagtgggagtgctgggttctgatgatggtgagtggtcttggttcctgttagtaggattcttatgtttacctttcgccatctggcaatctctggagttagttgttatagttgtctttgtttagagattgttcctctgttgcttttgttaccctctatcagcagacgtgggagactagctctctcctctgagtttcagtggtcagagcagtctctgcaggcaagctctcctctttcagggaaggtgcacagttatctggtgtttggacctcctcctggctgaagatgaaggcccaaaacaggatctttcccagaagctgtgttactttggccaggaaggtgaccagttgtctgcagccgaaggtggcgccacctcagaagctctctggctctcgccttcccagaaatggctggcctctctattccacaccgtcacctgtgccacctgccctcagaggagtcctggagccaaggacaagaagtcttaatacctgaatcatttctctagttcctgaactataaaagttcctgtgtcgatgtcctcaagccatgagctgagtcttaacaatattaatatttattgatgaaagtaatttttatgccgggcagtggtggagcatgcctttaatcccagcacttgggcggcataggcaggcagatttctgagttcaaggttagcctggtctacaaagtgagttccaggacagccagggctacacagagaaatcctgcctcaaaatgaaaacaaaaaacaaaacaaaaaatgtaatttttttttattaataaaaagactcaaaccaatggcataaaacccttatctgtggtagatacatgttttcaaaaatttaggtccttttcttatttccttctagactactagagttcatatagtgcataatttatttttttaggcatgtgggtttgatttagaaatgttttaactgggttcttatccaataggaacaagtttgactgtagtcaagattagtgacaagatgctctttcgatagtaacaacctctatacaactgtctcaaatattgaatgtaaaacttaaccaatgtagattgggacatcagtgtttaccactattgctattattattctcattttaaaatagttaccatgtggttatcattatttgcaagttatttgataacttcttaagttcaatgtattcaaatattaattatagcataaagcatgtgtatatcaattaaactagtatctatttaacacatggtgcatggtataagtatagcaagtaacagtccttcttgccaaaatgcttagccatctgtgtctggatttcctactaggtaacttatcttatcttatcttatcttatcttatcttatcttatcttatcttatcttatcctatctatctatctatctatctatctatctatctatctatctataatatgtatgtgtgtgtatatatatatacatatatatatccccaacttcctcagaattccagccttaaaacacccaaataccttaattacagtgaacatagtaattatctcacatttagaaggatcatagactcagactacagagaacataaagagaagagagagtaccacgtgagatttccattttatacatgcacttacagttgaatttcttctctcatgttcagaggcacattagtttaataatttgaagtaaaaaattttgtgcatgatatggctcggctaatttgggatactgggccaagtgcccataactaaactcaatgctttttgagggcacttttagaaatagaggtggaattcgtggttatcatttagtattttgtgccttcagctatcagtaattttcagtattagattcagtaatttcaaggtcctgaacttcataaaatcccccccccccgctgaaaaattattcaatcccgaaaggcaaaattcaccttcattaaataaatgttagaaaaacaaatggaggtattcggtattagatatgcatgatccaagcatctatctctagatcattcgcacacacagctgaaaaatgtttagagacagtaaccaaatgccaattaaaaatatgtaagtatcatttttagttgtttctagaactgcttctctattttaatcacatcactaccttttaaaggtcaactactgtagaatcattcccaatgttcttagcaatgtgccttagttttcaatgggcctttaaaacacaaaactcaatattatcaatgaagataagtctaaggaatcagatacattttagtatttcattatatatttgttcactcacatgcatgcttctaaggagcttctcatggtgggtgattctgatctttgaggtgaacaaacatgggtttgctctgtccttactgtgtcctttcagtcctacttattgactcagttaattcttcttaaacacatcattttgatattcacattttaatatgagaatttaaaaccttattgcacatgaaatgcttaagttttctataaaatcaacatttatattaactattcctagtgactagtccaaatgaggtattctagtaaaatatttgagaaatatttgccatgtcacattgcaaagattaaaagcaaaaacatcaaccctaagagaacaccaaaaagaacttggaaaaaatgtgagagatgtcgttgtcatctaaccttaaaattgcattctggatatagaaatactgcatatgtatcgcaagttgcagtaactcactacaatttcttcaatctaggtctttttgtttcttttttttttttcctaagatggaaactgagccatagcttattccataaatggtcctgtgactttttcttaaaaagttttagttctttattgctctcctggtaactgccattttagaaaccaatgactgggttttctcacagtgtttcaataagtttcccttagttacagattaagatctggactatttatgaaaaagaagaaacaataatttgtatccattcctaaaatattctaaagctggttagcagaatgttcttagtgaatgtctgtgctagaaggaagggtataaattagaacacagaagcgtttgttagcaagaaatcacatgatcagaagatctagattttttcctgattcaagtttttatttgacattaaattaaataatgaccttttcaaatacactgtttgagaacattctgcacatatgtgatgtattttgctcaactgttccatactcttctcctctaactatcctttacagctccactaaaaattattaatcatttccttcaaactcatgaactcttaagtctatttagcagttagtctctctctctctctctctctctctctctctctctctctctctctctctctttctctctctctctctctctctctctctctctctctctgtgtatgtgtgtgtgtggtgtgtgtgtatgtgtgtgtatatgtgtgtgtgtgggcgggtgtgtttctgtgtgtggtgtgtgtatgtgtgtgtggggtgtgtctgtgtgtctgtgtgtggtgtgtgtctgtgtgtgtctgtgtgtgtatgtgtgtgtgtctgtgtgtgtgtgtctgtgtgtgtgtgtctgtgtgtgtgtatgtgtatgctgtagcatgatattctcaatacagatctcatccctgaagcaaactcactctcccttcagcagtagccatcaattcctaacagctactcagataaaggtgggagggacatcacagaccaatctcccatccatgctgaaattttgacaggtttaacctacagattttgtgactgcagctatttcaaagggatatctttaatttggtagtgacctagaattaagtctgtataatttagggcaccaatagttccttatgtgttattatttgattactacttaggttcattaaatgagactaaattatagtgatgttcgaatcactattcccattgccacagctgctgtttaattgcttagctggcatattaattctcatgtaactcaggtgactctggacctcattatctattgtgtttgaatgaggtcatatgacatttataaatctacattttaggggcttcttttttaaatgtgcttagacagaattctgcttaaacacctgctacaagaatgtccctgtactgtaaggtaaatgcagttttctcttattttccattcttccatgctggtacaaagatattcagtattatcatatctggttttgtttatatttttacttagataactgacccatgtcaccagtattctatctctgtttcagcaatataatgcaattcttaccagtttttgtctgctgatcactaagataaccaatgttttcgtggtgccttctgttttcactagagtccacctgccctctcttctcagcagaaatggagacaaaatctccaaggagatcaacaggtgtaaaaagatttgctaacagaccacaatatcatgtctactttccttcctctctcttttctagtagtacctcagcatcaaatttccatttgatgtgtaccatgctccttggtaaaacttaagtgtaatttatgaatttctgttcaggaggtgccagtctgtgagtaaacggaagaaacgaatgtcagtagtattactgacagcagcactaaattgaagctcccagattcctttctgttcagtgcccattagaggatgccctgcaaggtctgctcaatagaaacatgaagtaagaaatttaaacgtgctcaaaaactctcccaacactgttacgatctccattttgcagataaggaaaagggaccttgtgtatgaggaggcaaatgttgccaaagtatatccctgtagctgcttgatgtaatcatgaaaataggggcatctgtattagaaattgtacatttaagtgttctctttgaacatgaataagagctgcagcaatggatagaagggtaactttgaagttttgaacccagttcatgataattcccccggtgtctgagttatatagatgcccaaagatattcttttgtgcatttgacaaaaggcagaggagattaaatgtgttacagctgagctggtttatgtttcagagttcgaggcctcctggtctacagagtgagttccaggacagccagggctatacagcaaaaccctgtcttgaaaaaaaaaccaaaataaaatgtcctttaaattattaccttaataatatgattttgttaatcgtaccctaattaataagtatctgtgatcactggttatgtgcaaacatattgtaagcaggggatgttaagcatttcagttgcatatgctttaagcagtactgttattggaaacatgccccactgcagtaacaaatgtgtgaggtgatatttctcaaatacgaacatggcaggttactctgtggtagcataatgtgtaaatgtgacagagttatttacataaattttggcaaatccccaggaatttttcttcaagttcattgcctctaactgcaaagtgtaacatcctataagatgtatggaatctacactgaaactctattggaacacttttatggttttacattcagcactgtcagaggttggagagccatgattttctggaaacaactgctggtctacttttggaaggagactagatgagaaagaaagacataactgagtcattgcaaccccaacactgacttcttttttttttttttactgaaacacatgggtcattctatcacatcacctagtttgggtatctttctatatgcatatatctgcatagcacattcttagtaaaataccgagcatatacttatccctgacctctataagacctctctattaccatgaatctattgagtatagttgtacaatttgttatcccttttctacattggtttccataaactatgagatgcactgatttggaagtaaagaagtttgactaacacaaaatcacctttgaagtgttgtggctcctgtctatacatgctaagtgttaaagttatattgcttatgtggattatgaattcattggtttccatgatggcaatcatatgttatcttcattggttaaaatagtgtcagattttctggttttgttagaacaccaccacaataagatacgtgaatttcatattgatctatgccagtggatatctgtgaagaaacctcaaataattttgcacattgtccacaaattattacaaacccaattatggaaaacaaaagaaatttattcttttgcaggtttgaagcctagtttttgttttttgtgatttttttgtttttgtttttgttttttaatcaaagtatcagtggaattctgtgccctctgaacacagcaggaacatgtatttcctgcctcttcctgtgtatcccaagattctcattacatggacatatccccctaggtttattctgtgaccttgtttaaatatcagccattgggtttcaatctcattccaatccagtatgagtttttattgtctaattatttttgcaacaaacctaattccaaatgatgtcagactgaagttctaggctttcatgtcctctgggcaggaaggggctaagcaggtcattctaacacaggtccttaatgcattaagtactgaataaagattgcctgtaactgtttgactgctctcctggtggcaatgctctgcacaggatattgctgccatgccaaattacatgaagcccagtggaagtttggctgcaccaaatgacctcagcctgaacacttgcaccagaacaaatgatgctgactggtatctgagacacaacttaggcaaagagcttgacaagaaaattcataacatgatgcatacagtataggagaaatgggcatgaagaaagttccactgaaataactttctaaggaaaatagggacataaatgaatttgtcttatcaggaattctgcaactaacacatcagcccacattcactaactgcatctccccctctcaaatgaatttctgacaatatttttatattgtttctttagttatttaacacccacggcctcatattgaagctattgtagactaaattattttactctttttcccacctcctgagttggtgatttttagaatgttacttaagactaaaaattactatgttaattcaatgtaaaagagtgaaatagttatcaaaaatcctaacataatatttgagaaacttcaaaaaacaaacctattttagtacttatgaaatgtctataagtacttgatgttgtgtatatttaattgccttttttacaatattacaggaatttgaataagcgataatgtttttcgtttgtaagacttacatagttagaatgaaccaatgacaatagcaatagaagagagatagagtcttcaggtattcacgtactgcagcaattccccttcttaggtaccatttctacctctatcatatcagactatgcttgggcttcaccttgtttcaattcacaaaggccatacttgttatacagaaattgcccaacaactatgacttttggaagagatacacaacaaacttctggcctgttggtttattgatgatacctaggtttttaaccttcttatgaccattaaatctgaaggaataagggctagggagcttaggacagaggaagttatacactaaaaaaaatttatgaaatatacatcatgaaatccaaagttttccatgtatgaatattttatttattatttatcgatttatctatttattgttttcatatctcaatcattgcccctctcctagtttcttctcccaatgtctctctcttcatacttgttgcccttcccctctgagaggatgggaccctcattctactctgagagggagggtatccctccaccctggctccttaagtctctgaagaattaggtacatccatgcccactgaggtcacacaaggcagccttgttggggaatagattccgcagatggacaacagatttagagaaaactgtccttctatttcttgcgggaatcacatgaagacagagttgtacatctgctatatatttgctgaggacctcggtacaggcttcgtatgctctttgactgacggctcaggctctggaagatcccagggttcatagttagctgactctgttggtcttcctgtgtcgttcctatccccttcattgccttcaatccttctgccagttcttcaataaccatctctgacctctgtccaaagtttggctatcagtatctgagtctgtgtgatcagctgtcgagtggagcctctccgaggacagttacactaggctcatatctgcaagcatatcagagtatcactaatagtgtcagggattggtgcttgccaatgggatgggtctcaagctgggccagttattgcttgcctattcccccagtctctgctcagtctttgcccctgcatttcttgtagacagaagaagacttgggaaacagattttgtgggtgggttggcgacaatgtctcttgaatgggagacttacctggctagaggagtgagcctcttcaggttctgtgtcccaactgttatgcctttcctttaaggtcatggccactgactccttggagcttcccacattccagatctcaggcacttctaagaaatttcctccaccccacccccatacctgctgttgcagatttctattcattcttcaggccctctggccctcttgtctctccccacacctgatcctcactccctatttcattccccttcccctctcccatcacgtttcctcctgaggtctcctattactattttatttccccttctaagtgagattcaagcttcctagcttatgccttccttcttgcttagtttccttgggtctgtggggtatatcatattattaagaatatcatccagagtcacaaaagaacacacatggtatgcactcactgataagtggatattagcccaaaagctaggaatatccaagatgcaattcgcaaaacacatgaaactcaagaagaaggaagaccaaagtgtggacacttcaatccttcttagaagtgggaacaaaatacccatagaaggaattacagagacaaagtgtggaacagagactgaaggaatgaccatccatagactgccccacctggggatttaccccatatacaatcaccacaccagacacttttatttatgccaacaagtgcttgctgacagaagcctgttatagctgcctactgagaggctccaccaatgcctgacaaataaagaggtggatgctcacagcttaccattggactgagcacaggtttcccaatgaattagatagagaaaggacccaaggagctgaaaggggtttgcagccccataggaggaacagcaatatgaactaaccagtacccccagagctcctagggactaaaacatcaaccgaagagtacacatggtgggactcatggctccagctgcatatgcagcagaggatggcctagtcagtcataaatgggaagagagtcccttggtcttgtgaaggctctgtgctgcagtgtaggggaatgccagcaccaggaagcaggagtgggtgggttagtgaccaggggagggtggaggggataggggattttcagaggggaaaccaggaaaggggataacatttgaaatatacataaagaaaatacctaatttttttttaaaaaaagagggagcttgtaagcattaggataagagactcagtcttcctatcctgaaatagagatggttagataagagttcatttgacccttggacacatagtaagaagtaaccatatgaagacacatagaatgagcttgtggtaaagtagtagaaagaagaaaatcctagaagagagatacacttaagaatcttctttaaagccatgttgctgaggcaatgttgttcaggaagatgctctcaggtagtaccagttaccatctatctaatcatgtagaggaaacacatcacctccaatagttaggattaaaggtattgcctttcttcccataattgtaccctgagaacattcccacttatctgagccaggcattcagaagttgaaacatatttttctctcttataatctatattccttttagtcctctgttcattattttgctacttaaaagagaggagaaactttgcatatgtattcaacttatctcaaagcactaggatgcttgtttagtatcccacaaattctttgtaaacaaaataattttcagaatattattgcagattttcatttaagtattcaaattttctcaaatgtaagttctagatagatattctcaaaacaggaaaaaaaagggagataaatgttcttattttcttggtttatagtgtgtactgtgtatccatgaaacaattccttgctcagaaaatttttgttcattaacattatatagtatagtttttttaggcataatttaagggcgtgatctgaatgaatgaaatattcctatccaaggtgagcacaatgaaagatattcacaatatcaacgagtgctagttctggaagtgtggagagcctgaccaccaattagcagtctgaacatgttttcttaactgcatgtcctttcagagtctagcagatggccctgatgttacttttttcaaagcaattactgatgaggaaggtgcatctcatttctagatatttctttccttacttcctcacatctaatctttcatcctgggttaggttggtcactatcaaacttcaaagttagaactttgtatctttggtactttggtgtcttggtgatctttgctcttcagttaggtaccatattcttctgcagtctctggtctacctctttcaagtagcggagttcacacagtacatatcatgactttagttccttgggtgttatatgcttctcatccttctttcatagtcagccatgatacacatgatgatgctttagaatcagtgtctgaatacataggttaaaattgggacctcgctctaaaactttgagaatttccttttgacttatttattttaatttatttagtttattttttaaaatatttagtagtaatgcactaggattctaagaatactggtatgacaacatttcagagaatttatatagatgtcagtgttttataagtactaatttctacatggatcattttcactgagtctatgcagatatagaataaacaaatttgcacgtgaattaattcatgcataatgtttatgggagctcactcttatgttacagtgagagaatccagtgtctcagccaactgttattttcactttcagatcctggccttgcttgttagtttattttcatttaaaaacactattttacattattcatttttaggatatctaaacatcaataaaatctaatcttcataacaagacactttaaatatttactattaaattgatccttcagtataaaacttgtgatatagctattaatatttaaaggaactggtggctatttacttaattaaggagatacataaattttgatttttactggtgtgtgtgtgtgtgtgtgtgttaggatattgttttaactgacctcattgctttgagatatttgtatagcagaatgtcctttgtgtcttgtttggtgagtgtccaatggtgagttactgaacttgcttgtgattcctttatctttcatatccattagctaactcattttcttcaaaccatagtccaaagataataccacctatggacttttccttatcagaattagtgctttttttttcctgcttttatttgccagtgtatcctgtgtcatagttttggacaatgcttgctgcattctgttatctccaatcatgctgaaatagcactttgaggaactcaaaaacacttattttaagttgtttaagtagtaacttttgttgtgtaaatacttatatgttcaagtttctgtcaccagtggacagtatacagagaatataatcccttaaccataaacatgtctgtacagggaatcattattggttaatcctgcactatcataaaaccttccatgtctgccttttattttctattactcacttttgtcatcccaaagtctagcatagacctagaatataagaaaaactgaaataacacaatattgaatatataacatgttatacatattgtattatattttgtaatcagaataataatggattctatatgtattcagtgcaaaaaaaaatcttaaagtactcaatatagggtgtcttacacaattttgcgaagataaatctttcaattccctatctactcccttcactttatatcttttgatgcctttcagagccaatttgatgtatttctccactgggttatagaacaatcagctttttagaaaagtatcaaggcaaacaggattttggggtggaacagatgtgtcaaatctagcactgcagtaggaaaagtaatctacagagctcattctggcatgcctcatcccagaagaacagttggtgacttcactccaatacacttacttatttcagacataaaagaggtttcggccaaaagcaatggcaatgcctggttatgattttggtgctaaattgatgtctgaaataatccctagcaaattttgagaaggatttcagctgggaaaatacctatgacttttgtacacagagattagtgtagtattagagtagtaggttcaaccctatcttagacaatatgattcaaatttcggttaagagcttatatccattaagtacaaagtagaaactagtctatatttctcactgaaaatactctattttaaaataattctaataatttgaacaaccttctagtgtcccagagttaaatttccattgtttttactttgtctcttgtttttcctatcccttccctacttcagtgtaaacaaacactgagattaattgattactattaacaaaaatgtctattaacaaaaatgtctatttttaagaagattcaagtcatactccactttctactgatttcacacaggttcattccatgttcataattcatcttctttgtctccttcctttattttactcctttcctgcctccacctagtctcagaagtaaatattaaattaatatgatggtcatatagatagacctttaccttagaaagacaaactagggaaagcacccaaggagctgaagtggtctgcatctctataggtggaaaaataatatgaactaaccagtacccccagagctcctatttctagctgcatatgtagcagaagatagccaagtcggccatcactgggaagagaggccccttggtattgcaaacttggtattcccccagtgcaggggaatgccaggccaagaannnnnnnnnnnnnnnnnnnnagcatttgaaatgtatggactaaggctgatcttcaataacaacataaataatgaaaagccaacacttacgtggaaactgaacaacactcttctcaatgataccttggtcacggaaggaataaagaaagaaattaatgactttgtagagttaaatgaaaatgaagccacaacatacccaaccctatgggacacaatgaaagcatttctaagagggaaactcataactctgagtgcctccaaaaagaaactagagagagcatacactagcagcttgacaacacatctgaaagctctagaaaaaaaggaagaagattcacccaagaggagtagatggcaggaaataatcaaactcaggagcgaaatcaaccaagtggaaacaagaagaactattcaaagaattaaccaaacgaggagttggttctttgagaaaatcaacaagatagataaacccttagctagactcactagagggcacagagacagcatcctaattaacaaaatcagaaatgaaaagggagacataacaacagatcctgaagaaatccaaaacaccatcagatccttctacaaaatgctatactcaacaaaactggacgaaatggacaaatttctagacagataccaggtaccaaatttgaatcaggatcaagttaacgatctaaacagtcccatatcacctaaagaaatagaagcagtcattaatagtctcccaggcaaaaaagcccaggaccagatgggtttagtgcagagttctatcagaccttcaaagaagatctaattccagttctgcaaaaactattccacaaaatagaagtagaagtaactctacccaactcattctatgaagccacaattactctgatacctaaaccacagaaagatccaacaaagacagagaacttcataccaatttcccttatgaatatcgatgcaaaaatactcaataaaattctccctaaccgaatcctagaacacattaaagcaatcatccatcctgaccaagtaggttttattccagggatgcagggatggtttaatatatggaaatccatcaacgtaatcaattatataaacaaactcaaagacaaaaaccacatcatcatctccttagatgcagaaaaagcattcgacaagatccaacactcattcatgataaaagtcttgggaaagatcagggaattcaaggcccatacctaaacatgataaaagcaatctacagcaaaccagtagccaacatcaaagtaaatggtgagaagctggaagcaatcccattaaaatcagggactagacaaggctgcccactttctccctacctattcaacatagtacttgaagtcctagccagagcaattcgacaacaaaaggagatcaagaggatacaaattggaaaagatgaagtcaaaatatcactttttgcagacgatatgatagtatacataagtgaccctaaaaattccaccagagaactcctaaacctgataaacagcttcggtgaagtagctggatataaaattaactcaaacaagtcaatggcctttctctacacaaagaataaacaggctgagaaagaaattaaggaaacaacacccatctcaatagttacaaataatataaaatatcttggcatgactctaactaaggaagtgaaagatctgtatgataagaatttcaagtccctgaagaaagaaattaaagaagatctcagaagatggaaagatctcccatgctcatggattggcaggatcaacattgtaaaaatggctatcttgccaaaagcaatctacagattcagtgcaatccccatcaaaattccaactcaattcttcaacaaattagaaagagtaatctgcaaattcatctggaataacaaaaaaacctaagatagcaaaaactcttctcaaggataaaagaacctctggtggaatcaccatgcctgacctaaagctgtactacagagcaattgtgataaaacctgcatggtactggtacagagacagacaaatagaccaatggaatagaaatgaagactcagaaatgaacccacacacctatggtcacttgatcttcgacaaggaagctaaaaccatccactggaagagagagcattttcaacaaatggtgctggcacaaatggtggttatcatgtagaagaatgcaaattgatccattcctatctccttgtactaaggtcaaatctaagtggatcaaggaactccacataaaatcagagacagtgaaacttatagaggagaaagtggggaaaagcctcgaagatatgggcacaggggaaaaatacctgaatagaacagcaatggcttgtgctgtaagattgagaatcgacagatgggacctcataaaattgcaaggcttctggagggcaaaagacaccttcaataagacaaaaagaccaccaacagattgggaaaggatctttacctatcccaaattagataggggactaatatccaatatatataaaaactcaagaaggtggactccagaaaatcaaataacctcattaaaaaatggggctcagagctaaacatagaattctcacctgaggaataacgaatggctgagaagcatctgaaaaaaaacattcaacatccttaatcatcagagaaacgcaaatcaaaacaaccttgagattctatctcataccagtccgaatggctaagatcaaaaattcaggtgacagcagatgctggcgaggatgtggagaaggaggaacactcctccagtgttggtgggattgcaagcttgtacaaccggtctggaaacaaatctggtggttcctcagaaaattggacatagtactactggaggatccctcaatacctctcctgggcatatatctagaagatctcccaaccagtaagaaggacacatgctccactatgttcatagtagccttatttataatagccagaagctggaaagaacccagataccctcaacagaggaatggatacaaaaaaaatgtggtacatttacacaatggagtactactcagctattaaaaggaatgaatttatgaaattcctagtctaatggttggacctggagggcatcatcctgagtgaggtaacataatcacaaaagaactcaaatgatatgtactcactgataaatggatattagcccagaaacttagtatacccgagatataagatacaatttgcaaaacacatgaaactgaagaagaatgaagaccagtgtggacactttgccccttcttataattggaaaaaatcacccatggaaagagttacagagacaatgtttggagctgagacaaaaggatggaccatctagagactgccatatccagggatccatccaataattgcctccaaatgatgacaccattgcataccttaggaagcatttgctgaaaggactctgatatagctgtctcttgtgagactaggccagagccaagcaaacacataagtagatgctcacagtcagctattggatggattacagggcccccaatggaggagctagagaatgtatccaaggagctaaagatatctgcaaccctgtaggtgcaacaacattatgaactaaccagtaccccggagctcttgactctagctgcatatgtatcaaaagatggcctagtcggccatcgctggaaaaatgggcctattggtcttgcaaactttatatgccccagtacaggggaacgccaggaccaaaaagtgggaatgggtgggtacggaagtgggggcggggggaaggtatgggggacttttgggatagcattggaaatgtaattgaggaaaatacataataaaaaatatttaaaaagaaaaaatatctaataaaaaataaataaaaaagaaagaccaccccatttccactcaataaaacatatcacctagctaaatctaagggttgtctctattactcatggaagacattttaagcccaggagtctacttttcataaaatcacaaattattatgagtgagaacaacattatattctaatgctactgttgcattggtaaatacatgtaccagctcatgtattacagctatttcctagataacttcattttatataatagatttctaatttatggcaagtattagttcataaacatatatagtactggtcattttctacttcaaatagcaactaaagaaaagaaaataatgcacaattttcataagtgaacatttttatttttcactgaaacttcatcaggaccatccacaatccatgcttacaatgtatggtcctatgtagattaaaatttagatgatggcattattctgtgtaagagcattttctaggtgttaaaagaaattcacaggaagtaaaacataattataagttaatggttaaaaattataaactgtgtattactagaaaaatgtagttaatacaaaagaggataaatgtgtgcttgacaaagccctgttgcacaggtgattatttttcagtaaactataaaggtgtgagtacatgaataatctcttaatgattttgagtttaaatatttcaaaaataaattgttactggaaataaatagtgttagaaatgtgaatgagatatgtgattaagatgaggattacagcttttaaagtatttatcatttaaaaatatttctaatacacatttaacttccaggaaactgattggatgacatcattgcatagacatttaatgtatttatatatgtacatgtgttgctttttcttcacattactggattggcctctaattctgttggaatgaaggcaacaaagggagaggaaatggaccctacagattgcagggaaagcaggagttcaatgccatctttaactgttcttatgtggtgttgagaacataaatgctttcttgtaaatgtatttaaattttaacttcctattttgaaaattacgcttaaaagataacatatggtacgttccagctgaactagaggccaatccaggagagatccaagacatggaaacatataatttttcatcatttcgactatattctgtgactaacatgtttttatcatggcaacctgaaagggttggagattatgtacaataccagctgcagcagttagtaaaagctgctcagaagaacggtgtagactaagactacatagcaggaacattacgctccagttagatgtttactttttaatttgcttttttccttttaatatttctctatcaccttccctaatatgcacgtatttggcaacttatgagtatttagacatagttttaagatttattgttgtgtaatgtcgcaatacatgtctctcaaagaacttttagctacatctcataaatatgaatgttgaataatcaactcttaaacatttaaataatcattttgttttcctttctgtttcaattcattctttttcgttcttataacaacatagtaattttgtgcattaacaagttttgttacaatattgtcatatagtatatttacctccattacttattgtgccttcaatcctctttcctcttcccaagtaatttcttcacactttataaatgtacttctgaaattcaaaacatggtcatttaaaatgatcacaattgtgttgtggcaagaaactctgtagactatatcatactaaatttctaaagactcgtttagctgcgtaatgggttactaagaactgtatatgcatatgtgtgctgaaaaagcttgtattttctcatgtcattgggtgcaaattatgtgtaacataatttggataagttgattgaccgtgaagttcatacaagtttagaattttatctttcttcccaattgtatattgacccctttaaactttaataatctttttgtctagagatatatttctgtattcatataaacatctacatcttactaaaatacacatatattatttgataaaactactagacaagtcatagaattttatgtaaaagttatggaattttcagcctaccaacaatgaaggcactcatcagatcacatgaataattagtatgtgtgaagtacatactgagtcctgtagttggttcaattcatatattgagcaatggcaaattattgtaatatttttaacaatgacagttctgaaagagtgtggtgtggatgggtcactgttttggtctatgttttctactttatagcaacctgtctccttaccaattgttccatcattaagttaatgtgtatactctaatattctatggttcatgaacttagttgacgaaggcattaatataagaccatttctttcctgtcttcaatgaatgaatgaaaaggcaacatattaatatacttgaagcacagttagcactcctaatattatgctcaaatgaatattatctgttctgaaaaatagaatagctttcatagagatagagaagtacaactctatatgataagaatcttaaatggtctagaaaccatgtcacataaatctttaacaaagtagagaacatatttgtggtgatcaggaaatagattccattttttaaaaatatgatgtttatgtatctttcatacacaaaagtatatggaaaggttaacataaaaatgattgaaagcagggatgggtaggttcaaaacaaagtactagtcaggaagaaagcacagacacagcctgacccatttcctgttccctgcaaatcttttcaagtattctttttgttaatatttacttaatattctagttaagcatggattttcttatgtattttaaataaattgtttgtaaccaacaaaaaaagagatatttttttttcactgtgactcctttatctgtgtcttggggtcaatatatatttctccttttaaaaaaaagtttcaatttatgtatactattaaattgttggttttctgcatcgatgtgaaatttcttttctctctcatttctgttgtttctttctactgttctattttgaattgacttacaataattgttccatcaatctgcacagagtattgatttcatgtatcatcattctaagagtgattaccacagcaaatacgcactgaatacagatcaagtgtggaaaagttcaatatttgtatatcacactgtatctaaatgagaaggtctagaatgtaatcattctagccactgaaccttttcatgaatcatcatggccaaatatttcagttctcattattttgagcccacagcactaatatttcagttttacatatcatagttttgttgatcttacttaacactattaatattttttgaaattttaaatttgaggctcagattaactggatttaccagattcttgttaaataaaatccaacttcggtgccatattttttatcttcattttcttttctctctctctctctctctctgtgtgtgtgtgtgtgtgtgtgtgtgtgtgtgtgtgtgtgtgcttgtgtgtgtgtgattttagtcgtcttcccatgaccaacatctattttcacttccaagtgtttcctcttttttacatttgaattttaaaacaccagatttagggtagaaatgtggataaaccttctgagttcatttgtacatttctttccttcaaattctttagctaataatgggtgaaactatagatctaactgaataaaagtttcatctcttatgtcgtgatctctataggtactagaagaagtaagaaatgttaaaaagaggctaaccactctcaagtacttggtcagatacactcaaaattttctctcactcagttgccaagatttaatattttcctgttggccacaatgtaaaatatgttttgtgctgcatcaaagttttagatagactaaaaattgcttatatttataagaatctagctttgaataaatgtattttatcttttaattatctgtctaaaatctgtcctttcttttattcttctttcattttttagaggttttcttcatttacatttcaaatgtcatcccctgtcctagttttctctctgaaaatcccctatactcccctgtcccctgctccccaacccacctactcccacttcctggccctagcattctcctagagtggggcatataatcttggcaagaccaaggcctctccttccactgatggccaactagcctctgctacatatgcagctagagacacagctctgggggatactggttagttcatattgttgttcctcctatagggttgcagaccctgtcagctccttgggtactttctttttttttccattttttattaggtatttagctcatttactaataccaatgcttacccaaaagccccccaacccccccccactcccttacccacccactccccctttttggccctggcactcccctgtactggggcatataaagtttgcaagtccaatgggcctctctttgcagtgatggctgactaggccatcttttgatacatatgcagctagagacaagagctccagggtgctgcttgggtactttcttaaagctgaactttctaccttttatttttgcccctcagattactttttgagaaattctcaatttatagatgttatttttgagctgaatattcatccagaagtagtgatgtgtgagtctgtgcatgtgtgcacatgcatgagcatgtatgtgtgtgtctgtgtgcctgtgtttctttgtgtttgtgtgtgtgttaatgaagaaatacatatcactgcagggtgactgggtttaccttgtacctctctgctggaagaaatgattccctgctggttttagacaacaagactgaggacagagctaagtttcatactgagaataattaggataacacagatcttgtttaattatttcagtgcattgttcatagttaggcataacatctattttggtgtttttactaatttttagcattgcttctgataagaagtatatttccagacactgacacacaatcacagtaagaaactccaaaggatagtgaccacacattttaccaagttgagaaataatcaaaaatactttgaattaaggctttgtgtgtgtttaaattttattttaaaacttcctaaactctccaataatggggccattttattcgagtttactttattgtctagtttttatagccactgttaatcatgtgtactactttttttttcctccaagaagtcaagatattaactctaatttagtgctaattttctgcttattacctgcactaccaagtatcatcttgttgacttaagaatttatatctctgggatttttttccctccctgccactcattctgtgattgtactcacaggagatgttaatagaaggctctacaggaaggactggtaaccatggtgatatgagagtgctttctgcaataactccactgtacaaaataatttatgcatggatgtaaaatcacagatgttttgaaccatatgcaagctatatttaaccaggctacaagtgacaagctactggggagttactaatccaaaagaggtaagcttcagttccatagtaatttttttcccctcatgccctggttgactcttccaagatacagggtctaagaagtggggtatgagtgtgtatctttagtctgagtcactgtgtgtcagtaactcctgtgtgtaagagagaatgatgtaggaaaatgaatgtttggaagagacacttaggaagatgcacacaggtgcatgagaagaaacaaagaacaacagagtctgttcttactgtcttatagtatgtccattcctgaaaatgatgttacagaggaaatgatttcacgacacttacttttcagcttaaaaagaaaactcagatctttattttaatatttaaactattaattagtgcgtttatcagcaaaaatagttagctcttatggcaataatgcttgcagctcagtaaaagaacctatctttataattatttgagaggatcaaattgcctttaatataagttggttatagatcaaaataaacatttaattcttgtttcaaattcatgctttgaaatgttgaaaatatttatgttctttcctttaaactcagttttagaaagaataagaccttagctattttgaatcttcacaatatcctgtgaacttttaccagagttggacccacaaattgcatttgtagttctaagacatgaataactttctaaattcatctttccacttgtaaaaataactgctgcttttagaattggttttctaaaagagaggctcgcagaaatcacaaaattaatgcaatactttgtgcaatgaggctattttcagtaccactggacttttggaattcagaggcgaaggaaaaaaatgggaaatggaaatgaaacaatttgcattgcaaaacttctcctttctcatgatgtcttatgtgtttggttgccttgtcttcctccttcccatgttcgttatttcttggtaaaatgttgcttctgcctttctttgattaaagtcatcctagacttttgcccctgactcaacctctttgcttactgcttttatttttaattgtttctcagtctcattttaatataaattgactcactgctaattaagtacatttttgtagatccaagagagtttcctgttaggcaattgtatgctccctccttgatgatccatttctgaagcactaatgttcaattaaacattaacaaggaacctccatattaacccaggttaagtttagtacaaaggggattagtgcatagttcgagagagtaactcttgctatacaggttttgcttgactgttggtagagtactgtcaatttagagaaaaggggggctttctattacaataaagtacactagagctaattgcctttgacaatagcatgttcagaggtctcagttggccacaacagcaataagatatatacaacgagcaaaggatttctgggtggctcttaacctgctactttaaaaaatgtgcatttgagcaggttggggtgtcacctgcacttaatcccaggactcaagacacagaggcaggtgacctctgtgagttcaaggccagcctggcctaagtgatgatttccagggtggccaggaaatctcactgtatatagtgagactatgtgtcccaaaacaaaacacacacacagagatatagacacacacacacacacacacacacacacacacagagagagagagagagagacacagacgcacacttacacacatatgcacaaatcacaccagaataacaacatcaacaacaaagggaaaaaacaaaacttaaacaggaaaaagaaaaaaatacatatttaaaaatatttcctaagttttccacggtaagtggaaaattttttgcctaatgaaatttattcctgagattcggttaaatcttcttgcatacttctgtatcctgacatcaaaaatagaggatattaaaaatatttagctgcttcacttatttatctccttctcttaacgccttcataaatgtaaatgcttttctgatggtgctgttctttgtacagattataggaataggaacacatgatgttttcattgcagcccagttttcttacaatctaaccaaaatacaagtacatattcatatcttctactggcatagtattgtagaggatagcatgcttcctactttaatagggagttatttcttggtttcaatatatatatatatatatgggtttttgcctaatacctgagtcacaggattactgatgttaatctcttttgagggaacaaggaaaaagaaagcaaatgagcttcataggaagttaattagacacaactatcacattctgtgtacaatgctgtgactgctatgtcatattctttcattgatcagagtatacacttgctgccccaaatggctgcatataacatatgattatgccttacatctatagcccttaaaacaagtatgccaacaggatatcagtttagacttccataaagtaggatttttttattttgttctatacacttcatttttactaattgaatatcttttctcttgcacaaatcttttcttctgaaatgtaatagcttcacgttgtccatttatcttcattaccagtaacatgtagtaaatttgcctatctgtttgccctttagaaaaacacaaagcatagattattgtaaaaccaacagcacacttgtattttattagtgatatctctatctgcaattgatttatatgtgtgctatcatgggtttgtatgagtgtataatctatcattttatctattctctagttatgcaatagtatagcaacccatatatatgtacaattatatttatatataattcctttacatgttgaatattttatatcaataataatactccacaaaaacattgaagtatagtatatgtctctttatgtgtatgtgtggatataaggatgtatacatgaatatcttaccttaactaatactcattttaagtattcccaatgtttaatcattattaaacttgtggaagatttactcttagaggaaacaaaataatgactatctaaaagctagttgtttctgatctagttaacagttagggaatgtctgcttttgaaatgttgaaatgcacagttatcgttaattttgttggattcccagtgtcatttatttatatttgtgacatatgtatggctatacaacatctcatactagccatcatctttttttttttttttcttttttaaccagtaagtcccaatttgtgcagagaggcatggtgacatagtcttgctcagtcccttgtagccaacaaaaagaaagagtgaaaagaagagtaaaatgggcacttgtactgtgatttccctgggttgtcaatccagttttagagctgaagatttctgtttactttctctgtagagtaaatttcttctgtaaaaataaaattttgtacaaaaaaattaatggtatttttcttactattatctcttcataacatctaagataaattcaaatgtgatattaaaataaaatgccacattgcacatgagcacttcagattgacatataaagaattcatggactgctataaatttctgttcaacagcctctcttgttgcatctatgtatctatgcagattccataggaacatataaccatattcttacttcagtggaaaatttatttacttgaatgtaaaatgtaatttacaaaccatgtgaaataattggtgtaccttgtaaatattcaaattgtggtgcaattaatataaatatttacagtgcttctatttgcatatttctattctttggaaatcatgcagaacatttatattggagattaatatcattaagtccatgtcaaaaggctatcacctagtctaatagtgctaggataggaagatgtagaagcaagtatgtcaaatttaaaagcctttgtttaaataatgtaaccagccagcaattctgacttttcatatccttcaattcctaaacaaattgggaattaattaaaaattttatatattggactccttaaatttctagctattttaccagtatatatctaaatttctcattcatcaatgtgaaataaacaaatatatttcaaaaagttctgggtacgtgtgtgtagtataaacaataaaatgtgggtctggaaggatatgtcagctttaaaaaaaatttttttttattaggtattttcctcatttacatttccaatgctatcccaaaagtctcccatacactcgcccccactcccttacccacccactccctcttcttggcactggtgttcccctgtactgaagcatctaaagtttgcaagaccaatgggcctctctttccaacaatggccgactaggtcatcttctgatacatatgtagctaaagtcaagagctccgggagggtgtgtgtgtgtgtggggggggggatactagttagttcatattgttacttgacctttttcctttactgcttttaacattctatctttatttagtgcatttgtggttctgattattttgtgtcaggaggaatttcttttctggtccagtctatttggagttctgtaggcttcttgtatgttcatgggcatccctttctttaggtttgggaagttttcttctattattttgttgaagatatttgctggccctttaaattgaaaatcttcattctcatctactcctattatccgtaggtttggtcttctcattgtgtcctggacttcctggatgttttgagttaggatctttttgcattttgcattttctttgatcgttgtgcctatgttctctatggaatcttctgcacctgagattctcccttccatctcttgtattttgttgctgatgcttgcatctatggttccagatttctttcctagggtttctatctccagtgttgcctcactttgggttttctttattgtgtctacttccctttttaggtctagtatggttttgttcatttccatcacctgtttggatgtgtttttctgtttttctctaaggacttgtaacactttatcagtgttctcttgtatttctttaagtgagttattaaagtccttcttgatgtcctctaccatcatcatgagatttgcttttaaatccgggtctaccttttctggtgtgttggggtgcccaggactgggtgaggtgggactgctgggttctgatgatgatgagtggtcttggtttctattagtaagattcttatgtttgcctttcgccatctggtaacctctggagttagttgttatagttgtctctggttagagcttgttcctctagtgattctgttagcctctatcagcagacttgggacactagctctctcctgagtttcagtggtcagagcactctctgcaggcaaactctcctcttacaggcaaggcgcccagatatctggcatttggtcctgcctcatggcagaagttgtgttccactcaccagaagtcctaagaacctgtggagagccctctaagggccttgggggtgttcgctgactctgtgcccaaggtgacccggtgctggtgctgaccagaagggaattgtgaccctggtcaggctggattttttgctttcctaattaatgctgtttcacgtcccacacgattggattggaacagaagttgtgttccactcaccagaggtcctaagatcgcgtggaaaatcctctagtgaccttgtgggtgtccaccgtctcttggtccaaggtgacctggtgctggagctgaccacaagggacttgtgatatgtcagcttttaaaatgcagactcttcttgcagatgagataagtgcagatcccagaacccacactgggctgctcataactacacagaacccttaaccagggaatctaataccatcttctggtccccactaacactgcaacaacatgtacaaacatacccacctgcatgactaaaaataaatgtaaaatctttaaaaatgaatacttaattttaaaccatctgttcagagattttaatttagctataaatacaaatttctgtgttgatgaaagttaaaaatattgttaaaattttatttatggattcatttgtagtccaaatgtaaataaaaagattgccagaacagagttattttaatccctctcattgtctcttagtcttcttcccctaggatcattttttgaggaacatactttaataaagtttaagaatttctaatgaacagatgagctcacagcataatcgattaataaaatgaaacaatattatgaaaatattatttatgtagacatttaaataaaagaaataatatttttgctaagtagctatgtttgtttaatgtttgacctatataaatttttttataacgatacagatcattaacttacatttatatttagggaatgcaacacttatttgaatgacccaatttttgatttagtatagtattatttatgaaataatcccacaattctatcttttttgtccccattttaaacaaatttcatctcgtgtgtggtgtgtggtgtgtgtgtgtgtgtgtgtgtgtgtgtgtgtgtgtgtgtgtgcttacttttaaaaataaatgataagccttcatgctttattgataaacgtgtcctctcttatctaggcagaaaagaagaaaaagagagaggaagagagggaaggatataaggaatgatggagcaaaattaaaaactaaaatctaaatatgatattactggattgggctgtttctcatctggttttcagtttcttaactttctcatgataagcttcattttttatannnnnnnnnnnnnnnnnnnntgtgtgtgtgtgtgtgtgtgtgtgtgtgtgtgtgtgtgtgtgtgtgtgtgtttgtgttgtatgtattctgttttactcaggtaagagcttcaatttatactgggtattccattatactaggtttagcatcatttctattaggaagccagattttagtgttaaaaaaacagagaaaaattttggtcttatatttcttgaaatggggatatggaaaaaagacacttgcaggtgataacttaacccagagatgggattaggtttagcaatgggtaagaaaagctgttgttcttagacttaagacttgaaagtgtaacagcttgtagtttaggtagaaccaaatgtcgtctgctggcctttgcacatagcactatcattgacctcgaatctctctgtttcatgttatgtattctgtctttacctgtttgtttgtttgtttgtttgtatttgttttacctgtctaacttattcaaataaaaattccatgtacctaacacaaaagctggtttcagagataatgaaaaatcaaccaaaatcgtagttaatttatcacctgcaagtgtgctatttctatatcccattttcaagaaatgtaaaaccaaatttttttctatgttgtttaacattaaaactggtttcctaatagaaatgataaccaaatatcaaaagttgaagatatttggaaagttttatttttttcctgaatccacccttctatgagtctaaaagggagtttccaaaatagcacagctgccgaatcagatgtaatgtattgctttggacaatttatcagcattgtctcccaagagtaactgttagtatgacacgatctctgcccagatgtcagggcttgagatgagacagctctgacagctgagctacatttaatctatcaacttagctgagaacattctgagagataatagatccttccatgcaactaagttttattttcatatttaatactattcacttttagtcagagatgaagaaaatgatcttgcaagaagggaagttgctagaggatgaagaaacacaaatatttcagcaaatcagtgaatgtgacaatatctttttttttctagctaatggaagctccagagaatgagaacagcaggcacattgttcaaataaaatttattattattcattataatttaaaagatgtggagttacccaggcagtcttacttaaaaataacagtggatgagattctggggggaaaaaagtttaaagaagtgagctatgtgtgtctttctgtcttaaagtgtacaatgtatccatgaaaatgatttttctttttagaagtgtgtattcagaaataacttttcttggcaacagaaatcaaactctttgttgaataatttaaaatatgatttttgtatatttacatctgctgggagttgaagccctcattagtactaacctggtgttgtaagaactgtctaattagtctctgtacatctagtccttctgatgctgcaaatagagctagcatgttattcgctgtcatcactgtgcctgcatgatcactaggatgaagtgtaatcttcctttacattcatgccactgtgccttgcctcatacattgcattcttttccaatctgccatttttcacatgagcagcacttagctatatgtgcctagcaccgattctttaccagttctcatagctcccgttcaccctctcctctatgttgcatccctgtctttctaaacctccaaaataaactctggcctttccaaaactcttatcccctgtaattactttcacttcgaaccttttctctgcatcacctatcaaattttctgttttggggttttcactaaatttatactaaaattaacatttttttgcaagagtttgtctcttatgataatgcaaattgataggtgagatgagattgctactcattattatttgttattagaaacttggtattagaaattttacttagcacacagtggatgaacaacttaaatttctgaaactaaaatgacataaaattctgtaagagtagaggtttgatattttgtgttgatttgaggcatgctctcactatgtagctctggctgtcctagagttcactatgtacacaccagcctgaccaagcattcagaaatatccactatcctctgccttcagtgtgctggatcaaaggagtgtaccaccatgtttggttaggtccgatgttttaagtgactaatgtagagcgagatgaatttaagaaaaaggagtaagaaaatatggaaaatatacatagctaaattttgttgatattctttactgtacgtgtatgaaaactcaaaatttgcaaacctgtctgtttatggtttcttataatacatatttataatgtagaaaaattcttccaaaaccagaaaacacaacataaagcttgttaaggctacaagaacttacagcaagcactcttctaattctaagagtatcttcctgtcatgcctccttttttgacctataaagcaattttagatggaccattgctgtcctacaatagaaagaatttcttttctaaatattttattagtagaggtaggagtgatgatactaggccacataggatcaaagttgatctcaatacaatgcaatcagtgctcttgcctaaaattttatttccagtatattcattaggatctttggctctttttgtttacaaataaaattatcagttaattcaatttggtggataagtattcatttatacacatttaccacatatcccttgtcaaaactttgatgagatagtatgctagctatctgggaaaatgtgatttttgttctcaaaggaattttatttagcatccatggcattggtcaagataacacaaagagctgagggaaggggaattttagaaaacactaaaaggcaaacctactggactttgattcttcaggaaagaatgacaagaagactaatgagaaaatatcatttctatttggttggaatttttaggattgacaaactgagtctggctttgaactatctaaaacacagaagaaaattgccatgattagtgcatatatatatatatatatatatatatatatatatatatatatattgatttaagacctcgtgtttgagtaccctgagatgtttctatctgacataggtgaaatgctaactcaatatgagattttggcttatcacattgaaagtaattttccaaactccttgtaaaatgacttggtacagtttggctgcaatctaagacaaacgaattgctttggaacagaaatgtaggctgtgtaagaaacagaatatcctactgggacttcaatggataattttcttcctaggatgataaccttttgaaagaggatcatgaatcattaacacaaatatgagtccaatagcctgggtaacagggaatccatatggccagaagacctttggatgctctctgtggctaagattgccaagaatcaggagccagatatgagtcaaggactgagagtagatcttataatcagattcccagagagccaatacccaatgtttttcattctttcttcttattccttgtttttcttttcttttctgtttttaaccaaacctgttaaaccaaatgaaaaacaaaacaaaacaaaacaaaacaaaaaaaaaaaaaacaagcaagcaaacttttttcttgctttcaaaattggaagcaaataaaattgtctaagatgggatttctacacatataatgtgtacattcaaattcatacatattcctgagttcaaagcagttgttgttccttattttacatgtaaaaaaaatccaaagcactcaattaaaaaaatgatgaagtagaatcaatttgagttgatatgtgtgtgcttcaaattcatccttgctctctctgaacagctgacatgcccaaatcccctttggtttgcagtgtgagattattccagaaaatttatttttaaatacagattatttagtacaattatgctccttgccctagagtgttacttaagtcttcttaaaagaagaccttaagattgatactttaaaacaaatctcagctttctcatatctcattatgctataaaggcaagggttatgttatgggaaaggagatatgtggggtgatgattctattgttaaaactcagtcagtttattatgacttgagattgcaaattctcattctggtacccacattcatcaaataaacttaataatataccatgttaggtttccaagtctgtactcatactatatggtcttttaaaatatttcatccaaaagatgtttgtcagaaccagaagtgtgaagcaaagctctctgaatgtctcatggatagctgtctttctcctgtgcctgcagaatctcttccgtttgtgcttgcccagttcctaatacctgtggatgaggcatctggtcattctggtttagggctcacttttatgatcttcttttaacttaggtttaaagaccttcttactagaagtattgtagggtaggaatccaataatgttcttagaggcagtacacatgatttctgcagtatcatttgtactgaagtaacattatatgttagttttaagactgcaccagctatcatcatttggaaagaagacttcatttcaaaatttaaaaaatctccgcttcactattgcagtgggaatatttttttgcccttaatagcaggaaactaagacaatgttttcattcctttctgttaaattattatcctatttttggtgaaagatcttacctttttatattattcttttcctaaaattagtattagttaatacaaagcatcatgttaagggtagactaatatgaatagataacacatggttaagaagatggctcagtgaggaaagtgattatcaatcaagtctgatgacattcattgatccctgaatcccaggtaaaagaggaaggagagaatgacttcacatttttctctcacctcttcatgtacactgtagcataaagctaagtgcgcacgtgtacacacacacacacacacacacatacacacacacacacagccatcataacatgtatacgatacaaataaataattcttataataaaatgaataaagactttattgtagtagtttaaattaggactcaggcagatgccttgacagaagcattcagagtctcatataagtcaccaaaaatgtcgaacagccaaatatttatagcagcttctttgaacatgtatctctattgagagattattttgtgtcaaaattgccattctgcatattaaatatacactctgtctcattcatttgtgtccctccccaaagctattgattttgttccattcattttaaaatgaaaaaagtcaggctgagaaattatttatatcacattattagtaagtaatgcattataaactaaaaatcaggattttctttctgattccttcaacaaggatttacagacaattctttacacagtcttcctttggagtgctatctgatatttctttcttcctgatagactggaaatgatgtgtttagattaaaggtacctgaaggaagctcagagctcagtccctgcagttctgaacaaggtcattcaaagcacttatgaaaagctgacgcatatttatttgttctacaaaaatgtaacataccactgtactgcctacttttcttggtactgtactatgatattcagagaaggcaactggccacattgttttcatagcctggaagcagaaaatagtaaattaagatggccagcataatttctcaactgtacacagtccaaatagtgctgccttcactcaggttggaccttcctacttcaattaacctaaacttatcttatttaaacattcacaggcatgccaagaagctagtctccttagtgattctagattgtcttacacagacagctaatattagtcatcactagttcaacagacatagagcgtactcagatatacagatacacatcaggacaagtctattttgcatgaaatattaatcattgaaaatatttgaatgaaattttttagtagaataaaaaaatttcccgccttcctacaaaattagtaggagctcattttttatattgcccatattcaatgtgtgaattaaaaatatttttattagatattttcttcatttacatttcaaaggctatcccaaaagtcccctacactctccccacaccctgctcccctatccactcactcccacttcttggccctggcattcccctgtactggggcacataaagtttgctagaccaagggccctctcttcccaatgatggccaactaggccatattctgctacatatgcagctagagacacaagttctgggggtataggttagttcatatcgttgtttcacctatagggttgcagaccccttcagctcttgggtactttctctagatcctccattgggagccctgtgttctatcctgtagatgactgtgagcatccacttctatatttgccaggcactggtacagcctcacaggaggcagctatatcagggtcctttcagcaaaccttgctggcatatgtagtagtgtctgtgtttggtagctgattatgggatggaccctgggtggggcagtctctggatggtccatccttttgtcttagctccaaactttgtctctgcaactccttccatggatattttattccctattctagggaggaatgaagtgtccatgagttggtcttccttcttgattttcttgtgttttggaagttgtatcttgggtagtgaattaaaaatcttaattgaatattaaatttgttgattttattccagcatgcaatttttcctatatgtagatgggaaaggaaatcaaagttcattttgactcagacacattattcaaaacacttcttgacaatggaatgtagtttgttttgaacagtctgaatgaaaaacaagaattatattctctttggagcgcttctccctctgatgactgacatatgtcataaagttttacttccctggattctctcagtgcatttgaggagcagtcagtcttcagtgcattcttggtcttttgcacatgaactttcactgctctttatgaaaaaaacatacagccttcattcagcttcttttctcttcttgcttttacctcaaggtttttaagtttatttttgttctattgtacaataggtaaattttccaagtgagcattatgtgcaggatgataggcaacgggacagctttgacttctggccttaagtgaaaactgatgagatagtagaaagagtcatcttttgacagcacaaattctatccttggtgatatcctattctttcctacaaagacatctactacaagaggagtgctgttttcaagattaaaatgtccacatgtacttcctaatactttatattgggtttgaaataatttctttaaaaataggtccattatctttttcctgctgcttccagggataatgttgtagtattgcaactttttctgaatttatattcatgtgtgtatgtatgttgcatgagtacatatggatatggtgtaatgtatgcagtgtgtgtatatgcacatgaagccacaggaccacttggaataccagactccagtccaactttttctttctctttgtttgtttgtttgtttgttttggagacagcagctgtcacttaccaggagctttgtcagtaggtagactggttgatgagcagaccatgcctcgcctgtctctgcctttccaacattgagattataaatacctggtttttcttttgagttttgtgaactaaatctgatcctcagcttaaagtcaaacattaggcagccacttagccttagctttataacttttaattgaaatttctatcagtcaaaatgttagcaatatagtcagtaatagatgggacgtatacaactcacgtaaatatttttactgttaatatatgggggagataggaagtggaagattatagaccattccataatcttgaaacagtaatttcccccaaaaaacaccaataaaaaaacttacataaagaatataaaattgtcttgatatttttccatctcatacatcctaattagtggatcaaatttttacaggaacaacatttggataagaaggagtaaagaaattcctgtaataaaaagagttttcttagtttaactcatgttacatgactgcaaccagaggcctattatcttggattcaagaaatgtaaaataactccacaggtatcatcagcagaagaaactgtagaatggaattgaagatcagacatacagagatccacaggaccttagacactaagtcactaatgcatgttataataaagtgattttggtaatgaaaactctcagaaaatacactttgttttgaaaagataaaggcccaaaacaggatctttcccagaagctgtgttgctttggcctgtcacagaagccttttttcagtagtccacactctctcctgtgtaaactactttccatggagtcccggaaccaagatggctccagcagatcctgaggcaaaggcctcccaggctgggtggacacctgtcctctggccgggaaggtggctggttgtctggagcctgaaaacagcgctgacccagaagctctgtggctctcacctgtcccagaagctgcaagcctctgtagtccacactctcacctgtgcagactgccctcagaggagtcccgctcattgtacattctaagtgtgctctttgtataattttttttctaaggtatataactaacaagtatttctcccatcttgtggtttgccatagtttccctttctggacaaacagaatctttttagtttcatgagattctatttgtagattgttagtcttcaatctttaggtaatagggttctattcagaaaatcctaccttgtgtatgtaagttggagtacattccctatttttttcctccagtagtttaaatgcaataggtattacgttgagatctgccttacttagctttgactgtcaacttgacacagcttacaatcttctgagaggaattgcctagatcagatagacttgcagtcttttgtgaggactgccttgattgtttttatttttttcctttatttctattagatatgttcgttatttacatttcaaatgctatcccgaaagttctctataccttccccccagcatgctcccctactcactcactcccacttcttggccctggcattcccctgtactggggcatataaagtttgcaagaccaagaggcctctgttcccaatgatggcctactaggccatcttttactacatatgcagctagagacatgagctcaggaggtactggttagttcatattgttgttccacctacagggttgcagaccccttcagctccttgggtactttctctagctcctccattgggggccctgtattccatcctatagatgactgtgagcatccacttctgtatatgccaggtactggcatagcctcacacgagacagctatatcagggtcctgtcagcaaaatcttgctggcatatgcaatagtgtctgggtttggtggctgattatgggatggatccccgggtggggtacccagggacggagtcacagagacaaagtttggaactaagataaaaggatggaccatccagagactgctttgattgttagtggttgtaaaacactaggccagggaatacaacaccattcctttgacatgtggcttgaggctgcacaagaacactgaacatgggtctgactctccatagtttctgctggatgttcttgtttgtacttaagtgcctcaatccaaaacagagtggcaagcaggcctgccctgtgtcctgtcttgactttcttgagtaatgaatattgatttaaaaatgtaagctcaatacccagcctcaaaccccaagctgcatatagttagaggggcattgtcataccaacagaagcaagctaaaataaagtcacttacctattcacaatcaaattttgcagagagggagagataggtattcaggtttgtttgttcttaaggtgaactattgatttctgagctctatctcctataaatgttgatttacttctccaatgtacacttttggagtatttttctaagataaagtacctgcacttgcacaaaattatcatcttaatttacgtatttatttttttattttattaaatatagatatttttcacacaaaatatgctgattacagtttccctcccctcgacattcccagtcttgaaacttcccatcccatttagatccattccatttccttctcattatgaaaagaacagtcttcttagggataataataaaatattattagatacaacaaaaactatcaaatcacaacaggacaagataaacaaacagaaagaaaagagcccaagaaaagacacaagaatcagagacctaccagttcacatattcaggaatggcaaaaaacatgctaaactgaagaccataatatatatgcagatcctatgcatgctgcttctgccactgttggtttataaacccttgttttgggggattccttttttctgtctatgtcttactttctttctgcttcctcttctttagggttctttgatccccaaaaaaggtatttatttgatggagacatccaacttactgttgaatatttaaaggtcttttactctctgatattatatttctctgaatctctgcatttgttcacatctgctgcaagagcaagcttctctgatagtggctgagcatagataggttcctggctatctagtctgtggttctttgtcaaccaaggagtgttgggaatcatttgcacttcatctagtggggcttgaataagatattggctgcttattcctataatctttctgataccaatgcactaggataacttgcaggaggggcaccattgtacatcaaaaggtaatgactgggttcctctttatgtttctcctttggtaacgtacagaacacctacttgtactaaagatgcttgaacatataggtaaaggaactatgtaggcaagagtttagtaactccattttcacaagttgtttaggtgttgtcttctgaaataggtagggtcttgctttcagtgtgtggaaagtaacctatagtatttacaatagcctagaatattgggggagactcctaggacctttttggttaaaatctgattagatctgacctaaccccaatatgagcagcttcctttggtgataagagttgcacagttggggtttttgtctcccccattatctggttatttctgttagattgcctgaaatacattttgttggaggggacacttctactgtattaggtatttatactaccccctcaaatgtgtctcctcatatcctccccttgttaaaatgaattgtattttctagtgttttgttaaaaaggaagggtacttgagaaatataaagaatatttttgtattatgtgtaaggatgaatcttagtataccaagaatattatcaattatcatttatttgtataaaggagttttcaggaaaagttattttccatacatctttcttttttttttctaattgcaaatgtattatattgccacaaggaaatcacattgactgtagtacagaatgaagaaattatataaccaccatttggcattaaactcttaaattgtactcatgattcactgttttatttaatgattccaaaattgttgagacagtacttttagttacaagtccaagacctgaaggtgagattcaaccatagaatttgaatcactttaactgtgttttatattgaaatttacatatgattttgtctaagaaactacatagacaagaatataaattggatcatttcataattagttattttgacttaaagaactgatcgtcaaggagctagaggtatgtctaaatgggacaacacctttctagcatgtgcaggagccatgggcttgatcaaatatgaagaagggaaggggtggagaatggggtgaattagcaaagtggtacagtctggagacagtggcagaggtagtgatcgaatgtgagaatgtgtgaggttctgtggaaaggaatggaagaacggaagagtggggagaaagaagaggaaatatgggatgttagaatataaaattcagagagagggaagaggaaagagaggagattagaatataaggtgttgaaaaatggaaaaagagatatggaagattagaataaattctattgagagggcagaagtgacgtatggcaagtcaaaagaagaaaggaaagaaaggaaggaaggaaggaaggaaggaaggaaggaaggaaggaaggaaggaagaaagaaagaaagaaagaaagaaagaaagaaagaaagaaagaaagaaagaaagaaagaaagaaagaaagaagggaagaagggaagaaggaaagaaagaaagagaaagaatgagtgaaagaaagagaagaaagaaagaaaaaagacaaagaggagagagataaaaagcagcagggatgtgcttatctctctgtataaacaacatatctagaaataaatgttttctacaaacctaatatttagaaaactaaaagttattgactacagttgtgtgaccactaagagtttattgttagtggtattagaacttaaataaagattatagacatcaatttcaccctacacatacttcaaaaacataataagagaagttgctatacactttggacaatgcaatgtctatgacagatggaatgtaaaacaggtcgtaattaatatttggtgcattttcctgtataaacagtattgaaaataagacagtggagaaggggaggctcaaagacccctttacctacaaatgtccagtaaaggaaaacagcctgttttatagtggattcagagtttgtaagctaaatatctcccaccccagacacatgtgacaaaagaaaatccaactggccatagttgcaattctttacccaagttttatcatagactgttgatctagattcacttgtttgtaacattgagttatgtaatttttaatgatctgtttttatttttagttgtgtgagtgtgtgcatatgtttttgcataaggatttgcgggtgcctccacagtccagaatggggcatcacattcattaaagctggagttacagtgatttgtcaaccatcaatcatgggtgatgggaaactggggtattttacaagagcagcaagtgctcttaatcttggagccatacctctagtgctgtaattggtttttaatatcattttattgcatatccctttgaaaaatctgtgcataccagtacataattatgtgaaattactttgttatgaagtcatctcaactgatgattcaagactataaacatggaaattaaacatcttttaaagtccctctttcaaaatgcactgtgcatcaggtatttatacatgtcctgtattctctcctcataacctcggtagctccatttccaaccagcactgtatggtttatttcctcttttacagaactccttttcttttttccaattaggtgatccatgcatatgctgtatctcctggtagaatacttatcattgcaattcatgtaattaactgcttctttccattcaggctcagcattaactccagtatatcagaaaattcttttgtgactttttctaccttatctcccaatctatattcagttaaaagcttgtaacttctattcatttctgattttcatatattccaaacattttgagactcataaaatcagaggtaaactagaatgacaaattcctgaactagagagatatcagtcacaaatttaggtggaaagactaaattcattagttttgcagaatttctgagcatggaaagttaaggattggccatgtcagtggaatttacatcgttccaatagggagaggagacacccacacacaatctaatttattgtttagatgcacaaaagacaggcatagaggattctcagtgaagtaaacagccctttaacagtttgatgacatgttgatataaagacagtaatattctggatcactatatgtcataacagtacatacattgaagatgctattcaatgctattttaataaaatggaaatatgctcaaaatttttgtcagtttgatatatctgacaacctgttacaagtagaccttgacactatattttacctaagatttcccacttttttgattttaaataatataaaaatatgacccgcttcaaagtttgtcatcaaacttaacattatgttatgcctcatcagtttcaataatttcttctgacatttgtaaatattgtgtcccttccattgcttatctactagttcacttaatgttacatctcacagaacagaagagtttttgtgttttttatttttttgaggggagcatttttgttttgtttgtttttgttttgttttgttttgttttaatgacagccatttagtggcatccatttctttctttcaagaattaaattctgaagttcaacattaatgtacagttttgtaggcttttccagtgttgttttctatgactttcatagttttgggtgtgtgtctgtctctaagtatgtatttttgtgtttctttttgtgtgtgagtactatttatttggattaatattttattaacattttgaagtgtctcaggtctgtattcaaattaacagttttgcctgagggcatacaaatttcgtcagcatcatttattaagagtattctttatctgtgtcaacttccctttactcatttgacaaagatcatttctgtgtgtatgtgtgtatgtgtgtgtgtgagtgtgtgtgtgtgtgtgtgtgtgtgtgtgtgttgtctgtgtgtgtctatgtgtgttagaaatttctgattttatgtatttgtcccttttcatgttcaatcatattattttcatcactccagctttgtagtgaaccctgatgttggaatttttcttcacgtttaatattgtggtagttcttcttgtcatgtaaaattttaagtggtttgtcaccatcctccagctaacttcctggcctttgaatgagactgctctgtgtcagtcggtcaagcaggaaggtgcttaacctttgactacacaatgtgtcccaattcatcttttaaaaatacggtttcatagaatgtcataaattctttctgatagttggggttttacgaaattattttatagatctttaggattttaaagtggtcacactgtgaataaaacactttaaaatatcctgggcccaccaaatataaaaaatgaagcttatcatgagaaagttaagaaactgaaaaacagatgagaaacagcccaatacagtaatatcatatttagattttagtttttaattttgctccatcattccttatatccttccctctcttcctctctctttttcttcttttctgcctagataagagaggacacgtttatcaataaagcatgaaggcttatcatttatttttaaaagtaagaattataaaaaaatcatataatatttatagtccttggaaggacagagctggtcacaattctcaaaggcattaactactatggatctttgttaagatataaagtgtgaaattcattgccacagactagatagtggtggggagatagtagcacctacttattaacataaaagttccatgccattacatctatctgtctgtctgtctgtctgtctatcaatatcgaaatacatgtggatgggggcacaaatacacttgtcagcttctttagttctatttaaacaaagtagcaagtttcgatattctgggagctctcagaggtaatctgctaacaccttcagtctgccatctcactcttgtaaagcttttcagtttagtgacatgcaaaatgtactcagaagaaatactgacctgatacatcctcattagcagaatcacatgattaaacagattattctaatggcagaactctcaccaaaggacacaaggaaaattgatttgctttgacatgtgtttggctaacctgtcaaaaaccaaagcagtagcaaatgtgcagttgtggtgcatagcatcttcacaaagcaagttgtctctgactaatgagaggcaggctacactctaggagtctgattgtctcaatccaaaatgtccaatgtcctctcctgacccatattcacaaaatatactatagataatgaggattaaagttatgttacagcactttaatctaggatacgaaatgtggatgtcaaatgagcctaagatttcagaatgctagtaccacctagcagaacaacaattgtgaagtttgtgacctacaacatagtactgtgttggcattcggaaccataaaccaaaagtctttttttctttgcttaaatgcagtgttatgcaaagaatgtcttttaataatccatcttccactaaagagatcctattttgtatttctcagaaaaacacaagttgttatctgtatttatggattaaagagtttgaaacaaaactgtgcacaaaaatgtgaagccgcatttgaaagcagtactgtcactcagacagttccccttgcttatatatgtctcttgatgaacattgtgggattaggtaaacacctactagttagttgaggaggagcaggagaggtgtgcagtaacactgagccccaatcaatcactccacatatggttgaataatattacatttcagaaacactttctgaaaaagaaaaaaaaagtgcaggtctgcaaaataccagggtcatgatggggtgtatcatcatttttgaaagtctacttgtaatagcatgctacaaggtatcagcttgttttttaaaaattatttctttgttatgtaattacctcaatgtaggtacatcctcaagcttcaaatgttgattccaatatatctttaagtctgtattacaatcatgcttgtatagaaatatttttggtggttacatcaccttgcatatgtttttactctgtccttctttctaagtattttacttagaaaattgaaccacataggagagatcagagattgatcctgtgatgagagtgtgcttgcctacaataaacaaagccctagcctctatcccagtactgccactcaggacatctgtcttcccaggactcaagaggtagaggaaggaagatttaaaatttaaggtcatatttaactatataatgagctgaagtccatcctgggctccatgaggttctcccttaaaatatatatactgaaccttgcacaattgtcattattaacaactttaacctcagaaatcaatactttacaaagttcaacctataagaactaatatagacagacagtgtttgatatctcaactgattgtaactgttagattcatcataaaatatgaaacattcttaaggaaagacaaatatggaccatttttattaataatccacacttccagctatatctgtgaatgtgttgcgacaatttcgccagtaagactatcctgattcattattaacatatattatgttcatttgcaagaccaatatattcagcttatatagactatactttcttgaactcctcttttaaagtaacacatctaaggatatatgttttctagacttgtttcacaaaattcaccttctataatatgatttagtctaattattttctagtccttgtttcaattatttacccagaaaaacagataagtgcaatattaaaatgaacagcctgggtcaggatgataacacagcaggtaaggacacttcccacaaaactggatgatttgagtttgagccagggaacccagaaaatgaaaagacaaactcacttctacaagtttctcattgtcttctacatgtatatcatgtcatgaacactgttccctgattcacacacacagaataaatatttaaagtattcattggatataatatttctattttcttgaacctgtgtatttgattttatcctaatactttcctggatttcagtggccagttttctaaaaattcaaatcttcattaagtttttgagaagtatcagcctcaaagccttgactgcttactttatgatacagttacccttcatattagcattcttcacttctctaatgttgaccaggatgttatgaatggaaacacggattaaaatagtagtatttcatttttacatatccattattatttcctcagaacattttattttggataaaggccttttatactctgagaccaatattcatgaggttttagattttaaaatgcattcttctagcagtaatttagtttcagacttctgatacctacacagatattttcaaatttcctgcaacacaatacaaataattgtcaacttaaagtttattcgataacctatttacacctcatttaatcataaataagaaggtcttacccattgtgcttgtttcttaagattgctatgacaaataacagacttcatgacttggaacaaaagatatgtattttctcagtcgtttaaaatcagatttctaaatcagcttggtaggagctagtttttctgaagacttgattgaaggaagccattgtttctccaactgctatgttttgcttatgttgtgtttgaataatttgactctgtcttaattttcagaaggctttccccatgtttttctttttttctgtaaatactgtccgactctgtggattggggctaaccaaatcagcccaggaccgtgtcattttctttttttcttaaaacattttcttctcattgtttcctctttctcatatcctcccagatccatatgatcttattctttacttggttatatctataaatttttaatttttttatttattaggtattttcttcatttacatttccaatgctatcccaaaagtcccccataccctaccccctcactcccctacacacccattcccacttcttggccctggcgttcccctgtactgaggcatataaagtttgcaagaccaatgggcctctctttccaatgatggctgactaggccatctactgatacatatgcagctagagacatgagctccggggggtactggttagttcatattattgttccacctatatggttgcagacccctttagctccttgggtactttctctagctcctccattggaagccctgtcatctatccaatagctgactgtgagcatccacttctgtgtttgctaggccccagcatagtctcacaagagacagctatatcaggatcctttcatcaaaatcttgctagtgctttcaaataagttctcattaatgaatcccaagagtttggactggagcatgccttattttattatgtcttttttttttaacacaattcaacccaaggtattattaatgagcccaatatttgtatgtatcaggaacaacaatgttctttttatttggtaactagttatgagaattgcacttcaattgattcgttttgttttatttttgtttttgtttttgtttttgtttttgttttcgagacagggtttctctgtgtagccctagctttcctggaactcactctgtagaccaggctggcctcgaactcagaaatctgcctgcctctgcctcccaagtgctgggattaaaggcatgctccaccaccacccggcttcaactgattgttaatggaatggaaaagcaagaaatcattgaagttaatacagagtaatcactgagtaatgcccccccccccccagcaatacacagacttccaatgatttctaagccagtcacgcatcattgaaggaatggctaaaaaagttaaagaaatttaattaaatttggatataatttgaaagaaatgaacaccttctgttgtacatgggccatataggaattggttttggctcgtgtttatactcaagttttgcagcattgtattggggcagtctagagtaaaacacagtgcttaacaaagaaacaagtctaataatatttcatttcttttacttacaaactcaactcgcattaggtaaaacattcaatatagtagcattaattttgtgttttcacagaactatatgaaattccttaaatgattcatggatttgtaacaatggacctaaatggaagaatatgtactttttcagaagttgcttatgcaatacattttgacaatcatagtcacatcaactcattaaaattaaaactttttaataattaaagtactcatagtatatttaatttgcctcctctgttactcataaagtcgtccaccatctgaaatagtgaggtgtcttttaatgtgtagcagatgcctttgcttaaagcaatggcgatcttgctgttaaaccttcactaaagcctagattgcagtttccttcttcttagagataaactcatcctattttcagatctacaggttccacccctccagcccatttatgtctgcaatattgagcatttctttctttgcattgtgagtttgcaggcttctcttcttctgcagtactcagtggtggaattgatcaaatcaaataaaacaaaacaaagcaacaaaaatgtgctatattcagaagatggcctttgacaaatcatgagcatgattatttcacggctttattttaaatcattttgtcttgattaacatctcccaggtcgactagaaacattcttctgttttgctcatcccacaattgcagtgctgaatataaacacttaataaatattgactttctaatacaatggagataaatgataaatatacatattcaacaaaggcacaaaatatatatttgaaaacaaagaatagttgtaaggataatttgaacattaactgctggtaaatgctattctgatagctgtgcaaactttatgtaaactctgctatttactgtgcatctagaaaattccctcttgacccagaaacagactcttcaacaccaacagacattgcatagcaattatagcagggatttaagtacaagcaaaaggtccttttcccatgggaagaagcttgaactgactgctatatggattatttctttttaccctttctttttaaattttgtattgtcctatattaaaagcaagtagaaagtttgctgttcattgctttatctctagagttgagataagcatgtattgaaggcatgtgtctgactcaagaaagcaaatgtggggaaagacagatggacaacagatgtagggattgggagttctgtacattaaccgtttagtattggtcatggatttcttccgtgattgtcctcatatgtttagatttgagcagctcaattacttaacagacataaaataactatatattctcacacattcaaataaaccacacgttatatcaattattatttaaattatctttagatcatttatgatccacaaatacaaatatatttaacttactctgttacttaatggataacaacaaacatgggtacagagtcattatatatgcaacctatttttaaatacagttgatccacatttgctcactctacagaaatacatccaatggatactaataacaaccacatttatatgtatttgcctagtttttgatactataattattttttcttttggttttaatggtatcttagttgctgtataattcacatataaaaatcaaaaccatgccagtaatggaggcctagaatgcaaaaatgcagtctacattccaagtccttatactgggttactaaagtggtattctgtgtgatttcctgccttcctcttttgctctcctatttcctgctctcagtaaaatgacagtcgccttgtataagaagcaaagtagagataaacacttcacccctacactaaccagtgggtttcattaagtgatggcactttttccacattctatatttcctcatggtacatgatgttgcagatgcctctcacctcatatgtgtctggtactctgtattagaaaaacaggattagaatggctgaggagtttcctatttcaaatgaaatataaataattaagaccagttgctagattaattctagattacttaggttttttttaatgcatttatgaactgagctctgtgtgatgaatatttaaattttaaacggttaacaaaggcatgaagagcagacatacggtcatcgtgttgcacatcgatcttttctccacatttacaaacacaaatttaaaaggtgaccacctaaatgtttgaaggaacacggcctagaatgagaattctgggtccttccattcatattcattacaacttctaattcattaccatatttaccactaaaattgcagagcaaattatattctgtatcagtccccaaaggggttttcatctttcttgtttggctcttcaccaaaacagtatacattaaagagagggattgtactgtcggttgtgaataattaacatgatatagaagttggtactttgtaaaatgaatactgcttaggtttccaatgacaaatcatacccatacttctcattttgtacttctgtgcatggagaggtattatcctaaagaaacagtaacagtaaaactaggaaaaatatcttctcattgctagtccccacgttggtgattctgccttcctctctgtcctcaacaagagcaacaagaagatagaacttggcctggtaatcttttgtcttttggtttaaagaaattaagaaatgataatagtctataatattctctggaaattaacaaagcaaatgaataattttgcaagcatatttatctaagtactaactttgtaagatttaccagaagaaaaatcctttccctatagtaatagaaatccatcctattcttcgagttttaaaagatagctgaaggaaggccaaagtgtgaatgcttcaattctacatagatgtcagaacaaaataatcataggaagtagaaggtggaagccctgggagggagagaggaggaggaggagggaaaagggggacaggatcaggtatgggaagggacaggggagaagtacagagggtcaagaaattgaatagagagtctgaacaggttagagggtgcgccagagaaccggacagcttctggaacgggcagaagcacagagccgctgaggcagcacccttggcgggccgcagacagccggccaccatccggaccagaggacaggtgtccgcctggcttgggaggcggcctcagcctcagcagcagcggtcgccatcttggttccgggactcaacagaacttaggaaattagtctgaacaggttagagggtgcgccagagaaccggacagcttctggaacgggcagaaacacagagccgctgaggcagtaccctttgcaggctgcagacagccggccaccgtccggaccagaggacaggtgtctgcctggcttgggaggcggcttcagcctcaggagcagcggtcgccatcttggttccaggactccctggaacttaggaatttagtctgcacaggtgagagtctgcaccacagaagctgacagcttctgggaactgccaaagcaacacagcttctgagagaggccctgttttgggccttcttcttccaccaggaggaggtccaaaaacaagatatctgcgcaccttccctgtaagagagcttgccagcagagagtgctctgagcactgaaactcagagaagagaatctgactcccaggtctgctgagagaaggtaacagaatcaccaaaagaacaatctctaaacagagtcaactataactactaactccagagattaccagatggcgaaaggtaaacgtaggaatcctactaacaggaaccaagaccactcaccatcatcagaacccagcactcccacttcgcccagtccagggcaccccaacacacccgaaaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagtgaggcaacactggagatagaaaccctaggaaagaaatctggaaccatagatgccagcatcagcaacagaataagagatggaagagagaatctcaggtgcagaagattccatagagaacatcggcacaacaatcaaagaaaatggaaaatgcaaaaagaccctaactcaaaatatccaggaaatccaggacacaatgagaagaccaaacctacggataataggagtggatgagaatgaatattttcaactcaaaggaccagcaaacatcttcaacaaaattattgaagaaaacttcccaaatataaagaaagagatacctatgaacatacaagaagcatacagaactccaaatagactggaccagaaaagaaattcctcccgacacataataatcagaacaacaaatgcactaaataaagatagaatactaaaagcggtaagggaaaaaggtcaagtaacatacaaaggcaagcctatcagaattacaccagatttttcaccagagactatgaaagccagaagagcctggacagatgttatacagacactaagagaacacaaattccagcccaggctactatacccagccaaactctcaattaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggagcttctgcttcagccttccaaacactcgcctttgggaagcagccttaggacccatttgctgagctgtgagatcaacatggcatgtggtttagatgttctagtcatcaggcccagtttcaggctctgtcaaccaccaaatcctagcagctttttgcgtgtactgtcgtccttaggtgcagtgttctttgaactctgcagcctgagccagactctgactgagttcctaagggtttccaagtgagaatataacttgctaaggtggcttaatccacaaaacagaaaaaaaaaaaaaaaaaagaaattgaatagaaatatgtaccagtgggggatggggaactgggaatagccactagaaagtctctgatgccagggaagcaagaggctcccaggacccaatagagatgacttcagctgaaatattcaacaaaggggagatagaacctgtaaagaatacctccagtagataggttcggcttctggttgagggatggctccacccatccatctcaaaaattttaactcagaattgttcctgtccaaaggaaagccagggacaaaaaatgaaaccaactgaaggagaggccatctagagagcaccccacctaagaatctatcccatctgcagacactactgctgataccaagaagcatttgctgagaaaagcctgatatggctgtctcttgagaggctatgccagcgcctgaaataaagatgtagatactcagagccaaccataggactgagcctggggactcctatggaagagctaggggaagcactgaaggagctgatggggattgcaaccccataagaagaacaataccacctaactagaccacccagagttcccagagactaaaccaccaacaaaaagtatacatggagtgatcaataggtctagatacatctgtagaagaagatgactttatctggcatcagagggaggggaggcccatggttctgtagaggcttgatgtcccagcataggggaatgctagagctgtaaggcaggagtgggcaagtgggttgaggagcgccctcatagaggcaaaggggaggggggacaggggcaataggatagagtgcttgtggaagggaaaccaggaagcaggatatcatttgaaatgtaaacagataaaatggtgaataataaaaaaatatggggaagcatgaagtaaaaaaataaaaaagtctaaaatataaagaatcccactcaaatttgtgtagaataagctcaaaagttggcagaatatggtattataccaatgacatctgaaatatggtcaggcaacccaattagagaaattgagagtagtaatatgggataaaagttttaagcagagtctttgctttcaagttttaaaataataagtttatagtttagtgctaggcaccagggaagtgattatgcaaatacataaatgtacaagattctatttttgctttcatgattatataattgatacatcatgagaagacttaaaatgtttgatattaattgcactgaaaagtacacacatgaattaactaattccaaaatgccatgtgcatcttcaaggaaagttcatacatatcctaagttttctgtattaatgttatacatttaatattgtaggatccacttgtgaaactagatgaatgtattgaattacagcaaaagtgatttatacttttccttatgagtaaagcaagctagtgaggcaataaggaaccctgtggtctctgcttcagttcctacctccaagtatctgctttgattttgtgtgttggctccccatgtaatagactataacatgtaaggcacatagattcattattccccaagttcatttagtcatgttttttttatcatggaaataaaactagaatactgatgtttaaagtgttgtgaaaaggtgcctctgtcagttaggtgtcactgaacacaggaaaagagtggtgtgtagtgagagcctgcatcttctgtcctattctcatttcagacagagtttttttttagctttttactatctttcattttatggatatcagaagattatatttcaaaaaaaaaaggactgtttttgtatgtagactatatctatctgactcttctgggtttagacatgaatgcaagtacataataaaaagtagtaaagaccagtgctttgagttcctagtgcctgcatttccactatgaagcataaggaaaatgcacatctagaaattcttgaacacattgtagcagcagagacatacaggaaacagtgctaatattttttcttggcccataaattactcaagaaatgacatgattgtagagaggtagaaaaaaagaggaaagacagaaacaaagacagaaacagaatcagagacagaaagagacatagaaagagagacatagagacagagatgaacacatacacacatatacacacagagacacacaaacacacacacacagacagacagagggaggttttctttccaattctctaattcttaaaattcttaattatcaaattatcattgaccttcttgttggttcataattttctcactcatactacagaaagatttgcaacacaagtgtaatagcttattgtatcacaatgtctacatcaagaatggacaggtaattgacagaatttttataggaagaacagattacttgaaacagtaatgcaatgtgcaatggcacaaattgaaattcattagtcttctggattatttaagtatgatagcttgggtttgtttgtattttaaaaagatatgcacaatatataatatattaatcctttacatacttctccctttttccccacatttttttattcgatattttcttcagttacatttcaaatgctatcccgcaagtcccctatacccttcccccaacctgctcctctacccatctactcccacttcttggccctggtgttcccctgtactgggacatataaagtttgctagaccaaggggcatctcttcccaatgatacttctcccgtattactgagagatgaagcaagttttaaacacggatcttttaagaaaactagcccatacgtgaaaactacctttgtccaggataatgtaaacaagtgaaaacagagtactgtctcaagagaaattcacactctgcctggaaacaagcaagcaaacaaaggcctctgcactattaaaaatgtgctaaccaattaagagttctaaatacaagttgctctaacaatctaaatgagggtgtgaaactagatttatgatgtcagcaatggagagttgatcttcgttgtcaacatgacacatagaaacttatatgaagttagaagatagaaactcaactaaataattgtctaattttctccaccagattggcctgtgcacatgtctgtagtgtgttctattgactttaactgagaaggaacttagccttgagccagtttgcactattcctcctagggcttgcattaagcttctgccttggctttattcagtgacagactgtgttatgagagcctaaactgatataaatattttcatttgctgattgccttcagttggtgtatactattggagaaaaagaaaatctaaagcaatggttaatgcctaccatgcttcttcttcttcttcttcttcttcttcttcttcttcttcttcttcttcttcttcttcttcttcttcttcttcttcttctttaatatgcctagtttgcaaaaggatcaccataaggtatagccaaaatttagaactttctctaattctgttatttttttaaaaaaagcagactccttatgaattcagaaatttaaatcaacaacaaagaaggttgttttgcctcagacattttacttatggacttgggcaaccagatcatccatttcatctttgtttcccctctctgtaaaagatggacagaaatctgtatcctaattatgaactacaatgcaatttgctccataaagtttatcacttatatttaatctagcattatcttgcaagtatacagttttcaggtagtagatattaggtggcctttcataagggccaagaccctttctcaaggatgctgttgttcatcagaattgttttacctaactttcatctctttttctcagtctttctacaactgttcttttgattttcagtgagatcggaaatcagcagcttaccatgttataacatcactaatagttaggaaatgtgtagtttaaatcaaagattataggacagaaaagcttagttctctgtaagtatctcctttctggccattagttctggtactttctggtataaggaacactactatctcaaactattataagattctgtttaaaaaataatgtgaattcaagattttatctggtatagtacaaagatgtagggagaatttcctttaaaaagagtttggctctgggcaatatttcaggatttctatccataaccctatcaggcaataatggagtagacagaaaggggctgaagaaaaattctttttcttaaatttacaatatttaatatgctttataacttactaccagagctgggcttttttaatcaaggaaaataaagttcacttccaagtttaccagtgaagatcttttcccctgtattttaccatgctaggaatttccaggcctttttgccatggtcctacacccctccacattttcgactcttttctttttactttttttccaattttattagatattttcttcatttaaatttcaaatgctatcctgaaagtcccctataccctccccactgccctgctcccctacccacccactcccacttcttggccctggcattccccggtactagagtatatacagtttgcaagaccaatgggcctctcttcctagtggtggccaactaggccatcttttgctacatttgaagctagagacatgagctctggaggtactggttagttcatattgttgttccacctatagggttgtagaccccttcagctccttgggaactttctctagatcctccattgggggccctgtgttccatccaatagatcactgtgagcatccacttctgtatttgccaagcactggcatagcctcacaggaggcagctagatcagggtcctttcagcaaaatcttgctggcatatgcaagagtgtctgtgtttggtggctgattatgggatggaatccctggtggggtagtctctgggtggtccatccttttgtcttagctccaaactttgtctctgcaattccttccattagtattttgttccctatgctaaggaggaatgaagtatccacatattggtcttccttcttcttgattttcttgagttttgcaaattgtatcttgggtattttaagtgtctgggctaatatacacttatcagtgagtgcatatcatgtgtgttctttgtgattagggtacctcactcaggatgatatcctccagatacatagatttgaccaagaatttcataaactgattgtttttaatagcagagtagtactccattgtgtaaatgtaccacattttctatatccattcctctgatgagggacatctgggttctttccatcttctggcaacaaatggtgctggcacaattggaggttatcatgtagaagaattagaattgatccattcttatctccttgagcaaagctcaagtctaagtggatcaaagacctccacataaaaccagagacactgaaatttatagaggagaaagtgggggaaagccttgaagatatgggcaaaggggaaaaattcctgaacagaacagcaatggcttgttctgtaagatcaagaatcgacaaatgggacctcataacattgcaaagcttctgtaaggcaaaacacactgtcaacaagacaaaaaggccaccaacagtttgggaaagtatctttaccaatcctaaatctgatgcaggactaataaccaatatatacaaagaactcaaaaagctggactccagaaattcgactgttttctttgaaatactcttttaccagggttttcaggctggacttgaactctagtctggaaaagcctggctctgtctccagagtagctgaggaatgcaggcctgtgctggctgtactgtcaagtctgccttggccttttaccttcaagaagcacatgtgacatcatgtgatgccacagctttgtcaggagtcaatagcattttcatagctatgcaagagtgttcatcagcaatggattcatcattgctcacttacatcaataactgcacagcacaacagtttgactattatttttcaagaggcatgtatattaataaaattgaatgtaaatgagtcaatagattcagtattatgtggagcacagctttggacacaacttcttttcttgcacaatcaagacacgttcatacaattgtttctctttagactgcagctcataaggtagtttcagctaaccccactaaccagaaaaagcaacgtatatctctgaaagaaaaggaagaaatggttgtggaggggtaactgggaagggggatatcatttgaaatgtaaatgaataaaaggattttaaaaagaaagaacgaaaaagaaggaatggaatatgaaaagcattattataagtaagaatctcaggtaaccaatagagcaaagaacatacctgatgcacgttttctacaactgactatattcatgtgtttttaaagatataaaataaaagcaagcacacacactaacataccccagaagtataaccacttcaatgcattaaaaacaaaaactcttgttcaacaattttaaaaaaaatattattttgtttctagtatttacatgattctgatgcattgattcaagaaattgtaagaaaatcttcacatctcatttagattcggtgttatgtagtcacataatgcttattaagacttctgtgaaaggaatgtctttgaaacagttactatcccacaggattaaataatgatctatgcatttgtataaatttttccaatctcatgacttattaaaatgcatagctactttatgaataatctgggtaaaaatgaatatttttgaaagttcaagttacaatctttagtttgcttttaatattcgttctatgtcaaaaagaatgagatcaacatggaagagaccagtaaagggactagagtgaatttctttgtggcatatcagtgctaatctaatcaaatagaccttttgacaattcaaaattattgtctaattaaaatattagtctatgggaattttatcacttctaatttaataagaatttttatatatcattctcttttagttacttcatttgtatccttttgatgtattataaaaacaagtttaagagggactttgttgtcttaataatacagaggagtgactgagcaatttgatcattggattgtggtggctgtatttatctttagctagctttaggagagttgagattcaaatccatacccaacttattacacaaaatttactgttacctttcctttcccattttatactccaagtacttagtaaaacaatgaaaacacagttggtactcatgtacacattgtttgtctttaaaatttaattttaatctctgagcatttcttgtactaatatacactcatctttctcttctatgcactttctttaccattttagtttgcttgttcatttgttgattgtaagagtgtgatagtatattcgttgggaatattttatttttacattaaatataaaaataaatattttatgtatttacattccaaagttgctccccttcctggacccctccccaagttctttaccccagcccaactccagatagggtgctcccccacctgctcccccaccacccacatcacccccaccagcatccctctccctgaggcatcaagtttccacaggattaagtgcagcctttcccactgaagccagacaagacaattctctgctacacatgcgcccaggatcacagagcagcccatggatgctccttggtcggtggcttcgtctctgggtgccctgaggggtctgggttagttgatactgttgttcttcctatggaatgcagtccccctcagctccttcagtccttcagccaactcttccacaggggtcaccaacctcgatctaatggttggatttaaatagctgcatttgactcagtccactgctggtttagcctctcaggtcaatcacattcctgtctgcaaggagaatatggcatcagtaacagcatcagggtttggtgtacccacctgggatggatctgaagttgaattggtcactgggtggtctttctttcagtctctgctctatttttggccctgcatttccctttagacagtaacaactctgggtcaaaaattttgaagatgaagggtggtcctctgcctcaactgggggccatgcctatcgactggaggtggtttcttcaggttccatctctgtctagtatttcagctaatgtcatccccattgagtgctgctagcctcacacatcctagggctgagactttcttgaggttccccctcccatactgctgcatatttcacttcattgccctagccctctggggttctctcctgtcttcccaatgcttgctcctgggacccttttccctcccctctcccaaatcccactcagcttccttccttcctttgcctcccatgattatttggttctaagagggtgtggggtactcacacgtgtaccttccttcttcttaatctttctaaggtatgtagggggtatcatgagtattctgaaatttttggctaatatccacttatcagtgagtacataatatgcatgtccttttgaatctgggttacctcactcaggataatgttttctagttccatccatttgcctgcaaaattcatgatgtcctcattttaagtaggtgaataatttttcattgtgtaaataaaccacattttctgtatccattcttcagttgagtgacatctgggttgtttccagcttctagctattacaaataaggctgctatgaataaagtagagcatgcatccttgcggtacggtggagaatcttttgatatgataatgtattagtattgtatgatattagcttggaatgttttaaagctaaagaaagatgtagtatattcaaaaatattcaggagaccatcatatctttttatattttttctcactatgatgaagactttcttgccaggtctatatttctatagacctagatgagataggatgaagagcataaggttgaacataaaacattttcaaattagcatattgaatcttcatatttctttccattactaaaaaagtattatttatgtgcccattataaactgtaagtgaaagctgaagaatgcaagagcacccaaacaaaccaaaaccctgttttctcagaagtagtgaacaccctgaactagtctttaaacaagattgtttaaatttttgtttcatacttgagtgtttgtcttttgatattctctagtgatcactgtgcagtgacaccaatgtgaaggcagtaattcctcctctagggactgaaaattggtgactgagtcatattatataatattaaatgatattcaatgacaaaagtaagtttgaggaaaaatggtgttctgcagatggacagtggatactgatgaagcaaaactcttttatgttctcattcttttttccaaacaaaaatgtgccagaattccgctatcagttataaatactataagcacagaggctggagatgaagatgagaatctgtattgctacttataaactacttacagaataccaaaaaagagaatgtaaaacaataaataacatgtatacatagaatttctgttcttatgaatattacattttgaaggaatcatagcataaaaaaggaattatatttaatgtacagtacttagtagtataaatacagatttttgaagagataaaacacaatatgcatttagaaaataaatatgagaaaataggaacttgccatctcacaattctctatattcttaagcattcaacttgaccttgaaagttggctaaatttttggcaggtttaaataaagcctgaatcccttctacttgtgaatcttctacaatgctaaatattctgaggttttcagtgtactttcaacgtctaccaatgaattaggattatttttataggaagtacattttgtgtaagattgaagttctaactgatatttatggattatgtcaaattggtaacaataaatcctaatagaaattatgagattgttattagtacatttgggaattttagtcaatcactatggttggacaatcaatatttttagattatactaaggactggaatattgaagagaagtggctacagaaaggattgctacattcagatgcagaccaaaagggcctaaaactgagtggagctggatatcactgtataaagctttcaaagcaaggaatactcaatattatagttgtgtacttcaagtatcagaacatctaatacccactaggtgccagaaaatgaagagcttagtcaattggatactaattttatattattttccctcacctctgaaaatgaacactaaaggaaaacctataagataaaccttatatgtgatagcggtgttggaaatcaaacccaaggcatggtagaagttgtgtaagtgcactgcctctcagatacacccagtaggccaccatgacactttccaaagactggtccctacttacttaagttcacatgttaggtccttatttctaattaaaataactgcattattctagcccaaaacaggagattaatgttgatctaaaaaaattaggctgctgaataaaatatataaatagctgtcttttagttcttgtgttgtctgaagtacctttaatgtatctgcataactatcattgaataaaagggcttctagctcagttgctttaatatcacaatgagaaatggcagagctgttaagaaatactagacatgcattgaaaaagaatggtacttttggaagatattcacaatcaggagtattagttacagtattatcatgtgtcatgcatttctgtataaattttagaaataaatatttgattgaaacctgagataggtgagatttacctgattaataggtcttaaaatatacagaaatccaaaatgagcactcaagcctgtcttcaagactctgtcctctttattaagatggcataattcattctataatagagcaacatatggttgagtgtaaaataaatggagaaaaggtaaaataataatacagttatattaaactaaatgtcctcctttgaagcctatttagctaatactccaagaaacagtaaatgctatatctagagtcttcaagtacaaaatctgtagagataatattttctctttgcaaaggagaaagaactttaataactttgtcttcacctacatgataatcctaatttataattatcagtatcatcttgctccttcaaataactttccttttcgggaagcagaatgagaagcctgctttccttgctttgagaactgtttatttttgttcctaagctgagaaaatcttttgagagcaactcatgtttattgatagcaaatatagtttgaggatgaaaccccagctcagaagcaagcttacttttaacttataaaaagtttatacttttagcttataaaaagtgatgtagtcttacctgaggtgtctttcatggtaaaaggtgagatttcattttttttaactgggattgccaaaacatttgaatatgacttctgtagatatatgagtgaccaaacaatcacctcttccatgaatactttgaatcaaagtgaaagccatgtgtcaataaataaccatgttgacaaatgactttattgactgctaaagcaaagctaatgtcctggaaagcaattaacaaaaggtaacatttagtaaaattattattatatatgctgtattttaaaaacatcttaagaaaaaatgtttaatacatattctgatctataagaatactccaagatgtatttttaaattatttactttatatgcatgtgcatgagtctgagtatgtatttgcaccatgtgcatgcagtgctagtggaagtcagatgtcaggatcaactggagcagggaactgtgagccacccctggtgtgaaggagggggaactgaacacctaagtctgcttccagaacatcagatgctcaaaacatcaaagcaatttctccaggacctccaagaaatattaaaaggaaaatgttcttggtgtctgtatgctctgaaattattagcacgctgttttatttttttattgtattttgctttggtctcctgatgtcacgtatctggaaaaggttagactagaaaaggtaaacacagaaaacctggaaaggactttaccataaagcactaacatgggagattctgatttttcactattggaacagcatacttttatgtgtagttgtttataaaataaataataaccctaagatatattactcacatctgagccatgtgtgtcattgatagttcaggtaaaattaaatttgcaaaaatgtatattagaatacagattaagttacaattcaccaatattgaaactaaaattagaagattcagtagcttggattatagtctacatgcctcattcttgaatataaattaaatgtgttgatactatggttcaaatttgtgcatatactccatatttagtctatacttcatactgagactttgaataaggcaaaaggtctcaaggttgcatggattgtacatttcaatgaatgaaaataaacaagaaacctggacttacagactgtcaaagtgatgtgtgatcctatgaagaataaaatagggccatcacaacataggggaaattttaggtaatgtgactaaggctcttctgatttaggattttatttttactagtttactttagattttatatcccaatcatctctgcctcatagttacccttcaaagaatctcccctcccatcccctctctcattcttctgtaagaatggtggccttcctgggtaccccacaccctgccacatcaagtctctaaaggattaggctcatctttgcccactgacaccagacaaggcagctctgttgggaaatggattccacaagcagggaacagctttagggacatccccaatgccagttgttagaggaactataggtagattgagctgcatatctgctacctgtgtgtgtgtgtgtgtgtgtgtgtgtgtgtgtgtgtgtgtgtgtgtgtgtgtgtgtgtgtagggggtggggcgctcactccagtctgtatatggtttgtggctcaggctctgatagcttccaagggtctagattaattgactctgttggtgtatttatggagttcctacccccttcaagacctttaatccttatcccaccatcccatggcagtcccagacttctatccaatgtttgcctgtgagtatctgcatttgtttcagtcacctgtttggtggagcctcttagagaacagctatgctaggctcctatctgcaagcatggcagtatcattaatagaatcagggattgatgcttacctatggaatggagctgccaaccaaccagaggacaatttctagggtagcacacaaagtaccttcaggcaaagggctgaggatgttcattctgtgtgataggaaactaaatacattggggtgcaaattttaacagctcctgtttgggctatggtttccatttgctctctcagtccaggatttcatgctcaataacactctgtagatacaaaacctggtagtgacagaagaaacatacccagaagaagcatgtttttagcagagaaaatgtttaggaaaaatatcctgagtcaaaataaaactaaatagaaagaaatattttagaaaggcgtctggcatcttgggagcagtatgaacagtggtaaaggttaggttatccatctatctgtctgtctatctgtctgtctgtctgcttgttggcattatctctgtttttaattattgcacattcaatatgcatatcagttcctttatcatacgttcttgtatgtataatgcatttttatcatattcgttctctattgaattctcttagcttcatagtactactgcagacccaatgttctcctgtccactttacactttcaggtctgttcctggtgtgtcaaaggtttatagtatagttgaatacaggagcacaaaggaaggactgcatataagagtataggtaccttctagcgactacatcactaaagaaaatcttccacctacagcaaagatgtgaaaggttgaatgaaaaatgagaccaagtattattcttctaaatattaggatgcaataaatcactaagaattaatagcctcataggcctggtgaggtcagcacactgcagattattcattgttagggaactgtagagcagtggtatttataaaaataatacctgatctgatttttccattcagaaagtcatatattcattcagaaagttcactgaatgaaatatgagaatattggtcaataggcaactgtgcctctcctgtgtgagagattggatctgtgtctaaaacaaaagcaatttgttatctttataaatattgcttttctagttgtagttttttaatcagataactttgagtaagttaccaatcaaatgaaactgtgggaaggtcattagttgctcacagaaccaaaaagaggtgacagaggcaggtttagaatgaagaacggctgtgatgagagtggaaagattgctaagaatcagctgaggaaggggtgatctcatgacaggcagattttgttcagagcatgagtttggagtggatggaatccaattatcttcagatttgggttcattttctctttttgtccccttcagctccagacttcaagacagaaatatccaatagtcctatattgcattctgggtaatctcttcagctgagctagtaccagaaggaatctagcagtcagcaggaagatgagtgcatgtggagcagacggttccctacttactgtaatatgttagaaaatgctaagcatataagatgcagtcacctaattttttttttttgcagtttgggaaagctacatatatacacatatgtaatattctagacgtaagggttacctgaaatgaaatctatatttaagtagaaaacccaggtgcttataaatatgtgtgtgaagaaagatacagacacaggaagatttagtgctggtggctgcattatattatactcagggttagaaaaataagttccaaccattccagattcagcaatcctttctttaagagctcttataacaattccttaaagaacctatagccctattaatatgctgtttagtctatgaaaaactacaatgaatcaaactaagtattcaaaattataattaaattttaattagtaatttttaacaaaatatgtatttcagaatctacatttccaggcacagtcactaaaaaaaaaaaaatgccatatactttcacttgttcccagactcaagcacaagcaggcacacatgtattactcttgtttgtgtggctgagctgatgatgttattttccagagtcatgaacagattttaatacacactgagcaaacaaagttcaatttccccttaggtagcatgttcatgtactgcaacatttatattaaccctgacatttgaaagtagtagtttcctatcacagtgacaacacagaagcctcacatttatatgagatgaggtgagattataacctttgtaagactgagtgaccataaggatagattggagacaagcagatttgctttattaattgtgtagacttgggaaagaatctgcaaggtatgaagagtaaatatcctctgatatataaccaaagcctatgaaatcaaatatagagatagatttgaagactattcaatatagtgatcatttggatacaaagctgagggaaaaggaaatattggaatttggaaaacctacttatatttttcagtctagcagtggctggcatcagctgtaaagtgagaggcaatatacaacaataagaagaaacagtaagcattctttgtaacatatagtgtgaagtgcagttatgctgggtagttgcttgaactcttggtgtggagttcgggaggatgatctttgctgaagatacagactttattcagggtaacaaaatgcaaataggaaaaagaacagggactcgaggtctcttacaaacagcaaatatacattagggaattagcatattcttttctattataagctatcttggaaccatatatgaacatccccacaagtacccagagtgtaaatgtgtctgtgatctttaaacactaaagagacttatatatcattgcatcatgaccacagcacatgtgattcttcattacatggacatcagttcaaccctcatttaatcttggaagtaacttcagttcacatcttagctctttctaatattacttggataagttgggtcagacctagagaactcagttttctcaaactaaaatcaggatataatatccaaatctcaagatgtttcagattaacatgaataaaggtatccatgaagctgagagccctttttaatataagaggtgacctgagcatatgaaaaacttgggacagaagactgtagagagtcctgctcatattattctgcagagccttgaaaaatgcttcaagtaggaaggcctgcagctatttaggcaacaggcacaattggtaagaccaccatggatagtgccattactgtcattaatgggtgtgattaacaaggtaatccgaggaaagccttttggcaagaagaatgggtaagctgaaaaaacacatgaaagatccatggttggggaatgaatttgcttgatatctgggtacataactttggcattgtcttaaatataccattaatttactattaaacacacacatacacacacacactgagagagagagagagagagagaacctagaagaaattgagttcttgaaaacaattgaaaatgcttattccactatttttcattcttttttaaaaatctttttctttttttaattttttattagatattttctttatttacataataaaggaatcccctttcctagtttcccctctgaaattcccctatctcctcccccttccccctgctccccaacccacccactcccgttcctagtcctgccattcccctatactggggcatagaccctttacgggaccaggggcctctcctcccattgatgactgactaggcaatcctctgctacatatatagctagagccacaagctccactatgtgttttctttgattggtggtatggagtactactcaacaattaaaaacaatgactttatgaaattcttaggcaaatggatggatctggagtatattatcctgagtgaggtaacccaaacaaaaaaaacaaacaaacaaacaaaaaaaaaaacctcacatgatatgcactcactgatattagtggatattagcccagaaacttaggatatccaagatacaatttgcaaaacacatgaaactcaagaagaaggaagacaaaagtgtagatacttcactccttcttagaatgggaataaaatacccatggatggagtttcagagacaacatctgtagcagagcctgaaggaatgactctccagagactgccccacttgggaatctaccccactattcttcattcttacaatttattttcctttgcagtttcaaatttatgaaaataattattcataaattattataaaataataattattttaccctctttatcctcttttatgtccctcccttttccactgagccttttgcttcctcctagtaattttctttgtagttttttgaatttttttccctatcagttttcaaaacacacctttggaataaaactcatagaaaatctttgaggaccgagcatgtgtttcagagcacagctaccgcttaaaaggcacatggccctggctccaaactctagcattccaatagtagacgttcttctttctgaaactgaaatgactctgataatctttgcgaggaatgggaataaatctacgcccaactgaggacactgctctccctagggtcagaaagaggaactgaagaaggtcacttagctataagccccatcattgtgcagaggatcccttggtacaacacttgattggcttatgttcacacaggagggtgcattgggactcacagagactagaatgtgaaagaaaagaaaaatctaaaggacacatttctttcctaaatgaagtacatatcttgagtcttaatttaaagtaccaatttgtagtaataaaaacagatgtattatccaaaagttgactgactatattaggaactttattcatacttttaggttcctgccaaatataaaccattgatgaagagaacagataagagagaagacacggggggggggggggagagagagagagagagagagagagagagagagagagagagaaaacagtgatactaatgtatcagagaggaggcagagaggaggaggagggtcttgccaccatttacttgttctctagattctggcaaccctctaggatgctgcctgtgactcctcagaagctctgcctacaagtttcaaagacagtgatacatcagctacactgtaattgaaaactcaaacgatattagcccttccctttcttaattaaaataataattgtgatacccagaccatgaaaaaggcaggctaccttctcccacaacatgttattacataaagaaagagaatgagatttaatgagtcctattgcttttgacctaattaaattctcaatctccgacatcttagcttccacctggcctctgtagctcataaatacttactaggatctgctcattgacagggccactgaagaaaatgggtttcttgccctagatgtgtattatgattgacagtgtaatcttcagggatgctgtggtgtcaggaacgccatgagatatgcaacagctctgcgttccttaccagacctctcttaattatgatggatatagagttgcaggtatcaggatgcaggtttgtgacagatggaggtagctctttttttttcctgaaaatttagaatagaaatccatcccagtgcactccaatatcctggtgctaataagcattagactcattttttgaaacatggggttaacctgtatgtgtgtgaacatgcctgagtactcatgtgcagtagcaaaataaactttatgttgctgtgcaataaggcagagaaaaatctttaaaacagttgtttcctcaagtataatacttaccatatcaggaattttgctctgtattattttcgtatgtgttttttatagtggcagcttctttatttcagacaggcctcacagccattcttttagtctgggtagcctctgtctactgagagttgggataacaatcgtgagtcactttgtctgactgctgacttttttttttattattcttgatgagtaacaagacttaacaaagaggtatgtaaaagcactcaactctatttgacaaataaatgcactagaactatattccataaccacttttatcatataaagcaccacatatacattccaaaaagacttttagttttttaattaagacctagaaatttttgaaaatttagggaagatgataagacaattccttaaggcacatatgcaatatatagcacctataagaaaaaagaccaccccacaagtgaaacatgattgatattattttgtaaaaaaaatgttacaggtgggagaatgactgagacacaatcatggcacatcaataagtacaaatttagtaaaacacttatctgatcataatttctcttaaacagagaaattagagttcctgaatgaataccagtgatactcagtatacttctggtaaaggtggggtatatttaaaaaggattttcattgaataggattggtggttcaatttgctcacaagagtaccaactattcattctataaatttaaaatatcccactgttgactttctatttattgtcttttacctttactcattgaaagaggattcaaaaaaaaaaaaactttaacaaggttaagtgattcgttctgagtgattttccccaataggatgcatgatgttttaaaatttatcaacaatcttggatggtactgacttatatatggtgtgattttttcactcaacactaactatagacattatcatgaacagaattccatctagacattatcattaacagaattccatctgaagtacaaaaattatctcaagaaaacctttttgtagtatacatgatttatatgctttttcacaaaaaagtttgtgttagatttatgatatagttatagaagttcaaatgttattaaagaatctgccccactccctcaaaaaaaaacaaacaaaaggagaatgtgatggtttgaataagtatggcccccattcatgtgtttgaatgcttggactcagggactggctctattgagagatgtggacttgttggagtaggttaggtcttataggaggatgtatgccaccgaggaagtgggctttgaggtcataattgctcatagtatgccagtgtaacaagcagtcctcttctgctgcctgttggtaaaaatgtagaattctcagcaacttttctagctccaaatctgcctacatgctgccatgcttcccaccatgataacaatggattaaacctttgaacctatcagccaggcccaattaaatgttttcctttgtaagaattgccatggtcattttgtcctattgacagtgtcctttgccttacagaagcttttcaattttatgaggtctcacttatcaattcttgatcttagagcctaagccattggtgttctgttcaggaaatgttcccctgtgcccatgtgctcaaggttctttctcactttcttctctagaagtttcagtgtatctggttttatgtggaggtccttgatccacatgaacttgagctttttacacagagataagaatggattgatctgcctctttgtacatgctaaccgacggttgaatcagtgccatttgtttaaaatgctatcttttttcccctggatggtcttagctcctttgtcaaataccaagtgaccatatgtgtgtgggttccttactgggtcttcagttctattccattgatcttcctgcctgactctgtaccaataccatacagttttaatcactattgctctgtaatacagcttgatataatgccttttgatcattaccaatagttaacaagtacatttatatatttgaaaataaaatcttgatgtttacctggatttctacaaggtgacaggttcaaattatactaaaataaaatacctcctatatgtatattacaatttaaacctacaatatgtgctttgagatttaccttttaacacaaatctatatcttagtaatgcttcatatttacctcttcagcatatagtcagaattccttttggtactttagggttcttttacatgatttaccaagtgctggtcttatatccaaatataagatatgctacttttatggcagtaagacagacatcagaagggcagctcattcatttctaacaattttccttaagcaggttgcagagagactgcaaggcaatggatgcggaccatacagcaggtctcattttctctaacacagactttgcaatatatttcatatatgaataaatgaacttgtatacccagtgaaagttttattttaaccctcatttggtatcaagtacattgtaaaatagtatacacagtatggtttgtagatgataagtactagcctcgttgacatttatttttgttgcatttttgagttatttggcttgatttcaggaatattgttagattcttcttttaaaagtttggtgaacagttctctgagagttatcatagataacaggtagttcagttggttaatttagagttgtaaggtattataggtggcatgagactatgcagcagatatcaaataatatctaatatctctctgggagggaacattgatttaaaaatattactaacttatataggaaagatgaaaagaaaatacaggttctatgtattacatgaaggtgtaattaacctacaaaacaatatgactactgaccactgatatgtgtatattagtgataatccttatagaagatacaatttgaggttaaactgttcaaaatatatttggaaatcactcaatatgttgtatctttcacataagtgactggtcagtattttatgttttattttactatataaataactttgcagtgtttagattgctaatggtattagaaattatatcagaaaggaagttagagagcagacaggcatggtcagcctggggaaaacatttaaggatgtcttgatataaaactttcaacaagctggattaagaatatacaatgactgaattttgggatgtttctcaattgtaaggcatgtgtttatggtgcagaaaactgggttcaattccgatctcatgttcccgactctccctaccctacatcccagcacatataaaggggaaaggaagacattaaagtgtgtttaggacttgttgtccatggtaatttgacaagccaggagagttcaccaaagatctcctcgctctacagcctttagacagataatcttaagcaagacagttgactttctagagctagctttcttcatgtataagactaggcagtgctgaaaatgctaacttgagtttctaccttggttttcttctggaaaatacccgaatgagatgcaaaatgccacaagtggctggcagagcacaagtccttcagacttcttggctggggtactactacactgtgtccatggcaatacgtggttgcatactgattgaaagaattagactggtatagtgccactgatattgactcatttatttctggtcctagaattatccaaattgaaggataagtacatgtgtattttttaattatacatgctttatatgtttaatgtgcttgtctgtgcaatgcctgtatcattatcaggtctcactctctcttctcctacttcttagatttttttttataattgacattatgatatgattgcacaggtttcccccaccctttccttcatccaaacccttgcttttacccctcactgctctctttcaaattcatggcctctttttatctcttgactgttgttatgtgcatatgtgaagaacctgcaaacacctattttactaaaccaggatccctaacaacaataaaaacattttcctttatgtccatagttaaatctagcctttaccactcaaaaaggaaacttcttttgggggcatagactattgctgaaaacaacaagtgatcaaaattcagagttgtggagcctttcctgatggctacaactacaaagtaattcccttagttcctgcaacagggtctctcactgatcctggagctcactgtttggcaggacttgctagtcccttgcaaattactgatccacttgtctccatgctccagggtctatacacactcagtctgtgttcatctaaacgcttaaatgtaggtatccctggtttcagagcaaatatactgccctttgcaacactgccagataaggcctatgttttgttattaaatcaaagagaattcacgcaactttgtaatagtttgataatttagaaaacctccctagatatcccactctaaacctaaacattgaaattgttaacttgacctcagctccctgttgtactctaggattccaacactcattatatgactaaaacgatgtagcagatgtgattaaagttattagtcagtagcccttcaagtaaggtctcagagatggtcaggaatgttaagagcaatgaatctgactactgtagggaaaagacagggtaaagacaccaactcagcaagttctcaaccttgcttgtgcattagataaaggtccatgagaaacctgtgccagggacctgtgggtgagcaggctttaggctccagcttcatagacagtgtgtcacagttcaggatgtgaatacatagctggacgtgatgagtttgcaagaaggatggtgatagcaacaggctgctcaacattagacagacaaaaattaattcaaaaccagatgcacagttaacgtgttaacacccacctaaaacacagtcttcaggaggcggaggcagacggagctctgagttcaagttcagcctggtctgtatagcaggttctaaaacattcatgtctacaaagtgagacccaatttaaaaaaaatcaaactaataaacaaaaaatgaacaacaacaacaacaacacccacacacaaaaaaacaaaaacaaaaccaaagtaattctccccaaactaaacacaagactgtattgcagctttggctctgaatggtgaatgtgaacacttgggcctggccttgtgtcacaattttttgatgccaacaaatactgcttgaatctgaacactgaccttgaatcagattcaaggctattcaaatgtggtgaattgcagtatttcatataaagtttttgctcaatagaagctgatgctgtcattatgaaagatgatgagttttaattttaatgttttcatactgctcttcttcagtcttcaaggatcaaattaatgtgtctttgaagtgcactatattagaatatatgattttaaaaactgttgtttcagttgctagctttagttaatgaaaaacataaattttgccttgatactaagaaaaaaagtttcaataacttctgaatgatctttaacctattcctatcattttatgttatgcatttatttgaaaagacattctcagcattgatgattataaaaataacaattaattctgagaaacgctgaagagcttctgtgtcctgaagtgttattcattcatccaggattgcactctttttgtcaaaataaatgagcctctcagttagtatgttgttttcaactacagtaaatggtaaaattatatgtattgcaaaaattgctttaaaatcagttgtgtggtggctttgcaggaagtgtttgacttgtgtacatccatttttttttttacttagttcatgtgtatatgtgttttactcacatgtgtatatctgtgcacggcctgtgtgtcagtgcccggagaagccaaacaagggtgtcagatatcctggaaatggtgtaaagttagttctgagccgccatgtggatactggaaacggaagctgggtcccctggaagagcaagccacagattgatctcttcagactcagtgcactgattatttaatgggtatatgtttcagatcacatgaaaacttattcagtgatatgggtcgttaatgaaaaaaatgtttaaaattatatcatagatgatagtttaaaatgtccaggaaaagaaggcgttattatgaccacagagaactgaaatttactcacaacctggctgtttctcaaagtgggtgggtttgggaaccgtgctgtaatcacagacagctgacacctggagacctagaccctgcagagaactgattttaaccaggcttcccctgttcctcatatgcaaatatctcacgagaagccatcagacaagtgtggcaataagagaatagtgctgcaggccttcaatgtttctctacttgttatgaagctgtgaaaaaggcaactgatgcagttactaaaaggagatgtaaaggttgagcagatttggaaagagccattttctgtacgacaaatgttaactggaccacttattttgccaaatgtgtgtgaagagctgatgaaaaggaccatgtaacgcactgaagacatctaattagacagaagtggaaatcaccattctattgaaacactttttcctgaatcaagagtgattcaccagctgaaaagaccttgaccttctgactgagggaggctgaactactcgtcacaagatttctttccttgaggaaaccaaatccatgtctttcaaatgtagactgctattcttaaaatcataattgcagtcacttttgaatcttaaatttgaggtggtttttatacactatgtcctattgtaaataaaactgctagttacagttttatagatgaagcataattttcacttagaaacctagacgaaaaatagttatataaatcaaattctatttctattcttaattgaaccttagagtaaatggaataaaaatgaaagcaaaataaagtgctacagtcacaatttcaaacttttgaattacatctttcaaggtcaaagttctaaattataacatggctacacaggattttatttaatttatgttataatgagctatgccaggaaaactcggtcccttactttggaaaaaaaatacacacacacacacacacacacacacacacacacacatatatacatatatatatattcaaaagactgtaaaatctaattaactaatttcttttatgaaaacaaacactcacaattatgaatgtatttgcctaaaaatatgccatatatgttttcaatatagaatctcagtgtgtcaacttatttctctctaagactcctttatgtccccttgtggcaagttctgtgataatatttgctagtcagtttgtttttctcatgaagtgataacttcccttgttttaacaccagtcttctggcatcatgtagcctatcacagaagttctgttcatgtcactaacctgtcagctttaaggccatcacagaactcagggaatgaaatgcaggtactaataacgccttctgatttactatggatataaaaatgtattcaacaatgcaaattgtttttatctaaacctggcatttagttatgctcgattggcaaagcttggggatgacaatatacatatacatacatatattcatatgggagattaaaaaataaatattataagatatttaattgtcaactggttgccaaaaattttatagaacagaataaaagtggattaaataatagatgggtaataattaaagtaaattacagatcaggagggaggaacagaagtactgagtatgtttgaaaatcctcatttccaaactttcatgagaaaattattagaaaaaatattagaaaatattagaaaatgatacatttggaaagaaatgaaacaattgctagttatttccaaacacatgcatatcttatatttctatcagtagacagtttttaacagcaactgagacccatgaggaaaatagtatgacacagaaccatatagaacaaaatcaacataaatagacaatgcaaaagaaaataaaaatgtatttttctaagtctatagataattctaagtcacaatatatttatatccaaatattttatgttttttattggagaagaatatttttagaaacaagctccaagtctgttttttaaatataatttttctttattctttgaaaaatgcctatatgttctggtcaaatctatccaccagtgtcttctctcttgaaacctttcagaactcccgtcaacatacttccctttcagcttcatatctcagctccctccctcttctccttccagtttttcctttaaaaattctctcccattgcccccttctcaccagagaaggagaacactcccattgggtaccaccacaccctggggcatttagtctgagcaggactagacacatactttcccattgaggccgaaccaggcagtccaggtagtagagaggtgatccagtgaaggggaacaaagactgagacaccccctcctctacttgttagggaactaacgtgaagactgtcttagttagggttttactgctgttaacagacaccatgaccaatgcaagttttataaatgacaatatctaattgggactggcttacagatccagaggttcagtccattgtcatcaaggcagtaacatgacagcatctaggcaggcatggtacaggaggatctgagggttctacatcttcatctgaaggaagctaggaaatgactggacatcctcatgaggctaggaggaaggctttcaagcccactctcacagtgacacacttaatccatcaaggccacaacttctaatattgccactccctgggacaagcatatgcaaaccatcacaaagaccaagtagcacatttgaaacaaatgagaagggggcctaggtccagctcttatatactccctgtttagtagtctaggctttatgagcccttatgatcctatgttagttgattctttgggtcttcttgtggtttccttgaccccaacaacatcctcacttctattccccattcttccatagactcctcagcctccacctcatgtttggctatgggtctctacatctgccttcatatgcttatagatgaagattctcagaacacggtgattctaggttcttgtcagtaagcataccagaatatcattaatactgtcctggattggctctctctcatgggttgggtctcaagttgaggcagtcattagtttgactgcttcttcaatctttgctccatctttatccctgcccatcttctaggcaagccaaattgtgggtagtttggtgtacccctctctattctgaaagtcctgtctggctacatgaatggttagttcagtctctgtattcctgtctcgtaggaatctcatctaggatcaccctaatagacttcctgtatcctcctgctttctaggccagtcaccagagattacacctgctcactgatttccattctcactcccatccctttcttagccctccatctttccatacctgataaccctactacttcccgcatcaccccctctcttacccagatcactctctccatccacctctcatgatcatttagtttgcccttctgaatgagattcatgcatcctcccttgggaccaacttattacccaatttctttgggtctgtggattgtagcatggttgtcctgcactttattgttaatatccgattacaagtgaatgcataccacatgtgtctctctggctctgggttacctcgggcaggatgatagtctcaacttccatccatttgtctgcaaaagtcatgatgactttgtttttaatagcaaaaatggtccattgtgtagatgtacaatttctttctttctttttaaatttatttttattggctattttatttatttacatttcaattgttatcccctttcccagttttttcttcaaataccccctatcctaaccccctccccctgtttctatgaggatgttccctatccatctacccactcctagctcacactctggcattctgctatactggggcatctagtcttcacagggccaagggcttctcccagtgatgccctataaggccatcctctgctacatgtgcatctggagccatgggtccctccatttgtacagtttagttagtggtttagttcctgggagcttgtgggggtggggttctgtttggttgatattgttgttcttcctatggcgttgcaaaacccttcacctccttcagtcctttctctaactcctccattatggtccccgtgctcagttcaattcttggctgtgaccatccacctctgtatttttcagggtctggcagcacctctcaggagacagaaattcaggctcctgcctgcatgcacttcttggtatccacaactgtgtctgggtttggcaactgtatatgggatgaattgccagtggggaagtttctggatggccttttctttagtctatactccatgctttgtttctgtatttcctaccctgagtatttttttcccccttctaaaaaggatcaaagtacccacacattggtcttccttcttcttgagctttatgtggtctgtgaattgtattttggctattcccagcttttgtgctaatatctacttatcagtgagtgcataccatgtatgttctcttgtgactgagttacctcattcagtatattttctagttccatctatttgcctaagaatttcataaattcattgtttttaatagctgagtactactccattgtgtaaatgtaccacattttctgtatccattcctctgttgaaggacatctgggttttttccagtttatggctattataaataaggcttctatgaatatagtggagcatgtgtccttgttatatgttggagaatctttcgggtatattcccaggagtggtatatctgggtcctcaggtgatactatgcccaattttcagagaaaccttcagactgattttcagagtggttgtaccaacttgtaatcccgccacaatggaggaatgctcctctttctccatattctcaccagtatctgctatcacccgagtttttgccattttctttgtctaattttcagttgagaggcatctagtttgttttcaatttctggtgttacaaaaagatttgctatgaatattgttgagcaagtggtatagtggcctcctttggttatgtaccaagaagtgatataactggatcttgaggtagaacttttccaagttttctgagaaaatatcaaatttatttccaaagtggttgtacaattttgcacaatcaccagcaatggatgagtgtcccccttgttctacatctgtgccagtatatactatcacttgaggttttgatcttatatatcagaagatggaaagatcttctatgcttccatgctcatggatcagtaagataaacatagtgaaaatggccattttaccaaaagcaatctgcagaatcaatgcaattcccatcaaaattccaacacaattctttacaaaccttgaaagagcaattctcaccttcatatagaaaaacaagccaggcaatcgtggcacatgcctttactcctagcacttgggaggcagaggcaggatatctgaattcgaggccagcctggtatacagaatgagttccaggacagccagtgctacacagagaaaccatgtctcaaaaaaccaaaaaagaaaaacaataaaaccaggatgctgtgagtaattttaatatacatgcttctgccatattgctagtttgtcccatgctactggaacagtcagcagctggctgtttttccccaggagctgtgattattccccaagcctttcacagctagctttaccaagctgccaataagtgtgccccgggtgccctctttatcctcctgctggcctcagccccgtggatggaaaacactagaccggtttattattttaaaactagccacataactcaacggctgggcaaagagtttcctctcctgatcttatcagctaactcctgccatctacttggcccccactcaaagtagaggctatatattctaggtgtcccaagacctacttgactgcagcttcctcctcatttcaaggcctggtctgaatcctctcctctgtccctgcatcttttctcttccttctaggacccagaaatccgacctttttccttttgctcagaaattgagcttccaccttttttctcgacacaatcaagaactaattaaggaaactctctctacaccaggaaagcaaagacaatcctgaacaataaaagaacatctgaaggtattaccatccatgatttcaagctgtactacagagaaaatagtaataaaaacgcatgctatttttataggaatagccaggttgatcaatggactctaactgaagaccctgacataaacctatggacacttgatttttgacaaagaaggaaaaaccaaaccaaaaaaaaaatcatcttcaacaaatggggctggtctaactggatgtgtgcatgtagaataatgcaaatagttccatagctatcaccctgcacaaaactcaagtcaaagtgaattaaagacctcaatataaagccgaatacactaaaactaataaaacagaaattgtgtaataatcttaaactcattagtacatgaaaaaaaaatcctgaacagtatacaccaatggcttgggctataagattaacaactgataaatgggacctgatgaaactgaaaaacttgagtaaagcaaacgatgctgtcaataggaaaaaatagcagcctacagattggaaaaggatcattaccaaccctatacccaacagatgggtaagattctaaatgtataaataactcaagaagttagaagtcaacaatccaaataacccaattaaaaaatgggatacaaagctaaacagaattcacaacagaggatttttgaatgactaagaagcccttaaagaaatgttcatactccttatttatcagggaaacacaaattaaaatgaccctaaggtttcatctttccatctttctattaccacttctgaaaagatcccttggtattggatgtaagagttgtgttgttgatttatcagttggaatgtattccataactcataagtcatttaaatatctatcaaccttgcccaattttaagatgagagagaagtaattcctcacagttgaataacttgtaagtcaaatattattgaaatcagaaaactagtaaggaacacactttggcctgatctggactaacttttgctggaacaaggcattgatatagaaacctatcttctttcatatatgctaagcattctattcagtgggctcagaggtgacttctgatagcaaaccatctgtacagagaaaagaccatgcttagctccttcaaagggttctgggtttgaaattgatgagttccagggtttgagagaaattacttccttcaaggttacataagagaagtcagagatttcttactctccacacctagttaggtctcatgccagtattctcggggccagccttgtagtttcatttcatactgacaaggacagattctggaatctgatttcaagtgaatgcaggaataaaaaaatggctggtggtgaattttgatacagtggctgcttcctttcaaacatttaaagtaactgtctgccctcctttctgaatagaaatggcatttttgttgttataataaatggcagagatacaacagggaagatccacaaaataaaattatgataagaaagcaaaggaagaggatacagtagctcgaaatataagtgaatctgcattaagaaaacaaatcagtatgtatgatccataatttgcaatctaatggagttgacattctaagaaatgagaatcacaaagcttaaaagaaagtatttttatacttattgattttaaataaaatatagatgagggaatatgaaaactgcaggaattatctgaacatgtggctttttaacatatcatttcaaccagtcaggatgacattggacaactatagaatattatgactcacatgattgaaaaaaaaatgaggatacaatgggcttcatgtctatcatgtctatttatccagtaggtcattgacagaagattttttcattttctcccatccatatatttatgtttttgttcattgataaaaattactattaaccacaataatgtttggttattgaaaaagagagtgtcattccaacctttcaagagagattgggatgattttagtcacatataaaatcctgagctagctactctgctaaaccttttcctctgggactggctataaagtcccttttctctgaagatgttggtgtctaaagtgtcaaagatttaataatccaatacatgaagcattataaattactgcaatatattaaggaataagaaatacatagactataacatatttcagtttgtgctaagtatattacatggaatgatatatcattgtggttagtttagaaagaaaatcttactccatcatatccctatttactgagcttttattttttatggagacatggtgggaaggtgtgcaaacaattgacatacagagtattccaataactacttttaattatctcagttcaatgaataatgtggaactcaggatttaagttagtatttattctccttttgtttttggtaggttataattaccagcagcttggattactggtacgttaatcattttatgatgctccaagggaatgacagaattaattaatttagaatgagaagagcttatttggcttacatcttgaagattctagtgcaagtccagatgaatcaacttgtttggagttctactggttgttttagatgacagtagcagggaaaccagctcagaccatgcccaggaaacaaagagaagaagcaggttctaggaaccttgatttccctttgagaacatatctttagttctctaacctcacacaagcatccagctcataaagcttccgtggaactgtcagacctcctcttagtacatgacaaaaactctgactctttataaaagaagtagctgatatttattgagtgtaagtaacagcatggcagtaggcattgatccggccagtatccagcccagaaaatcttatcaagacaggtacacataactgctgcacacattttgcaagatcagtgagtgtgcaaacaactcctctgaggcacattactctataatctgaatttctaacgattactctgtgctggcatgttatatagcactgaaggttatgaaactggtgtgtcagcagagaccataaaatcagtttaatctcttttatcattatactcttttataggatgataggtctaaaatataggaagacattgagcctggttctaaagcaggatgaataattggattttaagaagattagtggaatacacaacaagaagaaaaaaaatatgtaacatgaaaatgtaggcagacagaggggataagaaagataaaatgtccataaaagaaagaaagaaaaaatcttgaagtaggacttgctattataccatcttcatactaataaacaaacaaatacgcaagacaagttcttcatgccagtagaatgagggagggtcattgccactgaatgttaaatcatcaggtagtatataaagtctttcctatcatactggataatttcgttttaatacctgtatgtttcgaggcaacacttagggtaaggaataatattagcaagtctaaatgaactctttggttaacagtcacaaaacagggaaatggaggagatgagttatacatgatatctatgattctttacaaagaactggaacctggatacatgtgcttaagactattcttatggccttatcttacaagctccacatttgctcatttagttcaccatcatttaataaatgatttattctagttgataaaatacctattaggaattatttcattacctctacaatgcgttttcctgagtttagacaggtcatttaacttctacatgccaaaatatattttctagtgaagtaactacaaatggatgactttatcgttaagttattaataatacttaaaaagaacatgtgacataaattttgcatcctaatttaaaaatgcagtaaagggagctaaatttatctttataaagttattatagtataactaaagcacttacattaacctgcataaaattataaaatagtatttagactttctcatatttctttaatctactcttattcatttttaataacatgagagagaagcctgatgggtaattgtttctttgaatttcaacaatgaatatgggtcatgtgcaaaaattaaacaaaataaaacactgcgaatcacagactaagcttgtggctctaggtgttacagcactgcaaactgatttttcagtggatcatattttcttatgggatttccaaatcacataattaaacatgatggtcacgtgataacagcttttgtggagctgaggcatgaagattgtgggtttcaggccacataatgaaatgctttatctgatatgaacaagtaaaattattcctgaatcatatcatagtttttctctggttgtcatgaagaatctgacaggttgaactagagaaagcttcaagttcagaatggtcctcacctcaggcattggttcccaggatctgtagtaatgagttcctttgcctgctcacttgacaacagtgaatgaaatacctggtcagaggattctggtaaaaatgatgtcctgatactccactatttacatcatcattttaagtttatatgcagtctacttacagagccaaaaaaatatatatttaaagtcatgtacgggatgttttacaaggcaggtggaaaacggcttgaaagttattcagagttgcatttcaaattttagttccatcttaaagcagaaaatatttggtatccatgtcaatacataaaggaacaaacataatgttggtgattttactgatggtagttttcttctgactcctacaaattcttacttacttcactctcactggtttctatgaatactttagtaagattttctcattttaaacctaagctaaaaaaaacacacaaggatttaataataatgactaacatttatgattacttgtgagctaaatatttttctaacacttagggaattagttacttgaacttatattaactttggaaagtgttataattcggggaggaagggtagctgaagaaactgagccacagagcttgttcacaacttgagggtcttcctttagattttacaaaagacttattgaagagtcaagatttgaaccctggcaatatcactccataattccagcctctacccctatatagttctcttcagaaagataataactgtaactcagagacatttattcttttatatgtttagtgagacatgatagtgacaattgtcaaaatattcattactggattttaacatgtgatatgagccccaaaccatatcttagggaagacatggagcctggtcagtgctcagggcagacaaaacatcttcattcttttacaactctgactttgcgttaactcacacgctcagtgatatgtctagcctttcagattaagactgtggtcatctgaaatgctacagtcttccaatttgaaagatctgagaaaggaaatgtattaataggaaaggagagtgatgtgaagtaatatacagcatggcttaaaggccatttggaaattagtacatctaaacacagttaaacagagaaggagaaaccaaggttgcaacatgctatgaagcaatggtcagaacaagagcacactttgtcagccttgtcatgctttccaaaggtgctctcataagacaaacaccaaggagctcagaatagactcttgactttgaaatgatttacaaaattctaataaggagttcatacactactcgttatttataatttctgtatattccatgaagttgccacagaaaccctgtcatcctacactgcacttcatttcagatttgacagtaggaatgtgggagagagggtatgttaaaaccagaaaaggggataacatttgaaatgtaaagaagatatctaattaaaaataaaaaaaaaaactattctcacggttgacttatgtaaaatggaaatattccatgtgcaatccccttttctctgactgttaccctccaaagaccaaccaatgtatttttgaaagtatccagggcctgttacccacatgtatattaaggaaaacagctagagagcatcatctgctcttccaattttccagccttcttaggtggtcctttcaaatttttgtggtggacaagtgatgctcctcagtgggtactgatccctgtgccagttcatgaggatgcacacactggtgttacagtcacagcaggctatcttaacctcatgttggacgtgggccacatcaatttatgaggtcacattgtccataaggacttgctgttatctatgcccaacaaaattctattctacttgagaccctggaccccatccataaaatttcattggatttcctgttggtttctagattgtcttctctggctgatctggaagatatattcgagcaagtttttaaagtccagaatgtatcttgttggtatgcaagatattttagtttaggcttaagctggttatgtctatcgctccttcctttgagatgtgttttgtgctgttgaatatgaataggctttggatggaccatctcagaacttaaacacacacaccagcatgagctgagcctggaagttttgtttcacaagcacatcatatgctattgattatgtgtactatgtgtacttaaatgaaaatacacatcaagtgtttggctagcatctgaatttttttctctcaattctcttggtgttgtaaaaacaacagacagaaatcaaaacaacataaaaatatctaggtatgcttacaaacacacacacacacatttcagtgtttgatccctttgagagtggtgtatcagctgagctcttaaaatgtagtttgtttttttttttttttaagtgaaagaaatgggggcagattttagggaactttacccataaggatttcaggttgtgtctcctattgttgctgacacacgtgggaaaagatcgggatttgtacaagtgtggcctctctcccagactctgaagtcctgcacaaagtcagttcggaaagagattctccgcagcagcaaactgcactgtctattcatatttctcttccacctgcccccacaatggcgcctgtttgtgcagcccacatgcaacaaggctgtgtttgtaagtaagggtccattcactggctgtctatttagaagccttgacagaaaaccccatgaaaagctcttccattcaaatttatctttaatgacttgctccattcagtatagatggtaggcagggggagggtcctggggcttggattctcccactatgtcagaaaagaaagcatttctataaagccctctgacgtgctgtggttattaaacaacaggttatagcaaaaaaaaaaaatgactaggaggagaaattatttcaggtgtaaaaattttttcccctttgcaggcaacactcctccacatcctgttcttttctctctctctctctctctctctctctctctctctctctctctctctctctctctatgacttaacattacttactttctttcaacaaaagtaatccccttcccttccaagagatctgactacccatccagtgtcacaggatttcccctcagacactgttaacctcctgaaagtctctttcattgtacacattagtgtcgtccaacatttcttttgtttcgtaatttattatttgtatgcgtggacattccatcatgtacatatgaatatagggcaatttgtggtctctgtgctcttctgagtttgtatggattctgggtagtggtctcagatcactaagtgtgtaaggcaagtactttgacctgcagggtcatctcaccacagtccctcaccgttttagagatgaactactataaatttaataagaaaatgtttaaatgaacccaagagtgggggtgttttcaaatgagaaatacccctcactatcattttaaataaaggttgttaaatttgtggtttataggtttttgtctgattgccttattaatgaatactctccacttggattttcacataatactgaatacccagtcagtgtttgtcaatattttcttgaatatcacacagtgatattccttgaatgctttaactcattgtctgacactcctaatagtcattgaatgtgagtccttatataagggttttcctaagagaagtagaatataaatgtaataaaacttggtaatgtctcccataccattgcattctactttcttccaatactacatctgctttggagagttataaatgataaagatgagactcagttatatctgctttgtttttccttgaaactagcagcaactatagaaaaaaatggaaatgcttctattcaattaaagacaaagtaacaaagaactctggtgatcttgataaaagaaaaatttatttttatctatgaaatcaaatgattctatactaatgaaatagctttgaggaaaaaccatgcagatttcttgcccaaggcacaaaactgaaagacgtgtcaaataattttagtcattaatataaataggattttaatgcaacattttggagactccatattaattccagaattcacacactgagcaagataatgattattcctttccttttccttttccttttcctttgcccagggcactattatgcctttgtatgaccttgattgctaatattaagaagaaaattatttaagaaaagatttttgtaagttgattaaggtgtgagtgagaatttgggacaaacaataatgtccagatttcaccaaccaatgagatgtgtagtgaaccatagtaacattgtccactgtgagaggaagacttagttccaactatagaataagatcatattgctagaaacctgtgttctttggttattgctaaatgtaattatatttctactagtaacaaactatatgaggttgtaaaaaatttaattcatatatttcaatacttggttacattttcaattattttgtgtagacctcatctggctctcaaattcattcttatgggcttttctttaattgtttttctataaatgttgttagctaagtgagcctttctgaacctcccctccatatcccataagttcctagatctacttcaaacctcatatccaggtcactcttctagcccagccttccatttttgtgccacccatcaccttttggcttcatccaggatgtcattgcctatccacaacaacaacaacaacctcctctcataccatatctagtgattctttccagctgtgtcactgactatttgtccaatggcccagcttggttgaatctgcctgttcttcttctacatataccctttccaaaccccatatataccttcaaactcaaagtttagaccaggattcacaagtttgccaaaagcttagccccatgagtccacctggctatcttcaatctaagccacatccaatattcagcccctatctgaccagaatacctgtcctctgtccaagccaactgtgtccagatcagacacagaacttaaataagaagttcacatgcataattctcatcacaaaaatataaacaatgtggaagatcaaaatcaaggcaagttttcatcaccacaaaaaaaaaaaaaaaatccccctgtatggtagaaatattcatcaattagacttacctaaatgaaccttagaacacatacaaaaaatacaaaaaacactaaaaaaacaaaattacaaaataaaataaaacatatacttggtctaataattcaaggttttgctaaactatgtgagcctatattagaacatattggtgtgtttactattgcagcactaataccatatgaagactgatagaaacagttgaatgaatataaatataatgaacttaaagagaataaaagtctaatgatgcccccctgaaatctttaaatatgagatggaagtgagaaacacaatccaggatttggaaaccatatttaataaacagagaaacattgaagataagacaggcttaaaaactaataatttaactaggaaaacaaacagaatgcctttcaagtagaattaatcacacagaagatagaatttcaggactcaaaaataaaacaagtaaatgcaccaaacaaccaaagtctataaaaaagtaaaaataaataaataaaataaaacagaaagaaatagaaagttattataaaagaatgtgggaaaccatgaaaatattcagtcttctaactatgaatgattatatcaacaacagccatctaatatttgaataagatgccaaaaatatactgttttaagtcatactcttcaacaaatggtgtgtcattagttgactatatacatgtttctatatctatatcaataactctatctctatatatccataacatatctatctataatctatctgtgtatctatgtatctaagaaatatatatatgtatatacatatattggatatggatatgaagatacatatagatagaaatatgtatatatacatatatgcatatatatcttcatatccatatgtatactcaacttcataattgatactctttaattaaattgtgttttttaatttgactgtgtcattctattctaaacacagctctggtctgtgtattgtgtgattaaggtttatttttcctatgctgctctaacaatgctaaatgttccaatctagtctcatatagttccacaaaaccaaatgtcaagctggagagatgtctcagaaattaacaggacttcttatgcagggattattaatgacatttctatcacaactacaaataaaacagtcaagtctgtgtgtgtcttcctgtaaccctggtattccatgatacaagagtgtcctaataactctctgtccagtaggtcttcctaaaatggttggtaagcatatgatacagtgacaggccttgtcttatggtaatcaggcagagagtgataaaaggaagaccattgactcttttctgtctttccaatgcttatcaaggggtataaacacccacatattaatgtatatgcaccacatacactcacatatacaggtgcacaactgcataaagatactaaaatatagtagtaatgaaatggccttgtaaaaactgtataaaggtggagagtaggaattgaaaaatcaaagtaagtacaatgtcaagacagcaataattggtggattggttgggggttattgtttattgtcctgacattgccaatttcctctaaatttcaaaactcctagcatatttatttcagggacacctagtgagtttattattaccatatgtattctaactttgtaaaatacagaggagtttttatctgttgattcacaaagctggttaaaacaaaattataacaaatctctttcacatgctaaagaaaagaaaaaactttatctttcaaaagtgatggattgcattctgtctcagagtttcctcaggtcatattgctattctcagccgggctacctaagtgtggatgcttcagtccttagaagggggaacaaaatacttacaggaggaaatatagagacaaagtgtggggcagagactgaaggaaaggccatgccgagactgacccacctggggatccttcccatatacagacaccaaacccagacactattgtggatgccaacaagagcttgctgacaggagcctgatacagctgtctcctgagaggctctgccagtgtctgacaaaaacagagacagattctcaaagccaatcgttggactgagcacaggatccccaatggaggagctagagaaaggactgaggagatgaaggggtttgcaactccataggaagaacaacaatctcaaaccactagaacccccagagttcccagggactaaacctccaaccaaagagtacacatggagcaaccatggccccagctgtatatgtagcagaggatggctttgtctggcatcaatgggagaagaagcccttggtcctgtgaaggcccgatgacccagtgtaggggaatgcgaggacagggaagcggtagtggatgagtgggtgagtgggaaagcatcttcacagaagcagggagaaaagttatgtgatagggggtttctagaggggaaaccgggaaagcggaataacatttgaatgtaaataaataaaatatccaattaaaataaataaataaaaaagaatgaattatcttttgcagttcctttaaggtgtaggtaccatttataaaaaggaatttgaaaagcaatttaagtgcaaaattcatttgcttccacctacatgatttttctcttacattttttgggttttccaagacacatcagtttgacaaaaaggggtttaatgactcactgttatcaagacttgtaacaagacttacaaaatcctacttggtgtttatggaaatggaattcttttacttttatacttattacattggcttatacaaatattaattaaaagtcaataggtttgagagagatataaccagccagccagaacttgatgtgcaccctatactatgtggagcagaggcatgggtactcactggaatatgcagtaaccatatattctcagcatgttaagtgcctagtgaatctaatggctctaggaaatagaggtcagtgaggaaaaatagttttagtgtgtcccgggtttctattaacatctaaaaacaattttaaaacttaaattattaaaatactttttatatctaccacattgatccataccagaatacaaaatgtccctctcttgcagtcaatttatgattcagaaattaaattttgctcaatacatacattatatcatttatatgaatgctaaagaagagaaaaatcaagagatgacttgccataaattcacagccatatgtaagagatagaatgacaggtggcccttgggataatggtttttaggagactctggaagttaacagtcacaaatgatggtttagggtattgcaggaggtatagagatgtcaagaggaaaggggagctcacttcttcacctgtcactgaagaattgtcaactaataagaaaagagcaccaaaaaggagtaaactcaaaagaagttcactgagactctgttacattcatatattaaacaggaaaatttcctgacagagttcagagaaaaagatagcatatctgaatttaaaaaaaaaaagttacttgtttattaccctatatgatggtttgtatatgtttgacctagggagtgacattattaggaggtatggtcttgttggagtaggtgtgtcactgtgggtgtgggctttaagaccctcatcctagctgcctggaatccagacttctcatagcagctttcagatgaagatgtagaactctcagctcttcctgaaccatgcctgcttggatgctgccatgctcccaccttgatgacaatgcacctaacctctgaacctgtaagctatcccaagttaaatgttctcctttagaagagttgccttagtcatgatgtatgttcacagcagtataagaccataagacaccttagaagaataacttaagtttcataaaggaaaaataatatgggttttatattttctaagtacttagtgggagaaatcagtcctatctgttagaaaaatctaaaaatgaccaagagccctaaataaaatgagtcagtattttagggatgattccaatgttaagccttaggcaagttgaatcattaagtttcatgcttcatgtttctgatgaaatactccagtaaaaatagtaccctgaaaatgctaacctgcaattacccaattagaactgcagtgttataaaatggttttgctaatgaatgttccagttctaaatgttgaattttaattcatcatgtcataactcccagtgccattcttttatgtgtgcttaacagttttattccctggctccattatttcatcaatataccttggtatcacctttctattcaggcactccaatgatcaggtcttgctcactgtgttctagaacaatgtttcattttcagagaaatctagtcaatgcataaaaaagcagtcaaagaaggtaacaacgtttttactgaaagataaaaaatgataacagatatcccacatcactaaaaatctctacgaggtcatgatatttggggcaatacaaattatttaagaattaaaaataattagtggcattctagagttacttttgcaaagttcataaacagtttaatcaaaattaaacagatgtaaacactttttagaaaataaaattctatacttttttgacattctgttcaatatatctttgataccctcttaactgtagtgctgtctttaactcatttcattactgttcagtggttctgatagaataagaacaataaatcagaagaaaaggaggaagaggaggaggaggctttgaaggaggaggtggaggaggaagaggaggagggggaggaggagggnnnnnnnnnnnnnnnnnnnnnnnnnnnnnnnnnnnnnnnnnnnnnnnnaagaagaagaagaagaagaagaagaagaagaagaagaagaagaagaagaagaagaagaagaagaagaagaagaagaacaacaacaacaacaacaacaacaacaacaacaacaacaacacgagcaagaacaagaacaggaacaagaacaggaacaagaagaacaagaacaagacgaacaagaacaagaagagtaagaacaaaaagaacaagaagtacaagaagaacaaaaagaataagaggaacaagagaagaacaagaagaaagagactgttggtttcattctcctttatttgagtatcttattattcaggttatatattcaaatagggattaaaaatatttgaattcatttgtagtgtggctaatactgattgccatgtaatacttattcctatttgtttcttatcaatataacaattttgtttaggtcaaaagtgatgattgtgagcaggttttcctttttttttttcttatccttctttttttaaaagacacttccttgctttgcctgtctaccatgcttacatgatagtttctgaccattttgatatgcaagtcccttgaaagcaacaacattgaggttataacaaaagctgtgtgaggagaatcatgctctttccctcttaactccgtaagtacttagaacttgaagactggagatctagcaccatgttattcaagatttgaggaggtgaggacgatgaaattcaacagagtaaaaatgaataggcagaagggcagatattccctccaagcctgaaggcagtactgaatcttgtgcatagttatccctgttgtcagacttgacccttaagaacaacatgaacatatttctggtaggcaatttccatttgttgcagctgaattcatttgcaactaaatcagaagcatgcatttctcacagagcagtaaacctgttttattccagatctatataattgaaatataaacaataattcatcaagaaagcaaatagcaaatggtgataaagatgttaaagaagaaatataccctcatgcattgttggagggaatgcaagttggttcaactgctatggggatctacacagagctttctccataactgaaaacttcactaatacgtgatgcgactattccactcatagttatacagctggacgattctgggagcagatcacagagatatgcgatgtcccaggtctactgctgcacatttgacaattgtcatcatgtgaggcaatcctacatatgaatcaagaaataaatgagtaaagaaattgtcacttagatatccagtgcaattttattaagatgttatgaagcctgaaatgtcatttgagagatcaatgcaactcaagagcattattttaactgaaatgagtcacatgcagagaataaaaattggcaaagttgcatatgttctttcatattttggatgtgtgtatatgtgtggtaaaagtagaaagtgaactttctggattgatgttgtttcatttagttgaggaatgtaaagataacaagagaggttaatggggtgaatatgaaaaacgacatgaagagtatgaactagggaagcagtgggggagtttgaggtagggtagctaggaggggttagagagggagacaggggtaaagatatgctattcctttttgaagataaattgctttaaaaatgctataatgaatacagttattttagtaaattatatacattccattaaaaaactaagctaatgaagagctatttatataagccttgattttctactcattcgccaatatctgacaagaaatatacttacaaatctttataccaactatcgattttaaagacctctatttctagctgtcctttaaaagattcatttgtggatttttttacattgatgacatcaaatatactcttactactcttattatcaagaaatatatactatagtcaaagagaatattttccattctttctgaagttgtgcagttagcattcacaataaatttaattaacatatttacacaaatattggaacaagagtaatgacataatttttcatttttatcattttttctaatttcaatctcttatataataatcattcaacagcaatttgattctcctttgttctaatcatatcatttaaataaacctttctctttcatgcttggcaaacatcaatatgctttaaagtcttctagaaaacagagttagaaggaagggatccaaaaaatttttgttagggcagccatcaccttgttagctaatcacctaagccagaaaaagacatcaaaagagaaggaagctaaatatatgataagtattgatgcaaaaattgtcaataaaaagttaccaaagtgatttcaaccacatatcaaaagaaatatttatcctaacaatgtgaaatttttcctggattgtgagtgtaattttctataagctagtgaatgtaatatatcacattaataaaataaattaaaacaacacattcttttcagctgatatggaaatggatcattatataaaactgctactactatattttgatagaaaagtatttttaaaaaaataattgattttgagtattccatatatggagtactctatttacaactttctacctctctctaccaactcttaggactgactacctgatttaaaaataaagaaaactttatgaatttaggaataggtaaagggccctcagtattgtaaaatctgtttatgaaaaaccaataattaatgtcatgatcaattaggaaaactgaactttttttttttttctaaaatgcagtagaggtagaggttagctatgcttgccacttcttttcagcatgtggaattttactaaactatggttgagtgacggaactcatcaattttttacctattgtactagaatgccaagcatcaaaatgtccctaatacatccttgtgattaagtaaattttctggaagttgacttttagattgagagtgtgtgtataatttgaggtagactttaaaatgtagaaactaagaataaaaggctaagggttttagtttctctaatctcttgaatgagtttccccaagagaaagttctcttgtttttatcttacttttttgataaaatattttaataaaatataaataaataagctaacaagtaagtaagtgatataatttgtcactggagttaacacatctatgtttgccaagttagatcacagaacaatttccaggactcagaaagaattacagctatatctgagggttttggaatgcccaatggttgcatggagcctgatttaagtttttgttatcccctatagaatatgggaaatttagatcatttataccttttcatgccctcttacctctattttgttttccataccaagttacaaaacacatggatccacaatcttttagtagcattagattttgaattaataattcatttgctttggaaaatccctaacaaaatactggataaggttttggaggtatagctatgccagctcagattcctttgagcatgtgtcacctctcatgtagcttctctgatgagggcttagagaaaagactgctcaagcctgacaggagatgtctgaacgaaacaagtcagccaagtccatcattataatcattttaattcagcagagaaaacaggtaaaatattacgtaagttggtgtaacgatggcacagtttggaagaggtgaagcagggtagggtatgataggatgtagtccatgaccgctcgtccctcacacaaagctcaagcttcagtcgtggtgatgggaatcccacagttaagactgtgctctaagcttccatggaaatttgttttattgtttgtagcccggggaatacgaacttgaaaattgctttgtatattcatctcaatttttgaaaatatacatgttacagaagtaaacattaagcagtaaccagctttctgaaagaaaaatatataaagtaaaacacctgtcaataactcagctataattatatcccagaatcgttatcagatcactcattgagtatgtattctacatcaacaaatacgaagaaacacttgtatgctgtttttcttttcacattaatacaatacattcagttgattggaaaactgaggcactaaaatcatataatatattttccattattattgatatttatacctatgtttgtactaataacaaacaataattttaaaatataaaattcctatatcttaatacttggttaaattttcaattattttatggagatgtataaaaatatcttacttgaaaatagatctttatctcatatactatatgcccaaaacagttttctcttccactactcttcccaactacccctcttcctctcccccagatccacccctctctcattccttgtcaaaagaaaaagatagtgttatttggttctctgtagtataacttcttgagctctttgtatatatttgaaattgtccctctatcggatttaggattggtaaagatatttttccaaactgtttgttgccttattgtcttattgacaatgtcctttgcttgaactcaagaagttagactccagagaagcaaataaccctatcaaaaaatgaggtacaatatgcaaaatacataaaactcaagaagaaggaaaaccaaagtgtggatacttcgttccttcttagaatggggaacaaaatacccatagaaggagttacagagacaaagttcatagcagaacctgaaggaacgaccatccagagactgccccacttggggatccaccccataaacaaccaccaaacccagatactaggcagatgccaacaagagcctgctgacaggagcctgatatagctgtctcctgcgaggctctaccagtgcctggaaaatacagaagtggatgctcacagtcatccattgaactgagcacaaggtccccaatgacggagccagagaaatacccagggagctgaatgggactgaagccccatagaaggaacatcaatatgaactaagcagtactctcagaattccctgggactaaccaccagccaaagaaaacacatggtggaactcatggccctagctatatatgtagcagaggatggcctagtcagtcatcagttggaggagaggcccttggtcctgtgaaggatctatgccccagtataggggaatgccaagaccagcaagcaggggtgggtgggttggggagcaggcgaaggggaaggggatgagaatattcagaggggaaactaggaaagaggctacatttgaaatgtaaataaagaaaatatctaataaaaaatgggctccagagctaaacaaattctcaactgaggaataccggatggttgaaaagcactttaaaaaaaaaaaaaaaagttgaacatccttagtcatcagggaaatgcaaatcaaagcaaccctgaaattccacctcacaccagtcagaatgactaagatgaaaaactcatgtgacaacagaggctgaccaggatgtggagaaagaggaacactactgcattgctggtgggaatggaaactgatacaactaccctggaaataagtttggtggttcctcagaaaattggagatagtactaccagagaatgcaacaataactctcctgggcatatatccagaagatgctccaacacataataaggacacatgctccactatgctcatagcagccttatttacaatagccagaagctggaaagaacccagatgtccctcaacagaggaatggatacagaaaatgtggtacatttacacaatggagtagtactcagctattaaaaacaatgaattcatgaaattcttaggcaaattgatggatctggaagatcattcttattgaggtaacccaataacataagaacacatatgatatgcactcactgataagtggatattagcccagaagctgagaatacccacgatgcaattcacaaaacacctgaaactcaagaaggaagaccaaagtgtggatacttcgattctccttagacaggagaacaaaatatacgtggaaggagttacagagatcaattgtgaagcagagactgaaggaatgaccatccagcgactggcctacctggggattcatcccataaacaatcaccaaacccagacactattgtggatgccaataagtgcttgctgacaggatccttataaagctatctcctgagaggctctgccagtgtctaacaaatatagaagtggatgctcacagccatccattggactgagcacagggtccctaatgaaggagctagagaaagtacccaaggacctgagagctgaattgtttctcaacctcataggaggaacaacaatatgaactaaccagtactttcagagctccctgggactaaccaccagccaaagaaaatacatggtgaaactcatgcctttagctgcatatgtagcagaggatggcctagtcggtcatcaatggagggagaggccctgggtcttgtgaagaatctatgccccactataggggaatgccaagaccaggaagcaggaatgggtgggttggtgtgcagggggaaggaggggacatgggtttttcagaggggaaaccagtaaaggggataacatttgaaatgtaaataaagaaaatatctaaagtaacaaaacaaacaaacaaacaaacaaacaaacaaacaaaccaggcctctaagagatgataggcaaagaggacaaatcaagatataataaaataaattaaaaatcttccttggctgttgtttagttttcttgatgaataacagagtgacattacaggcagctcaacactaaacactggtgactcatgcctacaaccatgtttgtgttatgaaaaatcaggtggtatatgaagtatgtatttttttagtcactaatattatggagaatacttagtgtcgtaacaatcatagccgaattcagacctcagcttatttaggttatcctctaagtcattactacatttatgatttaaaaatgtttaacttcatggcctgtgcattatgactcaagtatccttattcttgttaaccattttcttgagatacttatgaaattacagaatcataaaaagccatggatctatctgcattccaagaacaattttattgaaaagtaaatacaatttacacacactctagccataagaaagagagttacatgatttagctattttgcccgctgaagatttatgtgcaatttaccttctttcaaaaaagttgttatgatataagtaatgtggattttcattttagggtaaacatttctccacatcagttatttactcatattcctgaataagctttgctcttctaaggttagttcattttgtaaagagatgttcataactgaggggttaaaagtctctaatgtaaaagcactccacaatgagcaagccagaacccttgttctcaagtcatctggtgtgtgaatgccctttctctccctttctcacattctgttacctggattcttgaaatagagtccctggtcttttacctagagtgagatttttggtttttgaagtataatcaggacaaaagcctgataaatattggtgtgggtgttacaatttccttttagaaataaatggatttattgctgaacaagcttctggagctaagaaccacactaggctgcctatataggacagcctggattttaatttttaaattggctgtgattatttttagtgttggagtatctgtttctttcctattttttgaagaaatcaagaaacaatactgaagctagtaacatctattgattcttttgtcaggctaaaatgaagtgtttataaaatgtctacctttgtatctatatatgtttttattatttatatagcattaattaagcttaaaaattacaaaataatgagtgctctttgcaaaaatgtctgtggtattaattttggggtggctaattgtgtaagatctctacttactttttcttatcagaattttgcaagtcaatactagctgttttatctactttttaaaacttcatctaaataaaattttataagagcagtgatatatcactgatcggatttttatttcctcacataccacagaggcttttttccattaaaataacaaacatatagaactaaataaaaacattgaaattgctattataaacataagtggtagagtagtcgcctactatgtgcaaggctctaggattgatatccagccccacgaaaacaaaacacaattgagaaacaatcaaaatatagatgagaataataaaaacatatgcactggttatagttttatcatatttattttataacaataactaaatcttgttatatgttatatttgctatgaaatttatttattcaatttctaaatgtcttaaatatttctttatgaatttgtatgtgctgtttgcttgctttaaatatatcccagaatttatttgccacatcctctattggtgaatattcatgttgtttttcttatttcaataatgcttgcacataaagtttcattcatcgtttactgattataatgctctctgagagccctttatacttgatgatttaaaatttgtaaacatttgactaagtttgttttgttttgttttgttttttaactcacagcaatgttttaaaatgattctactacaaaatacttgacaaaagtgtgtgttcctgaagagataatttttaacttccttgaagcccaaaagagcagttgagatggtaaccatggataaataagaatgtattcctgtaccatcttcaggttctttggttacaaattgtgcactgtcatcattctagttaacttatttgtgaaaaccttttgattcatctcttatgaacatgtaatctgttaaaatacatattttaagtaggtatataaaacagcattattctgcatttcttgcattttcttttgttattagtttatttaatctcaaggcagaatggtgtatctattaataacaacctccaaatctcaaactcttaagacacaggttttggcgttcatttatgcttttgttcttcattggtttcctatagctgctgtctccattgactctgtgatttgttctacagaagcagcctttacatttaaaaatatgatttggtaacagagagaaagaagacccagtgcgaccatatctgaccttccacattgactgatcacagagttcttcctctgatcccattagtaaatttaaattgattcctctcctggtaagctatgtggtcaaccctgttagccacacagcaggaaattcaagtctatccctaagagcaacaacaaaaactttaggcctggattaaatctattttattctgctgctaagaggcttctccgagttggtagcatcttcattgagatctgtattagtcagggtttctattcctgcacaaaatatcatgaccaagaagcatgttggggaggaaagggtttattcagcttacacttccacagtgttgttcattacacaggacaggaaatgatgccaagtccatggagctgtgctgctaactggattgcttcccctggcttgctcagcttgctttcatacagaacctatgactatcagcccagatatgacaccacccacagtgggccctcccacccgtgatcactaattgagaaaatgccttacagctggatctggatctaaggaggcatttcctcatggaggcttctttctctgtgataactcagcttgggtcaagttgacacacaaaacctgccagtgcaggatcctatgttatattgcaatgttagtgcatgtctacctacactcccatgacattcctgtagagacaatgatccaaatgagcagatctctggaagaaaatctttacaaattcactattaagagctcatcaagccttgccttgcccacacgatcttactaattagaatccttctcctttattgctttttcatggctgttacacaaatcattacaaggcaagggtggtttgagagacaattttgtcagtctaagggctgaaatatcaatttctaaccatgtttagaaatatatttcagtttagaaaagaatagcgagaaatgtttctgttctctgtaatttgacataatttttatgtgttgactaaatataattttttctacaaaacatatccttataaatgtattttttaatttttatttttaatatgccattttcattatatttatgtggttttgtctgtatatgcgaatgtgtacttcagagagtataaaagagcagaagtacccatatcaatatcaggacttgattctctcttcccacaatgttgtttccagcatctggacaaggttgtgatttttggcaagaggttccattacccgtggagtgatcttgacgttattatttattttcttcttatcaacagcaactcagtgcaaaatatttctcaatctgagggtgaatctaattggaagagcagccgaataacatttgaattgagtctgaagctcaacacttcaaaaacaaacaacaataaatgactaaaactgttttccttttgaggatgcaagaaccacggatgtcgtaatttaaatttctcttgtaatggagagaagctatatagcttccagaggagagaaacatgcagagtttgctgtatctcaagaggaaaacttgcaagtggcatgtcatagaaatctgaggtcatctgtacctatgtgtgattgctaagttgtaagctcaatttattacattgtgcatcccaaaaacatagtttttcacttacattctctgtgctcagtcatatttcatattccatttcattttcttaggtggtgcattaaatctcttgacccgtgcatatgttgaatggtggaacacactagcgtttatgtttcattcttttcttttgcacatgttcacggtttgaaaaaagcaaaattatttgaaatttagttctacttctatcaatgttgctgtgagaatttactctatttcctatattaaagcattaaaatgttaattttctagaaatttctattctacttgtcatttaaaatggcaggatgatttgttacaggatagaactggtccatattttgcttagacatcaaggaatactgagtccataagctttagtgtaggctctcctggcatttaattcatagatcaaagattctttcctttttaaagttttatttgcaggacttttcacacaataagtgacttgcgtctgaggaacaggaaaaataaagggtgggcatatctcaagtaaagtagattcattcagagattacatataataaatttcaatgaaggtagacattttaaatgtcccattagtcccatggagcagactactatagacaatcaaattacatcaagtttctgtttttacagctttggaatgtatcttgaatgttttacaactctctagccctgaaagaccactgaagctgtcacacacatatgtttgtccacatgtaaaaataaatgcaatggccgagcggtggtggcacactcctttaatctcagcactcgggaggcagaggcaggcggatttctgagttcaaggccagcctggtctacagagtgagttccaggacatccagggctatacagagaaaccctgtcttgaaaaacaaacaaacaaacaaacaaacaaaaactaaaaaacaacaacaaaaataaatgcaatgatcttaagtgttcttcagtaaaaactagtgaacatttcatatacctaggtttagtgcactagtagaacatacttttgtatgttgtctagtcacaagtatctttctgaatatttctcaatctatttcttattcctctttaccttgaagtttcttcatattgcataaacattctggccaattttttctctacatctgtttctgaaatatatctatccatctctctatctctctatctctccatatatctctctatatctatttctctatctatctatctatctatctatctatctatctatctatctatctatctatctatctatctacacgcacacaggtccaggctagtgagatggttcatcaggtaagggtatttgctgtgtaaaccaaggaccatgacttctgttcctgaagaacaagaacggaacaatgtcaaccgtacagacttcttctctgacttcctctgacactgatccacacacatgccacacttcacacacacacacacacacacacacacacacacatacacacaaagggagtacatgcctatgtggatctgcatgtgaatagtcatgcatgtgcctgtggaggacaaaggtcaacctcagatgttgttcctcaagtgaagtttatcttgtcttctaaaacagtgatttttagtggtctatagctcacccactaatctgtcctgcaccaaggaccaagactgttcctcctcctcccagctccagggttcatgagtgcatgaaactgctcatagccttcttaaacaggatctgagaatacagctctagtcctcatcattgtttggcagactccagcaatggtctcttcctgatcatttctatatcttaaattcattttattttatttttactcattcacattatgtccagttcactgtctcacatccagtcacaagtcactccccctcccacaatccttccctcattccccttccccctttcctctcattgggtggagaccccctctgggtatccccccaccctcacacttcatgtctctgcaaggctaagcaacagcttttgggatagcctccctcctccccgcctctgcctgcacccctcctccagttccatttgttccagactctcatgaagaccaagctgtgcatctctgctcattctattctttgaaagaaaagtgtcttcagtactttgttgaggtttctgaagcatgttctatggtctcttctttatttaggcactggattttgaattaatctatagagtatgtatggcaggtgcatacaacatggctccacttatgcgaattagtctgctctgtgcaaaagtaactactgtacattttttaattcatcctcatgaaacttgatgaaatactcaaaatagctttgctcatgagatttgcttatgagatttaaatctatgaatatatgaatataaaattgcttgctcatagtttattgttttatttttcaacatgtctaatattgaatggccaattttactcactcctgtgtttttgactgactacatttcaacctattgtccataatttcctcctgaacccactgaattttgtcttgctatcaggcagccggcctgctacacacaaggcactttcactagatgcctcaaacagcagacatgtttccccaagttctagaaggtgaagtttcaatatcaaaattctgtcagcattgatttctggacatggttctgttccaaacatcttgatagccatttttggctgtgagatgtgtgcacatgtgactgtttctgagtttttattttaactctatagttacagagacatcagctgtattagactaagacaccactcaattacctccctcacttacttccctaatgcctctattgccaaacacagtcacatttgatcatgtatgtcagcatggggaattgactatatataattcatgtaacagaaacagtcttcgcatgtaacaatagaaggttcagcattgatgagagatggtattaattaatcttgcttattttaaaagtagaaaatagcagtcaataatttaagaatttgtatttttacttgtagcaattatatgattaatgatgtgtcagaatattcagcgaagtgacctgatatcagtttacaaaatccagacttgctgtgtaaatctagcaactttagttcaatgcctggaacccaaattaaaaaagatctaggtatggtggatacacatctataattctttcctttcacaacacaaaaataagaagacaggagaataacccagcaccttgctttccagccagactgtagtatttagtaccacaaaaacaagagtccttgcttcaatgaggaaccaaaagaaaacagactcctaaaatgtgtcctttgagtttcatgcacatgccttggaatgtctatccatcatccccacaaataatatacccccattaaaatatacatgtgtattcaattcaactcaaaatagcagacaagtgtttaaaagaaatgaaggaataaaaccatgatataatcagctaccttacaaatgattagagtagaactaaaaatctatttgcatactttatctatcagtacttgctgtcaaaaatagtcttcagatagttggtgaaatctaaaattctacttacatattaatgatgctagatgaaattgttttctgaaaagaaaactcctaaagatatctgtgtggtttttctaccattatggtgcagagtggggcttttcctctcctttttttcctgtcctggtttctggttggatttaatgattctgtcatttctagaatatgatacactggatgaccacgtgattttcctcattgtcctctatatgtgataagcaaatgatgatcaaattatataatgagatttcacaagatccataggcttcagtacagttatcagagctgatgatgcttatattaatgaaaactcttagaaggttttattctctgccattaatttaattctcattttgtagttgctattgtttatggaaccacagaaaattccttacaacatcaatcaaggatatccccaggctgtcaaaccttcattcatccttagcttcatttcatttccacttgtagacattggatagggtgtgcagccagcctgttaatttctaatttttcagtgttagggatctggatctgttcctaatttctaagacatgtgattattgtaggtcttttacactcttttctaatagtggagaagaataaatgaaaataaaaaaacaaaaactacaacaaaatgaaattaaagtatgtttgctgaaatgagagtcaatgggatttaaaatgaaattatgacatccctttaattacatgatttattttctaaactcacactgtatggtacataatatcatccagttgttccatcaatatctcctttttggttttgcagaccttatgtgttattgtatgaactcacattttttagtactaaaataggacatttcaattctggtaacaattatgatcgggctgggtgtggagaagtagttgaaaaaaatcagcatttgagaagcagaaagaagtggagcagaagttcaaggcaattcttgactatataataaggttgaggtcattctggggtccctgatgtcctcaatcaaaaactatacagaacataaacaaaatggtgatcacactccattgcaaagtgggctattgattcttctttgtttcaagaatataatttttctaaaagtaggaaactcattctaagaacaggaaaaagcaggtaagagaaggaatgtatgaccgtagtcacatttggacaattcatttgttcctgagcctgcaccttttgctcttaaaatgaggctgaccatgagattaaggcacagcagaggatcatttgaatgctagattcatttaagtgtaacaactaataaatatgtatgagaaggtttcaataaaattggacaaacataatatacaaatcctgtgtacatctctacagtttcctgctatgaacacattagtccataaatctggattatgctattatttatcttatcagaaatgtgttacaaacaggatcccttaaatatgctctgtacagaactgttatagtgatgtgaggaatagtcttcttgctttcttatggctctttgtcttcttttaagggcagacagttagaaataaactactatagatctcctccttagatgctataaatccacaccttcatttaattctgattcatagactaagaaaaacacatttattcattcaggaaattaatcagtggaagatgactgagtgggtagaaaaatgaattatagggtagttgaatgtggcccacttgctagattatgggttggataattagttgcatcaaacaacctcattgtttccccctgagttcccttggatttcttcagcgtaagctttatcagtatttgtgttaaaggatgtcaccataccaaacatacaaaacccaatagcttattggaattcaaatcacctgcctcccagggactcactgtaacagtcatccatgtccaactgtccattactttgcctttcaatgctattctctagtagagtagaatgtagagactgaactgtgtgagttcattaaaaagagagagagagagagagagacagctccaaagtccttgatgattataataaattatgaacagagtttggttttcaatttacacatgctcacattcctgtccttgagaatctagtcacacatcaagaattgaactgaaattcccctattttgttgagtgaataattataacaatgaggaaacttttaacacagactgaaaatgttcctgtttgtggagattgcagaagaaggcagcagaggctatgctataacagaggctggggaatgaatctttcaatgtggctaatgaagtgtgtcgttgtgaaagtgggtgatgattagcaatgtgtgtaacaggaagctgttcaatgagtttgtcttctcacaagtcccagtgaccacagcacaggggaaaactgaagaaaggtgtcactcacatgctttgttaggacacacgattattacaaggagctgacaactgtttgggagtgcagcatgtaggaaccctttggagggcagaatgtccatgacttctctacaaagccatgaagaactacaagggaccttcactgaactgtatccaaagcaactttcttttactatgtacgatgatttttatcattgttctgataatttgtacacatatcttaaatatggaaaaaaacagagaagaaaaagccttcccattaacgacagtcatttttaatgttttggcaaactctctgccagcttttatgtgtgattttattattaacagttgtaaacatccaatatgtacactattaacagtgttctcacttacatttgagcaatttttaacactagcacaactgcaaaaattactgccaactttcttggtggttacaatgttgcctttaatgtcctgagcccgctataaaggatgatacgatattgcagcaaacagaagggtagatggtatacctaactattttacaacagaaaaattaaaatacagagaaatacagagatgtggaattatttttctgacaatacacgatagtaaatgctagacacaacatttgtagccaacctatttctagactgtgtgcttgcataacttgtcattagactaaagtaataaaatattttatagaagacttgatagtaggtatgtggggatgaggtgtgttagaatgtgtatgtgtcttatttgttatatcatcagtattctcaattctacgagttagctcattggttaacagaagttgtaggtaaaatagtgagcatttgtgttccaatcaaactttattcctgaaaattaaaatttgtattcaatataaatttatatgccatgaaatggtattgttttcatgctatgtaacctatttagaaatggaaaggaaatagctgtaaaggaggttgaactaaactatggaattccattattaaactcatgaatgcattatttataacccagaacattccccaatggtgaattactgtctcatgtacatgatgaaaaatgatacaataatcaggatttgtaaactgaatttctattatttttttcaaaactatttcttgttatatcttgagtttgatctaaccagagggaatgaatacttttcttatgcttacattttcctggaaaacaactatatgctagaaaaacataatatatattttcaagtttgaagtgatcaaataccgaaaatcatgtaaatgaaataatagaaaagtaaaccatggtaattctttaaaatataaaagggtcatggttaagttgacctaagctatcctgtctagtctgtgctgattttaatataatatgtaagaaaaattaaggaaattttctacagtatctacttgtcttctcagagtgtcctgtctgcctatgttcaaaacaatgaagagtgaaaggaattcagtaaatttcatggtgttttcaaatctgggtaaatgtcaagtgttttttatttttgttgtttttgtggttctagtttgagatatccaacaagccagttgtatggatagatatttatttccttaagtgttagtgatgttaacgattctctttctgtttaatgatgcatatgtatgcttgagtggcttgtataagtgtgtcagggagaaggctagaaagggccagatgccctggaggtatagttagaggctgttgtgtggaacctggtactggtggtggggcctgaacccgagtcattctctttctaaccctggatgtttctctggaaacccaggtaaaatgaagatgcagttgaacccctccagcttggagagtaatgggccaagctgcctgcttgttaggctcctctgggaccgaggttcagactttgaggtctgtagcaccattgctttccagattattttttaaatttaattttatttttacactccatactccattccctgcccctccacgtccaccctctgactgatccatatctcacacctcctccccatcccacccaccctgtctccacatggatgccctcaccccccaccccacctgacctgtaaactccctggggcctccagtctttgagggttagctgcatcatctctgaatgaacacagatccagaagtcctctactgtatgtgtgttgtggggcttcctatcagctggtgtatgctgtctgtttggtggtttagtgttttaaagatatcaggggtccagattaattaagactgctggtcttcctaaggaatcgcccttctcctcagcttcttcagccttccctaattcaccaacacgattcagctgcttttgtccattggttgggtggaaataactgcatctgactctttcatctgcttgttgggtctttcagagggcagtcatgattgatccctttttgtgagtgctccatagcttcagtaatagtgttaggccttggggcttccccttgagctggatcccactttgggcctgtttctggaccatcttttcctcaggttcctctccatttccatccctgtaattctttcacttgatgtcccgcttcctactggaggtgggctctatacgttccctctccctactgttgggcatttcatcagaggtccctccctgtgagtcctgggagtctctcatctcccaggtctctggtgcattctgggtgggtccccctgcctcaacctcctatttcccgaggttgcctgtttccattatttctgctggccctcagggcttcagtcatttttccttacctaataccagatcaggttcccctctaccacctactcctcccatcctccccaccccatccactttccctcccaagtcccaccattcctccccacttgtgattgctttcttctctctcccatgtgggactgaggcaccctcacttgggcactgtttcccagattcttaatatatatgtgctctgaatgaattctcttagattcttaagtacagctactaaaatatagagatgttaatgtcacataacctgtgcaaactggattgtaacactatggccttcagctcaaagatatactatgccatagtaaatgctgcctttgcctctactcaggtttctgagtaatcagactcattggctaggttgatccagactctgcctgtttgctttcaaaactaggattaaagaaacattaacaatgagaaaagagaattgcaatcataacttaattgaaggaggtgtagtaagctaaaaagggatttttttactactcctgatttctcagcaataaattgaattaatgaaatctggatgaatggcctttttctaaacataggtctgcaaatggaaaactcaattcagttgaccatcaaaaaataaatggatttctgtgtgtcaaagtatatttaaaacctctctccagtgggtagactccctattttgtagaacttgtttggcagccatttcaacctgtgtctttgccggatgcttccttctcctgggtgcatatataacttgaaccccatacattcttgtatgaagtcccctatctttctatccacacacccaccaggctttagaaagttttctgagatgaaattagctcatgaattccttctttgtcctataatgtataaggcggtatctgctctttttagtagctgaaccatactgattgaataatatccttgtatgttcagccctgagtatgacaaaattgacctaaagatttttggattgatttaatttgacttttcaagtaattgcctccagatcttcccagtttcagctgcttttccattggtgtgataaaataacacagcagactcagcttaagaaagaggcagtttactttggcttatggctctagaggcttagaatccatgaagctggagaagccacagcagcactcagaaaggcatggtggcaggagcaggaggcaggctgtccacactgaatccacactctacaagctgagcgagaaaagaaagtacgggcatgtatgaaatcatacactataacctgaatgatgcacttcctccaatgagtctctatttcctaaaggctctaaatccttcctaaacactaccaccagctgggcatcaggaggtgaaatgtgagtcaatggggaacattatcaaagttgtatttacagtgaattaactcagaaactttaaatactagacatatatattggaaacttcaggttgcctgctcagttgactctgcctgtgcagggatttgaggtccaccagcttaagtgttagtcagaaaacctgctcacggattcagctgtgaaattgttctctgacataatcataccattcttttttttttttcattaagtaacaagccaagtgtatcgttttgaaactcatctctagccctatttgatgttctgcccatttctaacggaagactgagcaccgtgcagtctatttccagagctgccatgaatatttatacgttgcctgcatctttacaaattagagagcagtaagatgaatgagcgtagtgaatcagagaagacacacagtgtgatgcgggtagaaatttactatctcatttctatttaaaacctgatgactcagagaaggaggcagtccacatccatttcagtaaatcccttaatgcttcctagcatgccattttggattttagcactactgggggttacttaatttattctcaggatgagtatttgtctgcatatgtgtctgtctgtatgtaaatgtgtatgagaaaatatgtatttaattgagattattttggagtgaaatggaaagaaataaatttaccaggctaattgttcattattttctgcaagtctcattttgtatgttgtctcggtgatgggattgtacctacgacctccaataaataattcttaagtctgacaaaaatgctatttgtttctaaattgatttttaatgtcttcagtttgcattttctccacttagttagctttccaataattatgcattagatttccctgcctttctatctttcccatgctcaagatcaaaatcttttttataggagacaagtgtcaagatttattattgcaatatcacaacttgacacctctgtactgcaagggcatggtgaggacaacactatgcataattttatcttagtctttgattatctggcaaaaatggaacaatttaaaaactgcattgtataacacagagtaagaaacaaaaatctcataattttcttcaaggcagctatctaacgcacattggtgagtgtaaaatgttcagagtggttgagcatggcctgaaatagaaaatcacatctgatactattaatttaggagttttgcttagagacataggcacaaatgatgaacacagagtcacaaattagccttgtgctgactaagtcattatttacacagcaatgatagagaaatattgtacttctttcatggttgttgactgtttaatcagttctatatatgtgctccctctatgctgcaacagctacaggctcctctgatagatgcccatatcaaacaccattacctcacatgtatgatgaaagtagaatgccatatgagaattttgaacacttacattccttcaacacttgtcatttcatttctcatgtttccttccgggaaagagtgagtccatactcaacatgaaagtcttgattttctggagcttactgtctatttcgtaataaggaaatagaaatacaatgtaaaatattgcttaaaagccatgctaagtgctgttttacctacgtgtcagcaattataacaacagaaacacagaaaggagcctgaaccttagagatctaggggtgatggtaccaattttgtaagggctgtgtgtttaagtttaaatttaaaaaaatgaaagtctatttggataagagtggaaaaaagggtggaaagtgaaattattgtggatgacattttgcacatcaaggagctcttttcctatggggatattgcattcattttatgttggtaattaaagatatttattccagttttgatgtccaagcagccatctggacatcaaagcactgagccaagttgccctatggctggaaggaaaatgacacaggtccagttctgtggaagcagaagctgaagttaaaattatagttcaaggaatttattaaggaaatagtctcaggacccatgtcagctgctcgtagaggaaataagattacacacagtggacctgacacttagcagagcattctgcatgggtgttagaaggagagtagagactctggggagtatctggagatcatgaggtgctcggtgtttacccatctgtaagcatctctataggtcaaagcctgtagttatggaaagactcactctccatgctaatcttgctgatttgcttttggaaccatggtgaatttgaggattaataaggtctgtctcttagtcttcactgtaatgtctgctagagttaactttgttcaccatctgtattgtgtaagggatgttgtctttcttcatctatttggacataatatttgcctttgtaccattatttcccattcttttagctccccactttgaaaatagcatttattataagttgcaatgactcctgctgataaatctacatacacatcttcataaaacttattatatccattcctaataagggacaatcacacttaatagcttagtgtaaagatatatagatttccccctatttatttatttatagacaaacatgcttttctgctaatattttataatagtttattttcacactatggcaaacatcttcatgaagcaattgcttgaaatattatccattctgattttacaacagtgattattatcagcgtgcaatgacaaatctgacagcgtaatttccatcttttattggaacaaatagcatggcctcagcatcattgggctgtccttacacaagattttatggatcattttgggatacatttttaatggtggaattctagggtcatcctgtctaccacaatggtgtttccactccaggtccccatcactagaccctggagatgactctgctggccttaatgtatgagttcagttcctttaaacatggacgttttaaatgatcgttatctcatgacactccatcattgaaaaacaccccttagatttcagcatgtcttccaatgtctttcaggtgctaagcttggctgctgctgcagtacccaacttctggtctcctcacttgttcctatcttgtctttagccacttcaccttttccttgcagggcaagtatgtcactatgtcaaaatgtattcttcccatgactgcatctatctttcttctgggtactctagccctgcactgctgatttcacgtttctccttaaatgtattttgctatttttatcatacatttgtttactgtacttttccttccaaaatgtttgatttatatgtataagctaaaatacgttttgcgtatttagtatacatactttgattaacatcatgtgttcccatgtctgtggtttcatctccacaaagtatatacacatctatcagctctgaaattatccttgcctcctgttgtattcaatatgcataatactggtttttgtgtatatatgcatgatgtgtaagtgtgcatgccataacatgcctgtagaggtaagaggacagcttttggaaattcattttcttcttccacccttacatgggttctgggagtcaaattgaggtcatgacgatcatgcagcaagtgtttaatccgtgaggccatctcactggctcttattcagcattcttttacagtaagaatacttaacatgaaaaaaaaatcctttgaatgtactttaaagtagatacttcatgctattatcctaaggattgctatgtagtagatatctagagcttattaatcctgtataaccaaaactttttatgcactatacaatattcctatttttatccatttcacacataaatggaatatattttgagccttttattctttgactcttgtagatgttttatacaactggaatcatgcattattgatcatttgtatgtggtattttttaccagcacagtggtttccacagtcatatatattgttactaattgttatttgtttcttttctttgaggctggatgagatcacattttatgtgaagaacacatttccctttattacttatctgggtcatttctatagttgaccactgtgcgtagcattttaggggacaggggagaccaggccatttgaaggttatattctcagaattgttattgatgaatcatatactgtttacatatttaatgtcaaaagccatatataacatatatgtgaatgtatataacatatacacaacagcagcttcaccattctgtttattcctccagtgacagaggaggttccagattctctacatttgtgccagcatttgccactttcctatttattagtattatcagctaccatacaccatacagaaatcagctttgttgttagaaatgtgtgtacttattatatattcatgtcatgaaaatatgagttctagcattagataatacatagaaggttatttgtaaatatttgttgaatacgtgtgtgcattacatacatgtgagtgtatgtatgtgtgtttgaatatgcatatgtgcatgtgtgtgtatgtgtgtgtgtgtgcttgtttgtatgtgtatatctgtgtgtttagatagaatggtttaaaaggcttccaaactccaagatacccttgggaagtgagcacttcacttctccttctggctttttggtgatgactcaggtaacatatatccctaaagctgtgaattatactgtaacagtaaaaactttcagctgggatggcaggagagtcaagtaaggatatttttattgaaataatagaacattggaaataatccatttttcttaaaataatgaatcatttgaattttaacctttaattatacaccattctatacatcccgtaacatgttcatatctctttgtatatctgtttatgtctctcactctgtttctctctatctctttgcctctgtttatctctgttctctctctctgtctctgtctctgtctctctgtctgtctctctctctctctatctgtgtgtgtgtgtgtgtgtgtgtagataacatcattttaaaaggctttacaagtgacttgcaatccagtattctagaagataatagctttctaactacaggttccaggggtaatgaaatgtcttattccatttctcacacatgtgtttttcttcattgttcaaaatttttattactgaggtacctgaaaaattccctgcaagcttcaaggagatcagaattctgcttaggaaatgctaactgtagccctggttgattttgcacagcagccagaggaggtctacatcacttcttagccacccacaatactaattaaatttacccatgtgaaaagggaacacccaccctggttattttgagccagtttgttgaaacactggttgaatccttctgtatctttgtatttccccatctcaaaactataggaacccacagaacttaccacaggagcaaagagaaccaattttccttttggaaacacgacaggatttataaagacagggagaaagttttaatccccagccagccttctatgagagtcctgatgttacctgctagcattttttcctttatggttttcctctgtagagtgaaagaacttgttccctggagtcaagtagatctagattaagataaagccctgcatttcccctggtatgattctaaaaccatcatttaagctacctgcatctgatacaagagaaacgataaagtccacctggttcagagcaaacattaaatattataatgaataaagaacatgagtggaaatttaacatttataatttgttttttctctctgtattctgctccatgattggtagtattattctttaattaataaattacagtgttattgaggatctactgtgctatagagaaaaaaatattgtaaggaagtcatcccctgatttcagggcacttatgtcctacttggggaagaataaaaaataaacaaatattaaataagttgaatttagatcatgatacattcttaaaggatgtaataaagatctggactgaatgttgacgaggattgggttttagtctagagattatgatcaagtgcagcttcatactatatgggacatttgaaataatgctgtgtaagtgccattttgtgaaaatcaagagttaactctaggggggtggaggaaagtaggggggggaagtgaaaagaccatggctgttttctgtttgtgaaactgagagaaggaagaggcaaagactatgagtgggggaagtgggggttgaagaatgatgtttgagtgggtagacttggagttatgacagagtttattcttcttggtttggtctataatggaaagccttctgggtggttttaacaggagggtgatatgaaggtcagtgtgtgtgtgtgtgtgtgtgtgtgtgtgtgtgtgtgtttacttttgtttaatagtttaggtgaagaacttgttaaatgtataaaagaaccaaaattcagaactgatatgttcttcatggttagtgtacaatgcaactgtagtgggaagaatagtctcccctaaaatgaaatgtcctccttctaattctgtgtggctgtgaagataatcttatttagaaattcagtcttctaaatagaattcagtagaggtagcagaataaaataatacttgtcttgagataagttttaaatctaattgataaaagaccagcaaggaagatagcagagatgggtcaggatggtgattctgttaacaaggggcacctgaaggttctagaaatcaacaaaatctaatagacaggagcatggatatgtcttcagaagaaaacacgctgtcaatgtattgcattcctggctttaagaatgatgagaggatatatacatgacactttgaactgttgaaaagctgtcataacaagacctaaggaattaatctggcaaccaagaagatagttacaaagggaaaggtggaatatatctttgacagctgtgaagaggtggatgaatcatcgaagtaaccctgcctgtaaggcacactgaagagtcattttctttggcaagaattttgatttctcattgtatatctgaaaatgactatacaggttgggaagatcccttgaggcacagaccccaagtacaaattttcagcaggtccatgtttcctactctgctccattaacaagggccaaacacagaggccatctttctcactcttgtgacctactttatttctcaagctcccttataatttgcttacattatattaacagcaggagttggtaatgaaaattctgaagtagggcaccttctttaatataacaaataattttcattacctgcaaaattgccacagacaagaagtaattagtagtgtagtatgtaaagaaaaaagttctgtgcttatagagaaagaagaaaattttgggatgggacaattgtttgcctttgtcatttgccaggtggtgatacattagcctgtactgaatttctaatatatatgacttcctacgtgataccttctatatctgtcgcttctaattattgtgattcttagaggacagatattaataaatctgttttaaagaagacactgtagaggctcagagagttccagtcaaccactcaccaaatgtttaatattatataaagatagggttacatattcatccatctagttatttttgtcttaaccaaactttacttttcccttgaagttatcatagccactaaactgatcttgtcactgactttattgatagattcagcatttatgttttatatttggattgtaaagccaacacttgtttctagagactcatgtaagaggcatacaggagcctctaaatatttaggctgtattatgcaacagaatggcagagtaaagggggagaaaagcattgctttccttctttcttgcttgctttttctcaggagaattagcacaggtctgttgctccttcctttggcaagaagcagtagggcttgataattgagtgtgtcatcttctaactttgtgttctttcctttgaagccacactatattatcctgggctgaccagtgctgacattcagacctgagaacagtcattaaactgtgattgcattgctgttttactgtcccttgagttcttatgaattggtttcttctcattatggggatttctcctgaacctccagacattgccattcctactgccttcttgagtccatggcttgaattcataggctgggaatgtcaagaaggaagagacagtggtggtgtgtctagtgataaagaagcctaggtaaagaatgcattagttctcaggactaaatcttttctttcaagctatctcaggttttaagttctatgagttgccctgccatagaagtgtaccctactaatctcgcttctcctcatggttcctttggattaatagagagtagatgtgtaattctctaattcatcatgatttactttgtcaagatcacaataaatagagaaaggagatctatttgtgttgtaaaactaagaatactttcacagctttgagtattttgtcttcttactctatgattttcatatatatctgtaatgattttgagacaatcatcaaaagggcttcatattattttggtaagatataaatgataataccaggtattgagttattttagattcctagaatctatatgaatatgatttttgattataacatatattatgagttggtaattatcatcaacatataatgtattaacatgcattgcatgctatatttgtaaaataaatcggttcattacagttgacaataaggggaaacataccatgtgggataaataccaagtttttgaatgtacagaaatgtagtaaataacacataaattaatttgaacattttaaaagagataaatataacagaaaagtgacattcatgataacacaaccatagagttgcctatataataccagaacaatggcaacaccaatggatctactaacacagatgaggaaatcttctagatttcttcctaaaagaggtttatactcctcagcatagaactacatgcaaccaatgacaactgagagaggggacatatatttcctctaactagttctctaatatcagtggtcctaaaataatttaaacataagcacagtaaatggattttagatatatatttttgcataaagataaccataatgactccaaagaagaggccatggattttaggaaaactaaggagcgatggaggagattggagaaaatgtctatgagaagagtttaaaagaggaaaggggaatggaaaatttgataattaaatatagaaaacacatcactggaaaaataaaataaatctgattttgtaaaacaaaaatcgatgacagataaatggtgcatatataaatatattactgatattgctgatattagagagagagagagagagagagagagagagagagagagagagagaacatagattcctaggcttagaagctgttctcataatttctctaggtcagtaatcatgcttgataaaacttaatccttattcttaggctctcacaatgtcacagtcaaactgtcagcagaaactggagtctcatttgagttctgtttggggcatggcctacagataggaggtgagaagattaatgaatgttattaataagactggaagtgagacttcagagcagagagagcctcaaacaactgtagggatctttaagataatttgccttcactttgttttgaatagatttaaaacaaaaactaaaggtatttaatttagggcggtttaacaaatcagtgattattagaatgatgccaattacagagataatcacacctgcatggtcatatggaaaaggcaagagctgaaccatcttacaagaactaccatattggagcagaactgggaaatgtatgaacacagcatctcctggattggttctcatgtgactgaaatggcagctactttgcaaactgaggcaggaggagttcaagttcaaggtcatcctgtgttaaaaagcaagctcaaggctaatttatttagaatatatctcactatttaacaaagagacgatggatacaatagccatctgcatatatggggaccaggggttaatctgtagtactataagcaaataaccctgagtagctataataaaaccagaataagacaaaaaggatatcaacaaaataacacattttagcaagtagtatctgtgaatcattttactaataacactcatactaatgttaatattttaaaatttggatctttatgttagttgcagccacctagttttttgttatcttctagaagggccagtggtggtattatttctattttttgttctaaagtagacaagatcttgtgtattaggtaacccaaagtcatacagaaagaaagggagcatcaaaaccctaacatctttagaatacgtcttcagttatgccctgcatctcagccaggaaaggaagacattgacacacttttgtaaaatctggaaggggttttgggagattctgagtgaatttttgtcatggccaaatcacctataatctataaaaccatcagagttgcaatcatttgttgatcagtaggctttatgccaggctctttacttgtactaattctattttcaacattccccaacttccaacattaatgacattcctctttatttactgagcacaagagtgcactttccttgttgacaaggcgtgcttaccttatttgaaagtaatctgcattcttttcattatgcttgtgaaccctgaaatgtattagttcttcttgtacctagcaagtcagagaaaaacattctgcatatgggtgatcatagggacaatcccatatccgggttcacatgcatatatgacagaaagcccttttaaaaggctatggaagagctggagagatggctcattggttagcttgatgtacttaacctagggccctgactggatctctagcagccacgtgacagctcactattttctgttaacaccaatactggtggttctgacccctccctcttccatagtcatagtctgcaggcattgtataaatatgcaggcaaaccacttatacacgtaaaataaaaataaatgaatctttttaaacagagggtatagatttgttctaattaacttggtcattttagcacaaggctcatctcatcaacggttttccgtgtaagtgtattgtctgcaaagagagaaagcttccattttatgtgctgaaggcaatatggactgaaagccaagggtaaatggaattttacatccagcccaatatgtgctgagtggattagcctttgtggattgtttactggactgtttcatatattgctctctacaacacttatactgctgagcagaaagagtaaaccactttctttcccaagtggtaaaattcgacttgaaccaacagaacagcatgcacatattttttatcaattctttttcgtttggtagtgcacttgcctaaattgattcattattaagcacagaaaaaaacaagagaagggagccttgttcctgaaagctctgatggggacactggtgctggcaccagaagtcagttatttgcattttgctgtgtgaagcttaaatcaagggcttcaaattgcattaagaggattttaaaatcagataaatattttccttttccatctttgtctttaagaatgaattactgagaaaaatatattaaaaatacaaaaaattcacctaatcaaatttcattgctgtttaaatttgtctgtttcactttgattgctatcaggtgtttattcttcataagtaaatgtagtaaaaagtagttcaaaaggttgcatttcttgttccttgaaaaagttctattcgtccataaaagaaaaaagtttcaggaggaatgaagactatttttttctgggtttatgtggaccaatatccataaaactataaagtgtaaagggaatcagattaaaaaaattaatttctgcaaattcagtaatgatgagatttgtttgatctacctataaaagtactatgacttagaaaaattatagtctgtgagacatctaaaacctatatcatagactatctgtttcggttaattaaaatattagtcacacttcataaatatcatactatctatgtatttcctgtagataagttgtcaggagtggtgatgctggtaaattcatgataatatggagaggattaaagcaacactgaccccctttcatgtcagcactgaagtcctatttctgtgatagcacaagaagacgaagatttactatcctttgctggagctcttcccctgctcattatatgaaatagccaaagaaacaaatagcactaggtattttcataggcattgtgtagtatagaccacccagcaagaattgtgtttgaaagcaagtgactgttacagaacataattaatttaaaaatagctaagaataagcctggacctgctacttcactgatttcagaaacaatataggatgctattttcaggaactcaattgaaactagcgcatttggggaccttggaaggagaggtttagctcttttctatgagccagggaaggcttggttctgaattgggtctttatttaaaaagtagaatgccatggatgattttattacacagataaggaaatcatgaagttgctatttctggaagtctgaggtttctccacttttctccttctatatttccttataagtgtcacagtagttctgggttttttggtttgtttgtttgtttgtttgtttgtttgttgatgtttaactaaatttgattatatttctggcttaatgttccactcagtgaacatccacaaggaatatgtttgcttctgttttgaaggaaaaattattgacttgatcaggactccctagtgatgatctcctccactaaccttgcttctgcagccaccgaggacctccattttacccagctcagtgttctgtggcacagtgggatttactattctttgtgtggataaatatcagaaatacacttttgaactttggtttgacatccttaaagttagcagaaatgtatatgtatacatatatgtatatcgtgtatatgtaaatataaatgtatatgtgtgaattttttaaatttattgattatttactttacctaccaatatgaacctcccctcttgtcctaataacccctcacacagatcctgctcccatccactcctcccattctgatatgagaatagagaactccctctaggtatcgccccatgtgatggtttgtatatgcttggcccagggaatggcacaattaggaagtgtgaccttgtaaggataggcatgtcactgtgggtgtgggcttaagaacctcaccctagcagcttggaagtcagtattttcctagcagtctccagatgaaattgtagaattctcagctcctcctgcaccatgtatgcctggaggctgctcttctcctaccttgatgataatgtactgaacctctgtacctgcaagtcagctccaattaagtgtccttataagagttgccttggtcatggtgtctggtcaaagcagtaaaaccctaagtaagacacaccaccacctcctgaaacatcaagtcattctcctactgaggacagacaaggaagaccagttaaagggactggatcttcaggaaggcaacaaactgaggggcagccttctcttcagttgttggggtatccacatgaagaccaagctgtacatgtgctacacatatgagtggggtaccgtgtccaggccatgtttgctgtttagttagttgtttagtctctaggaacccataagggtccaggttagtcaactctattggtcttctcgttgagtctccatcctcttctggtccctcagtccttccccaactattccacaagactcctcaagatccttctcatattttgctgtgggtctcttcatttctttcttttgactgatgagcagagcctctcagagtacaattatgctagacttctgtcttaaaatataacagaatatcaatttttaagatttttattagatattttcttcatttacattataaatgctatccccaaagtcccctatatcctccacccactctgctccacaacccacccactcctgcttcctggtcttagcattccccttcacaagatcatgagcctctcaccccattaatgactgactagaccatcttcataacaaaatatcataaatagcatcagggattggctcttacccatgggtctcagtttcagcctgtcattggttgtccatttcctctgtctctgctctatcattcatttttgaatacatagtgctattacagtggctataaaaaggacagtccaaatcatcatgaaattctcgaggaaaatacctaattaaaaaaaaaaagaaattctcattaaaataattacgtattcatttattttatttgaaaattgttggtcatcatgtgattcatcttgttaattcttttagaattatcttaatattgtggagtgtctgtaatgtcaatcactgtataaaataaggaaaattttaaatgaaaaaaccagagcctttagtttcctaaagtctactttacattttacatgatgatgttagcagaccaggaaggaagacaggaagccaagatgctggaaccttatcacacacatcttgatgaccttaatgttctacatctatcacacaaaaagacttatgctgtacctcctgccaatcctgatacactactcaaatggtgccttctgttttcatgccatatatgctcataaaattatattatatgtattcttaaaatctaagtgctctctgaaagaaacagaaaatatgtgcttttctgactctggctcattttacttaatataataataactaattccactaattttcatacaagtgcataactttatttgtttttgaataaatctcccattagagatcatatctatctctatctgtctatttgtctgtctatctatctatctatctatctatctatctatctatctatctatctaactgcaagcacactgggtgcctgtgtttgtgtgtgtgtgtaaaacatttttatctgctcatatgttgatggatatttaggcttattctatatattggctattgtgaatagctgtacaaatgtacctgtgatatgctgacataattttcttcccatatatatgtaggagtgttatagctggaacaaataggggggtcaatattgagttgtttgaaaaactacatgattccgtctatacttctgcgcaaatttacattcttggcagcagtatgtaaacaagaagtatataataaggaagtatatttcttccttcttatctacagccagcattcgcttttatttattttctcagtgatagtattgagatgaaatctcacacagctttgtcttacattaccccaagggttggaggttgttgaacatttttatttcatatatatttttggccagttgtatttccttctttgagaattatgtgttgatttcatttgtaaatttattgatagaatagtttgtttttcttgtattttatacactaggttgtttgtgtttaggttttttttatatagaatctagatattcatctgtgtttttcatagttggaaatttttttacccattttgtttctgtctccttactttgcaaaatctttactttatttactaagagaaatgcctttcgtcaaaatttaatattgtttcatagacatcacagacctttacagaacaattatatttttattccctgtggtaatggttaagtttaaatgtaaaaatttaaaagcctagaatcacctatgaagaaagtctcaaatgaattatttttatcaggttggtccgtgaacctgtctgtagggttattttcttaattgttaattaactttgcacacaaaggcagcactattccctaggctggggcccaacattgtatccaactgaataaggtgagctgagtagcacagaagcaagaagcagtactactagttcccattgggtcttgactgcataagtaatgtgaccagctatttgaattcctgtgatcttaattctaggtcaaataagtgcttcctccacctctctgttgttttttaccataggattcaaaaggaaaatagaatacctcctatatgttggctaatacacttgacttaaatagaaggtacttccatgtgccctgtcaaaaattgactattgcctgagtgccaatcttagattaaatttcacttaccagtctttgactcttacataaaaattttccattttcctttctagaaactagcagagaataatttgatcaagataaagtaataataagactcaaagctagagtgtttttgtttgttttgttttgtggaaaactgataacatgaccccttctcccaagtctatagaagatagatgatacatgatcaacggttttaagtataaatcatatattctaggtaatgccaaactttgacctcaggtaaagatcattgcactctaagcctttgaatttgtctactattcacttaccttgttggccttgttttatttataacttttaattgtaaggttttctttagtaggcgaaacttttagttttgagcacactgtgataggggcatatctcttttacgggcttgggagggcttatatgaaaagtgttcataaacagttaaaaaattgaatgtgagttgtggtggtgaaggtgcatctattaattcattttgaagttctttataaaaatcaataataatgtacagagatcagttgtgttgtgtactgccaaaatggctgtgttcccttgttctgaaagaacttgtgatttcacttttaatacaagtagtgctgacaccatctttgggggtgaggaaaggaactccgtgactttccacatgtgaactcttgaatatctgaaatgctggagatttggtaagtgagattttgttgtggctgctgctttatcagtcagtttattaggaagcatattaagaaacatggtgctaaggctcaatgtaataagttaaaataatgtgatgagaaagcaactaaagaagaaaaaatgctgataaaataccctgtaataatttccctagggcctgcacttaaatttccaggcttgaaaggaagtacctacatgtcaggcggctactgtgagagccacatttccagcaagactgttatcaccctcttttctcattcttgctaattgtccttgtgaatgggtatgcatatggctatttatgaaataattcaagaaacctggtgtgtctttttcaaaccacatagaaaactgagaaagcatttggtatcaacacgacaaaacagtattaattttgtaagaatgtcctttgttttgaacctggatcacagaccattgcttggacatacaaataattttgtctttctagctttaagtagaatagcctgaaattaattagaaaaggacatgattgtgatgttttagcacttcaaaaccaagaaaccccaatattgtccagccattcagtctattatatggaagcatatttttaaaataaattcaacattaccatcattataatattataaacccacattttcatgtttatatttttgacatgtttataatatatgtagtggtcagcaaattttctttagtataatagtagataaaatactgtacactgcaaattgcttaatttcttgaactattcaatttgcagttgtaatatgtaagtaattacagaaatatttaaattaatgttcatagctttctcagtgtaaaacttattttaaaatgattgttgtccaacagatatgcccttttgatcatactgtacttaggctacaaattcagactgcctcaaatcagctatcagaaatttagatcatttgctactatcattacaaacccatcgagaccatctctgatttaattaagaattttaaaatatacatgtgcacattttaaaatatatttacatcctgtgatttgcatcttttaaataagatgtcaacttttatctatgaactttcccttaaagaacaagaatgtattttacttgtataactttttttacaacacgattggcatttgacccattagcttgtattttagttttgaaaacaaaaatcatcattggacatttttttaaattttttagatgttatctaagtgaagcatgcagaatatggactttgattttgagatagatagctatgaggttgctttagaaaattaagggtgtcattctgtgttgatatttctgtttgagtacaccagaacatttggaagacaattctcatcttttctttgagaagtgtatgcctggatattagaattgtaataatagagcctgtcttagttaggattttagtgttgtaaacagacatcatggcaaatgcaactcttatatggacaacatttaattggggctggcttatagattcagaggttcaattcattaccatcatggccagaacatggcagcatccagctggcatggtgtaggaggagctgagagttctacaccatcatctgaaggctactagcagaatactggattccaggcagctaggatgagtgtcctaacactcatattgacacacctattctaacaaggccacacctactccaacagggccacaccttctaatagtgccactttctgggccaaatgtatacaaactatcacagagctataactccataaactcttatttttctggttgaaatccattcttattccaaagctcatccaatttataaatacccatttaccagtaatagtataacaattacattcacaagtattacccaatacaagtggtaaaaatctgtgctcattccatttgggaggcaatatgagaaagttgttgacagattttcatattcagaatgttatacatatgcatttggtttaagatcgcattgtcacattctaccttaaatacatctgttgtcttcaaggacagaagcaccatattcatttattcttcttacctacagaggtcagaagagggcattgtgtcgtataaaactagagttacaggcagttgtgagctacttaatgttggtgctgggaatcaaacttgggtcctctacaagagtaatatattgccaaagtcctgattcagcatgaggagggtcctgagaaagatgcatatgggaacgacaatgatttaataatgactcagagtcagaattagacacaagctgctagttcaggtactctctatgttccctgataattcttagtattctttattcttcaacttcagcttcagcttaataccttgatagtttaatccttcaacttaatagcttgataagcagagagatcctgaacacagtcttttatttactaaagctacatcatcatcaaggcttttaacattgttaataattatcaagaattcttaaatttacataaacactatgagtccctagataaatagtcccatcctctgtttctttagagcagaaccaagcacaaagcaaaagcatgtttccttctaggtttatacaacttattctttactgtggctggacatcgtttttctagtgttggggtagagcagacagcagcctttagtaactgcttccatataacaatagaaaaatgacaaactactgaaattaaaatgatttcttacaaagttttgactttatttaagtaaaacagtaccagttagctctctctaatatcttcccaggtcttgttatcttcaattcatcaagcaactagaaaaatgtagtgctaacttttaacatgcttctacatcatcttttaatcatctaatcttcatatccttatcctagcaattccatagtctccttctaatgctatggatccctaaattatatataattttctatattttctatccatgtcctttcttcctgagtcattctaactctatgtctctaaattcatcctggctacatcaatgcagccgttattagatcagagggtacatgtgcttcctatgactccaaaatcaaggccaagtctggatatgaaccatttccaaaaaagacaatgtaagcttttatggcccttgtgattatattgtctagatcctttcccatgaccttaaaggccaagtagaaggcctggtcctggtcctccatagttgcatggccatctccatttctcattcctaaaaactacatctgtttcagttactatggcatcattatctctaagtaatgggggaaagaaaggaagactgaaagtaaagtagttgcagatcaactttggggaaccagccaccatcagaactcatgttggtcataggatgaatgacctggcaatgctccagggacaagaattgtgtcagacattgtcttactaagccatgctgagtaagagtatgtgtgtgctcttaactgatgatccatctctccagaccctctttgccatttttatttatgtgtaataagcatttgtaaataaatgaatatattgagacttgccagtcattttttttttattcattttttctcttttcttgtttttacagcataagtactgaattttagaggaaatagagaattttggtctgcacttgtactgtgttattcaatacaaatcaaataactgacatgtcttactgcttgtctcacatcttcatgaatggagtttggtgatcaccaatccatctccttatcttcacatttttcttttaattttgtgcattttaaatactatataattacatcacttcctttctttcctttttctccatccaacttctcccaagtgtccttcctccagcatccttccatgctaccatcactctgaagttgatagcctccttttcttttattattattgttcacatacacacacacacacacacacacacacacacacacacacaccaatttttccgttaattttatgttcattatcacatggtacagttcctctattctttcttcacacgttctattttacaagccattagctcttccttataatgcccttgggaatttttgcgtgtgttctcttttgtttctgtcttgtaagcattagaaagaggtaaggcaactttgcatggcatgcaaccctgagatctctcagatactgagtttctaaccagctgatatgaggcccctgtcacatttatagcggaggaatacctggtctggcttcagtgagagagacttgaggctccagggagtggaaattttggagaaggtgaggatggggcaggtggggacatcctcttgaagacagggaaggaaatgtgggatgaggaaaagtcagaggatggaacaggagggggataacaactggactgttaaaaaagattaagtaacaacaattataataataatcttcttttaatactgctcagagtttgtttattcctcaagtgattattccctctccacttcagtgttttgtatatcaatgacaaagttgtcatggaaactcagctatcacatgccagcatcatatattgaagtctgtgtccagtagtttatttttaggcactgattaattcattcttcacaaactaatctagaagttttgttttctgatttatgtattaccaccccatatggctttcctcattttttttctaaataatgaaaatatttagccacacaaatgaaccatgaacacatttatacacatttatttagcattagaaagaaggaaggccactcatagttttcacacttcttctgagactggtatgactgcttgactctgtaaggagatgagtaaagtttcctgtaaaaagtgaaagcagaggtgatgtgactgtgaggtcaatggcaagaataaatacatcagtatgtcatagatgcagcagcagaaagacatgtttgggaaaagtttagattgacaactcaaattcttctgcctagcttccaaatgcaccacccaattcccagctcactcctatggttctcccagttttgtgtttcaccagcaaaaggactgacaagaaaggggaggagaagacaaaaaagaaagagaaggggcaatctgaacccactgccacaaaaactcaaaaatgcacttccctgtttttggcaaaccctgtaagctggagaagataactaatttccctttgtcactaatctagctgggacccacaactttgcagctgtcatatgtgacaattagaaatagcccctacattgtactttcctaaactaaccaaagtttcacttgcctgttgttaatgtgcttgcatctaaagctggtggcaatactatttttattattttctaactattatgtcaatatataatatgttgatctttaagtgtctattgtttattgttttctacttattcttctattattagaccatatagcataacacattatgttggggaatttttgtggtttttggttatttgaactggattagaataaattgagtatacatgatactgttttgtctgtcatgtcaacatatgatgatataataatttgaacttaaaagttcatgatatagtatataatatataatcttctattgtaaagttgaaaatcccttcctatatcttgttctactacatcaagggaatttctgttatgtaagattttttttttgacctggaggataaaactctatacaattttaagggtaatataaaaaaagactttctcaaattttccttcaggtgaaacaagacatacaataggaaatttgtcagttctatgttagtaaaacaattatctgttctatacaaagggagcaactatttttttcttttcttttaatttaaaattttgtttattatttgttcatgtatgtgtgtgtatgtctgactgcatatggtgtatgtctatgggaaattggtgaacttctggaagtcaaaagacagttttttgccgagtcactgcctggcacgaggcatattaataaggtactggtagcataaccaatcaggtatggacacgtcactcctaggcctatataagcagcaccatttctggggctcggggtctttcacctacgcagtccatgctctcccaataaacgtgttgcagaaggatcctgctgtggcttctgctttgctggtgagttgggtgctcacagatgtcttttctttccttccaacttagttcctggggactcaaagagagatcatcaagcttgaacaccaagtgcctttatccacggagacatctgtaatgaataacacacacacacacacacacacacacacacttatatattgtatgtgtgtgtgtgtgtgtgtgtgtgtgtgtgtgtgtgtgtgtgtatttctttttgaaatcctaacttctatgactgaattgatttcacggatacatgccacttattttgttatcagtatcgcttggtttctactaatctctcccccttttttcaaaattttttattagatattttcttcataaacatttcaaatgctttccagaaagtcgcctaaaccctccccctgccctgctcccctacccacccactcccagttcttggtcctggtgttcccctgtactgagacatataaagtttgcaagaccaaggggccacttttcctaataatggccgactaggccatcttctgctacgtatgcagctagagacacaagctctgcgggtactgattagtgcacattgttgctccacctatcgggttgcagacaccttcagcaacttgggtactttctctagctactccattgggggccctgtgttcaatccaatagatgactgtgagcatccacttctgtattttccttgccctggcctagcctcacaagagacagctatatcagggtcctttcagcaaaatctcttgattttcccaaatatttccttggacttctgactgaatgaactgtccaggtggagcatggtacatcatagtaggcctatataccactgaatgattgactaaatgattggaatggttgactaaatagtatacttatcatttagtatacccatactcatagcattagggagcaactgattggtttactgattttggaagctattcaagagactgtcaacaactgtgtatttcttgccttaaggaacttactgggtaagattgcacattttttctggattgactggctgactgactaactgactgactgacttattcattcattcattcattcattcattcattcattcattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcattgatagtctgtgcagagtacttcataatgttcttgactataaggactgacccatgtagccatgttggcaactgttcatcattcctgtggaagatgagagtgtcttggatgagaaagcaggtattcaaaaccagccttttgaagctcaaagtgctttctattacagtacagttcagaatctctttaccttagggcatattttatcaagtcagagcttcagaatcttattccttctattccctgattcttactaaaagaaatccaaaaacaaaaaaacaacaacaaaaacaaaaaaaaaacaatgcttttgtttttctgacacttgacttacactataatatatttgataatacattttgttttgcttcatatgagaagcaaaaatctattggctatctaaatttagtttttggaatggcctagtcttaccaatggaagtacctgactcagactcctatagggtacacactgggactgagcaaaattatccaatccttgctttaatttgcagtctaacaagagaaggagtaatttttagggagacatgaagtgaagtattcccttgtgctttcctctcagttttcccatagggttgaaaggagtgaataaataccaatttggaaaaaaaaatagctgtcatgcccctaatgttctgttttactaactcaattctgtctagaatacaaattttgcctgacatgtgccatgctgttggcttataaacatgaatactgaaagagatccacaaggactaaaagatcaatggactatacattaactaaacaagtttcaatatgccttaatttgacttgggcatgatttattgcctaaaataaatagaccaaggtctgttaattttccctgaggtccttgcattcataatcaccaccacagccagtttttttttatttaataccatgttactgctgtatacctttttatgagttgacagtatcctaaaattactttttttcagcaccatgccatttgtatcattttagatgaaaagggcacagggctttctgaaggtcaatggaaaatcacgcgaacagtgtaaatcatcgaacaagggaagaccatctattgtgttatgtttccttcatgtggcaagtatccaaatagcccgttcctccagaagctaaatgtatgtagtgactggaatatgtgtgccaagatttctagattcttggggagattaataatacttcaacttgcttttcctattcagcttgaggtggcttacttcttccttgcctttaaatttaagaaaataagcaattctccatatctattaagcactaggatgatttattccaaatgttttcactgtatgacacagttgcagtcatgaatatcacatgaccttggaaaatcccttaggaaaatgtgactgagacaactttacttccttggtacaacctctttagaaatccgtgatgataataacttaatctacaagcaacaactccctaggaaaaaaaatctagaaagattttgttgttattgttaaaaacatcaatgttaggtaaagaagacccatggttctctaagaatgtgaactgtggccatttctgtgatgcagagcattgaaatgttcagtgctgcctgtggcagggcctgcttctaattgtctcacaatgggtcttcaacaatactatctcagaagggatcatctcagaataaagagaggttcttacacaaatatcaacatgaatgtttatcatacctattattaagcatctaagaaaataaattgtaaaatgtattttctgtcatttgatggttcctagtcttgtcccaaccatataggataaatttggatttagatgagaagagctgaaatttatttgttgaaactaaacacaaaattgatgatttttctatccaatgcatgaaattttatttatttcaaacactattgttacacatattgactcatataatcactatttcaggagatttgtttttatgtgtgctggaaattgataaaatactctggatccaaagatgattggattgagtgtgctgttacatcattagcataagatcgcagtaatttctgtaagaaagtacttggtgcaatgaacattccttttagcactgctttaaatgtcccaaaaggttgagtatatgttgtgcctttgtttcactgaattctagaaaggctttaatgtctttctttatttctttcttgatacagttttcattgagtagagttgttcagtttccaagaatttgtaagcattctgttgtttctattgttgtagaagtttagctttaattcaccgtgatctgacaaaatatagagtgttatttcaattttcttgtatctgttgagacttgtttcatgacaggataaatcttgaattttggagaaggttccatgagatactgagaagaaagcatattcttttgtgtttgggtggaatattctgtagacatctgtttgatccatttgatccataatatctgtccctttcatatctaataatctgttagtttcatatctgtttactttctgtctattgctgagagagtggttttgatgtctcccacttttaatgtgtgggattcgatatgtaatttaatttttagaagataattttttttaacaaatgtgagtacctgtgttttgggaactgagatatcatcttggtacagttatccttagatgagtatgagatgaccatcctcatttcttttgattagatttggttgaaagtctattttattagatattagaatgacttttccaacttacttcttggattaatttgtttggaaaacctttttctgccctttcatatgatagctcattactatcagtatttttgaaactgaggtgtgtatcttgcatgaagcagaatgatagatcctagtttttgcatccattatcctagcctgtgtctttttatttggaaatagagtccattgatgttaagagatattactgatcaatgattgttaattcctgttattttgatgttggtggtggtggtagtagtagtagagtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnntgtaaagctgtatttcaggatagttatctttttattgaatgtattaattacttacatttcaaatgttaactcctttcccagtttcccctctggaaccccccattccatcccctatctccctacatctatgacgatgctcccccacccactcactttcagatcaccaccctggcattcctctacactagggcatcaagccttcacagaaccaaggacctcccctcttattgatgccagacaaagccaaggtctgctacatatgctactggggccattggtttctccatgagtactttcattggtggtttagtccttgggagctctagagggtctgattggttgatattgttgtttttcttttggagctgcaaaccctgtcagctccttcagtcctttccctaactcctccattgtggtccctttgtcagtccaatgatcggctgcaagcattcacctctgtatttgtcaggttctggagtatcttgtttcattcatctatgatgatgaaagttttgctaggtatagtagcctagggtggcatttgtggtgactttaaggcatctgtccaagcccttttaaggttttagaccctctgtgaaaaactgagtgtaatgctgatctgtctggctttttatattacttgacattcacccctttcagcttttaaggttctttcttagtcccgtacattcagtgtttcaattattatgtgatggggggagtttttttctggtccaatctaattggtcttctataaacttcttataagtttataggcatctctttctttatgttgggaatttttcttcatcatctaatgaaaatatttttaggaccttggaacagaaatcttcttcatttattcctagtatttaaacctacttaggtttggtctttcatattttgccagattcctggaggttttcggttaggatctttttaggtttaacattttcttctatggtatcttctctacctgaactcctttctttcatctcttgtattctgttggttgtacttatgtccacagctctttgtggcttacctaccttttctatcgacagaattacttcagtttgtgttttctttgtttctatttccattttcatgccctgaacaattttattcatttctgcacagttttattgtattttgtctttctttaaggaatttattcatttcctttttaaaggcttctatcattttcataataatggatttaagatcattttcttgtgtttcatctgtattaggatgtccgtggcatgcttggtaggatagctgggctctggtgatataatattacctgggctggtgttgatactgttgttatggtggtatccagccatgtattgtgttattatattattgactgttgtggttattataggttcaaaagtgcctatttctgatttccttttagttgcatgaatgatttttggatgatttctcccttgatttttttttttctgctcagttcggtgacctgagaaccctggtgttctggtgatcagtaagtattcaggtctagtatggtgtctccattggggtttctgtagcctgcagtgtgtgtgtgtgtgtgtgcgtgtgcgtgtgcgtgtgcgtgtgcgtgtgcgtgtgtgtgtgtgtgtggtatggtgtgattttgtgtgctatagttacctctgaagttcctattagcagcttggcctggccttgggtctctgatgcctgtgtggcctccagcaaagcagataggtttgtgggccaggaaatggggcacagagtatgggctgtggtttactcctgttgagtgtgctttggggggaggtggcatgcaagtacttggggcaaaatttcttaattggtgtccctagtgcctactggcctccagaaaagcaggcagatttgtggacagaaaatggagctcatggaatggagtggagtttactgatattgagtgtgctttcagggatgttgggcagggggctcttatctagtcttgcatattcttatttttaataaaataaattaaataaaggagatatagtgatataggtgaaaaatatttacacgtttgaaagaaatatcattttattatacttataaatgtaaaaaagtcttatttcttgcactttatgccataattttaactacaatgttttcaaaaaatgagattgtcaaaaatgaccataatcctgaaccatggaggtatcaatgagtacctaaatttcaccaaagaatataaagacttttcgaagtttgcctcccttttctttaaaaaatttactttaataaacttggaatttaattgttttatttcagtttattagccctcgagattgtgtatattctctcagcctcttgacagttttctaacctagaaatgggagtcagtattaaaaatgcaattataagcaacatagcatgatttcaacccagagtctgtggaagttggtgagcacacacattggcaatcaaatataccttacttgcaattcctgtcttccctcgtgttctctagtactttgtcattgtcttacctaaataccttgccctgtttcatcttttatttcactaggtttgatttcaaaccctattcccatcataacaagtctcgaagaatgtctccaactcccatttcactctatcttgagcaaaatgtcttcaacatctttgaaaacccctaaaacacattgtgttttcaagtctatatatttcttttcagtgcatttctatacagctatgtgtaccacaagatataagtaaaatgttttctgtatattctttttttattttcttctggagacaactattagttaaacaatataacacacaattacaatgtgtgaatgttggcctctgtcatcatttggaaaggccagaagggtgtattcatttttgtgttattttggtaatatgaaggccatgaaaattaaactcagctgcagtaggaggcagggcatggtaattaatactcagttttgccagtcagtattggtatgttggctccaaattaatccaggatgttttacaacccttaattgctctttgcaaaatatgatcatgcacatttggccatatattactagagatattgtttccaaaaataattttattagtctctgagtgttaaatggcttggaatactacaaaaggaggaataagtgataactgaggggaaagagaacacaaatttcaatgacaataggcagactttgtaccaagatatattagaggattgtacatacaaagacggggcatggtaacttgtaggagaaagatttggatgattttcaggattttgcaggttatagatgcaaattgggacggacaaaacggagtttgctcttggcaatgggtcttagaagagattttgtgttgtgacatattttacttctcttcttatttgtttcatctcatgaaatgaagcctcctcctttgtaaaattgaatgattcccctgtggccttctctgtgccagaatgtaatatgccaactctctgggcaagactaaatagcatccttttgtaaaatattaaataattttgagggctttaaatagttttgtttctgtgtttgtggtttattttggctgactaagaagaaaataaagattgattgatatgttatagaggaacagtaattagaaaaatttaaacaatagtctgtaaaaacaggaacaaagaatcttctataagtgtttttgattggtaaaacatgaaataatcttccatacatgaaagaatttgctctgctataagaacaattacttgcctcataaaatcagacttgcttaataaagttagtgcatttcagcttcttctgtcctggtgataatgaatagcataagaatgataaatgatcatgaaattgaaagcagattggcttgaattttgaatcatgtcaggatcaaatagcaaagatatacatttgaagggttaatgctaagtgttacagagtaacattgttgccatatgaatactcacccagaaataatcaggatttactttgtaggttcacacaatataggatgtatttatcctaaaaccacacaaataagcaaaaagcaaactatcaaaaacaacaggaaaaaccaaaggaacaaaaagtctgccaattcatcaggaaccggtcagttgttcttggctgactatccatgtatctcaaaaaccctgaactatcaaatttgtctcaatcaatatttcctaatgattttagcaggactcactttctattatgtcaaggaaaatttaattttatatatacacgaacgacctttacaagtgacatgaggtagtgtcacaaggtcacttttagctttagattgctgtgaccccattctggctgaggctgccttactgattttacatagcttaaaagccagttggctcccaaactgactctcagtgctttcttcattagtttttttaaatcaggtattgggcaggacattttttaaaaattttttatttttcagataattccagaagttgttttttttttttaaaagcatagtataccagacattattctttcaaatctagataattccacattatgttttaatataggaagtagttgatcttatttatgtattgtaagaatcactcagacatcgttaggtcatacaaattctaagagaaaaataagacaatatcacaaatctcttgcaacagtcttagaaagatgacaaagcatttgaacgaagaagttagaattggtaatggggagccatgaatagatttcaaacatattttcaacgtaaaactaataatgtttggtaatggatcagactgaggttgtggaaacaaaagtgtttgtctgttaaagtaggattagcaattaatcagtcagaaacaaatacattttggattagaagaagatcaatattaacttattagactttacaggttgatatctaatataaaaaaaagtaggccatttgtaggaaatttacttttcagcaaatgagtagaaattgaatttgtatacccaaatggaaataagtgcagtaacaatgaacaaaataagagaagacatatgtaagtagacgttgagatgctctatttaatacagatatgggcaatatgataagtccagtaaaacttgatacagaggttgggacaagggtagtagaaaaataagtacaagatcttaaatgctaactaaggtacacagcccttatagtactgaactaattccacctggacttggtgacaaactaactgctgggcagtaactagtaggcatttcaaagtagagataaatgaaagtttttaaagagtagtttgccatctcagggattaaaatacttcttggtatggggccaagagaatagaccaaaagacctgtcaactgctgacataaacaattctttccaggaaacttctgtaaggaaagccataagatgccacagagagtagtaagggagtgaggcaagagtgcctcaatgggtttatgaaagtcaactatttgaaggcgatgtgaagaacagcatcaagaaaatgctgttctgttctcagttctagcatctttcactggctattgtgttcatggttctttttttgtttatttttttttgtgtggttgttactgttgttgttttctagttgtgacccatccagcttgaatatatcctatcttctgacatcccgtgtctcaggcatcttctaacattgagttggacctcaagagtccactgaacctcctgccaaccagaagaatatgtttcatgtcctataatggtgacatccttccacctgcaaacaggccagcttggagcctcaaattgactaggttggaatcagatgagctcataattctgtacaaccactttaggctcagcacagttggatttactacagctcagccatgggtagcacttgcaatataacttcaccacatgtacctctttgagttttgatttactcgaaagtggatggatgttgactgcaatgcaaacaaatgttctcctccaaaaaattgagcataatggctgcactttcccttctcacacatgaactctcgctctttcaaactttagtaccacttctgagacaattaagataattcggccatttaaggactaacagccatagcagtcttagaactactgttttgcactaaaatgcactaaaaagctgttattgcttattggaattttaatgcttctttatcgggcaagagagagtgttggagtttgtatttgttcttaagaaatactgaaaagcaagaataaagaaaggaagttcattaaaattcacttcatagtagttttgcgaatatctttctggtgccttggaaagcctgtacagatttggacagaaaccttgatgtcagcataggaacaattttaaaagaagaaggacattacatataagataaagtaagggtctctactgtttccactttgcaaagataagaaatcaactggaacatttctcagtgttctaactgttctaaaacagttttccatcaatcatcaatcagaaagcccttaaaagctgtagtcattatcctagaagctaattatgtcctgtactttgggaacactaggaggagcactacgcctatgctatgaatgatgggagaaatgctcagactttcgaggagttttatgttcaggaaagcatgctaacaaaggtttctgatgatgaggaaggaggcatgaaaggatgtccaaaaatagtggaataattagaaggagccattctatggctcagtaaaggtcttttgcttttactctaatgccccaaatctttcaaagagtctgaaatactttagagatctggctttggaatatttaaatgaaagatgtttacctagtatattttagacaagcatcacaaacatctgaaggctccaaatacagaacaccttaggcccaaagtattatagataagggatgttgactctctcccaactttgtcatagcttaactgagaatgctctctaagtttgtttctcttaattagtaaggtagagtcaaggacacaatgatcaaaaacatagggactggagtctgcactatttaaaatgcctcatgtgtattggctaacattctcaataacataggtgttcatttagctgcattttataggttatgaaaaagtttatagtacctagggtctctaaatgagtaggggcacaggttatgctttgtgccaggtcagaagtaacttgggagtacattcttctaaataattcccactggggtcatcagaggaagttgcagaatgggtatgggtaaatatccaggcctaactgtgtgtgttgaaaactgcaaaattcaccaccaatggagaggaagcctggggactcagtatccctgtccttgaattttggggcctccatgcctctgttgtaaatgtgtcctcattcctggagggaagtctttgttcatgtatcctcagtcaaaagttggccaggcaataccgtgacaaataggagtttcataatctggatagaaaaagaaagagcagggtggcaatcacctaagacgcgaagctgaaatgccaaatccaggttggaagaattgcttgtgctcaaaccatgtgaactcttctcagcgactgtgtgtagcccttgctaaaattgctgtcctcattccttgtgtctggcctttggctctgtgactgtattggaaaccttctctcttatttcagcatcagtagccatgtcaaccctggagcagcctccaatatactcttctcactttctctgactttatctgaaaaatctgtcacttgcaaaacttttacaaagccactttcctccaatcaacaaaaggaaaccacattttctttcctttgatataaagagtgtcatccttttcgggctgctttacatttacaaatgtccaggtagttaaggacatcagctggttggcactttgaagttgcatttcccagatatatcttttctccctcattttcttttccttctctttctcctcttttctcccaaccctctctttttcttattattcctccctactttactctcattgttccttcttctctttataatgaagaggtattttgctactaacatgccattgagagttaaatggtccctagaacccagtattactggcttaacccttgtaagtagtattatcattctattctcatgacctgagtacaatagaatgtatctaattctatttggactggttttgcttctgaatggatgcattcactgtagaccttgtttcttactcccccagttttctggaatatgactctgaagtaggctcagttgtgcccgctgaggcgggaggtggggggaagggtgataattcaacttgttaaacagaggcattaaagcctccttcacaatactgctgtgacaagggcatattgaatatgcgctggaccaaagttagtgttcctaagtagtgacaaaaaactgtccagacttcattagaagccgggcttaggagtttacctgtcagcactctgaagtctgagacagacattgagttcttgcctaacttgggctccatagcaagaactactctcaaatcaacaaattaaataagttagttgataacaaacttgatataataggtcttcaaaacttgacctccactagcaaattacttaatcatctctaggtctgtgactcaagatggctgctagaactccggccaccaacttgcaggcaacaggatagagaaaagtattaagaaatagcactctttattgccttgaaagcaatctgatagaagccaatcatagctggcactcagtgtatgtccacacacacactgtagaccagggtaatatccagtttcctattaataaagtactaagctacagtttgagattcatattactgaggaaagagaatctgcaatatgtaactctggaactatgtaactatgtccattgtttaattcttcagattgaaagtctgaatctttaccaagttctattcttgcctttttcttttaagtttacagaagatagaggatatgcaaaggttatgaagaggatgatgttttatagcctcagtttagcatgtttttgtgggtgcctgcttaccaggaagagtaagtgaattatgagctaaaagataagttacatagaggatgggagatatacaaaaaatgaatctgagcagaactcaaaagagagtttatagccaacactagaaaatagaagcagagcaggctgacagagggtgagggatttttttttttttttgaaaagagaattcgttattggatattttcttatttacatttcaaatgttatctgctttcctggtttcccatccaaaaaccctctaccctccccccactcactcaccctgctcatcaaaccattcactcctggttcctggccctggcattcccctacactggggaatccagccttcacaggacaaagggcctcttctcccattgattcccaacaacgccatcctctgctacatatgcagttggagccatgggtctctccatgtgcactcctcatttggtagtttagtccccgggagctctggggagatctggtgagttgatattgttattcttcctttggggggggtggttgacagaccatgctgtttttgtttttgtttttgtttttgtttttgtttttgttttttgagagagagagagagagagagagagagagagagagagagagagagagaatagacagatccattttgttccttagctaacctagtcacagacctcattcagtatcactaatgagaagaatcaaaaatcatgattagctgcacatataatgagaattggtgtttaatgaaagagtatagttattaagttaaaatgagtactgtatgctatatcaagacacgatgatctagtattgagtatggacaattgacatgaaaaggcatatgatccttgatctatacaaaggaacaatggtgaaatatagtgccctaaattgttctttgagtcaaaaatgacatcataaagatgtagacacacacacacataaaacatatggcatttgtagttgaattgtttatgttatggttgtcaattgacaattctcatcatcttgttctgagtctatgcttgactagtaaggtcttgtgctgctttcgttcacaaaatataattgttggacttgtcaaactggttcattggtaaaatgcttttctggaaaatgtgagaacctgacatcagaagttcagaacacaaatgaacttgcttatgctaactagtatctgtaatatcagtgtccctagtgaaaatttggaaggtggagtcagaaaatttcttgaaagccaataggccatctaccctgattttcatggtgctagccaagagacgtgtcaaaaaggtggatagacatgactgatgcctaaggtttcccctgtcctaattgcatctgattatacacatcaaggaaagcatacacttgtactcatatacaaccacacaccattcacatacacacacacacacacacacacacacacagcttagacaatcatgtgcttccccatgttgactcagataatctgctgcttggctatggactaaagggaaatgattatctcagggaaattccaaaggaaatgtgaaaatatatgtcaagaccaggactaaaaagatataaaaaatgtagatttggcctgaaaaaaaatggctgcaatatgtattttaaaatgtaattcaactccggaggctttaggtatggctaacaagggaaaatcaaagttgaaatatcggagtcctttccttcttttcattatagcatggtaacagcacaaaagtaccaaagtctcttgtaaaataccttgaaataaaatgtggaaatactatgtataatccatgtgaatttgaattcctagagtgtttctataagaagagcatattatatttaggaggataccattcactaggtaggaacctagccagatagcacattaaacgtctttttgttgccagagcagacatgaaagtgtatggaaattttggggaacctcttctagcacagatgagactcactctaccaggactgactataacagctagacataaaaaagaagccatttcaatctacagaaacagattcatctccatcgaccagatagatgtgggcatgtaataaataaataaataaataaataaataaataaataaataaataaataaataagatgaggttgaatctactgaatttctcttgaaaatgcttccaaaatttatctgcagagtctaacccttgaatatctctactagtatctaccttcatgtttctgtgttaaagaaggtagttcagtaaaatttctctgggctacatagaaatactcagctttaatttccttttcctcatacactgtgattttgccatgttttcttccttttaaattcttgagtccccatcaacttagtgagtgtcagtgtgtagcatatcttttataagttccccctgtgttcttatattcatcgattatgacctggcccacacccttagcagaatgactttgtattcctaatactcaccaggttacaaggatgcatttttttttaaaaaaagaatcttgttggaaagcgttaatatctcagaactttttgtcattctagggaagatctctggggagacttgagatctagaacatcataggttcccccaaagtgagattattcttggatagtgcagaaatctataatgaataggaacttgaagcctgcaactgttcatggggagagtaattctctggtgatttcttcccttttaaagtcgatggtactcaggaatataaggcaatagatctaaacattaagatcatctaatagcttagggcttattttgggcttaaagaagattaagaatgacagaatttacaggcccacattttgacgtcaaatccataaatgttcagtgatggcatggctcctttaagcttctttgtttatctttatggaacacatatgctagaactcaggacataactacctaagagtctgtctttccatttgtacataataaagctcaattgttttgctttgctatagcaagattgtgtacatctgctgtgttgccccttctgatttcataaatggattcaccaacagcattcacactgtgcacatctgctactctagtatgttttctcccataaaagcagaatgttgtaaatcttggtttctcaaaacaaacaaacaaacaaacaaaagtgggatggagggtggagattgtcccctcataggttttatgtgaaaactactagtgtcaattaggaatccacttaatcagaacagcagtttaaggaaacctatgctggcttcaaatgttgttttcccaaaagaaaagagatacttcctttttttttaaactcagattcatgtgcgagtctacattgcttgcttttaaaaatagtattccagctgggcagtggtggcacacgcctataatcccagaatttgggaggcagaggcaggtggatttctgagtttgaggccagcctggtttacagagtgagtaccaggacagccagggctacatagagaaaccttgtcttaaaaaacaaacaaacaaacaaacaaaacaaaacaaaatagtagtccatagtacaattaatataatagcctattttgttttgttttcttctaaggtctcagtaatctgtcttttcagactgtttgtttctaattcaattgatctctcacacagtcttgccttcttctgcattttatcactagagtaaaactctctgcatttctctgatttctttctatttcccccaaagcatggcattgagaattagatgcagtgatgcatgggttggatgcagttacttcagacatccttcaggcaaccacagataatttaacctaatagcctgcaaatattctcttctacagaaagttaaagtttttctctcccccccccccactttttgtgtgttccaatgaaagatggatttcaaggatacactatagaggctgtagtaaatgtgcttagtctaagctttgacatttgatttttgttttaaaaaggacctgccctttactaacttaaaagactctcatttttcatagtggcatgaacataattggccagaaaacgaagaattctgcaaggctctgtggttttaaaaatcactaagatcatctatgccacagggattctacctggcactcagcaataagtatttatttgaatgaatggaagaaacaagtaacaaatttattacattttttccacccaaccaatcggtatggaagtgtcattatgtagaagttaaagatctaggggctgggtgcagatatattgtaaaatatcccccagaattttacttacatgccagtggagtaagagagaaaccataaagtaacatgataaataaaacatgcatattaaaacattatgactcttacagtgccaagttaatagataacactcaatagaatgatcaatacatagtatgtatgtggtactttaaatataatgcacccaggaaaggcctcatacgttgctgtgtgagtgatcaggtaagagtcgtgtctacacgcagcacagtggcagattccaggtagaatatgaggaggggagtgggaagaaccttctcactgaattgagagcaattatacacctgctatatttatgatgcagagactacaaaaggagtaaagatggttataaagagagttaactccattgatagttaacattatcttggtaatagttcagttcaatggggaattggtttgcagaattttggttaagtaacctttcctcagactgtgaatcaggggaaaactatacagcctttttatccataaatatagaaaacatggggatgagttggggaaatgtcagcaagccacctttaagccatgcacccaagaatgctgttttatcatcggtgaaatgtagagagaagaaagggaattttgtttaagactgtacagttgaatgctatacgttttatattatatactattagtgtgtttaataagttgtcttcttatatttccaggattttaatcaaatacatgtcctcaaaagatcttactgcctcagcatattgatatatgataatattaatatcaattatactatatatcccttttcctaccaactcatgtggggtgtgtgtgtgtgtctgtgtgtctgtgtgctttcaacacattggatattttatgtggtgattataatgaagtatagagagaaaaaattttttttggttttttaagacaaggtttctctgtttaggcctggctgccctggaactcactctgtagaccaggctgtccttgaattcagaaatccacctgcctctgcctcccaagtgctgggattaaaggcgtgcaccaccactcctgacttgagaaaatgttttaaatattgatcacctgaaactttattaaagctgacatatcggttttatgtgtacttttaattcttatccaaatgagttacttttactattccttacttattattgctactgcaaaggttcactcttcaaagtggctagctgttagattctaattacagttcagtctttaaaagtccgtctatacctttgtcgagtgtctaatgtctatgtagggagaataattctcatacaagctgagagtactcattaataaaacagaattaataatgggaaatctcgcctatagatcttgtaaaaatataatactgcaatgcccaacaatattcaatattttttatgtgcaacttaaaccattgttaaacacaggtcaatcacatgaacaagtattgtcacttttacattttgggtacctggatatagacccaattagctgtttctaatctcagaggagagagattaacaaagaaaatagacaccataaactaatataacacaatagttgaattgtgttaaagtgctacactaacaaatttaacggtaatatggataaggaaggcgagccctaggatgaggaagagaccataggtatattcacaatggtttaatatgttgtgttacatgagttataagagaagtagaaaatcaatgtggaatattatttgtagataagaaatttaattgtttagttttgaacaagagtagcagttcaactctgatctcagtcgtttgagtattttctatgtgctgaatggtcaagaaggatagataaaacaacacaattcattaaactaaaaccatgttaaactatataataatctgataaggatgcatcataatttaaatttcaaaattagcctacacagagtgcaaatcttcatgtctcatttcaaatatgtaaactaggctgatgtgttttgcgactaagaaactgacattgttaacaaagcagaaaaagatgggtaccaggatataccattatgtaaacactaaactagtctctaaacttccaggtgttattttttaaaaattatcttgtatgaacttttgttagcttatgtttttaaataatttcatgcagctttaattgaaagctaatatttgagtaaataatgttcaaaaagatagtgaagtgataaatacaagtaaaaactattgaaaggaatattcacactcccattaaatctaaatatgggacaggaaactttactgtgaatcagggtacttgcctttccttcacaccatcagcattatcctttgtggcaatggtcctatgagatgctgatgggactttggtattctgcaggaaaagaattagtgtctcagagatgcctgtgtcatgtgacggttactatggcaactagtttgaggcatgccattgagttaccaagtaaataatctcataaagttgatattatagctgacatgtaaattaaggctgccctgtctctgtcaggtttttttctattctgaattcccttgctttccatatttaatagaaaactgctttcccttacaaaaactaaccgaacatcatttgaattcacagttgacatcctactgtttcttattttagtattccatactttggcactaatttttcaatactacattgaggttacaacaagagatcattaagttgttatacataagccaatagagttgcacttttctcagtgtgtggtgtgtgtgtgtgtgtgtgtgtgtgtgtgtgtgtgtgtgtctggggcacaggggtcaagatgagcaaatgatagaacctgcttttagaattttctctgccaaacttatttcttttcactttatggtgctgatttccatggcttctattttagtgtttgctacagtatgctaagctgcttgttaaaagctgtctctgtttatttctagaaacaacctacattttctcagggtgtatacatgtggccttcttcccaataaagcacttagatttttatagccatagatgcctcatcattcttaagagctgattttgattgttcaacataatccctattccacaggcatctcacaacattattttcaaatttgttgctaattagctttaacgtgcagctagaccaaaagatttacaatggaagaatgaaagagtcacacaaacttttttgaaaaaaaatattgtctttatctgtttaaatttttaattaaaaggataactatatcattctccacttttttccttccacccatcccaattccaccctccatccccttccatgtcctaccctttctttcaaattcagtctctcattttttattattagtgctatatgtaatatttatttgtgtgtaactataaacccattcttatatataaccaaaaatctatgagttttatttggatattgggaagtctttagcttagcaatatatagatgtaatagattattttgcatatttctgcaatgattgctcatatatgtgtgaccttgagaaaatgatgttcaaggacataagcagaaaatgaacatttttttccattttttattaggtatttagctcatttacgtttccaatgctatactaaaaagtccccccatacccacccactcccactcccctacccacccactccccctttttggccctggcgttcccctgtactggggcatacaaagtttacgtgtccaatgggcctctctttccagtgatggccgattaggccatcttttgttacatatgcagctagagtcaagagctacggggtactggttagttcataatgttgttccacctatagggttgtagatccctttagctccttgggttctttctctagctcctccattgggagccctgtgatccatccattagctgactgtgagcatccacttctgtgtttgctaggccccggcatagtctcacaagagacagctacatctgggtcctttcaataaaatcttgctagggtatgcaatggtgtcagcgtttggatgctgattatggggtggatccctggatatggcagtctctacatggtccatcctttcatctcagctcnnnnnnnnnnnnnnnnnnnnnnnnnnnnnnnnnnnnnnnnnnnnnnnnnnnnnnnnnnnnnnnnnnnnnnnnnnnnatattgtgtgagttcctttgtgaatgtgttacctcactcaggatgatgccctccagagccatccatttggctaggaatttcataaattcattctttttaatagctgagtagtactccattgtgtagatgtaccacattttctgtatccattcctctgttgaggggcatctgggctctttccagcttctggctattataaataaggctgctatgaacatagtggagcatgtgtccttcataccaattggggcatcttctggataaatgcccaggagaggtattgctggatcctccggtagtactatgtccaattttctgaggaaccgccagactgatttccagagtggttgtacatgcctgcaatcccaccaacaatggaggagtgttcctctttctccacatccacgccagcatctgctgtcaactgaatttttgatcttagccattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttgttcgattttctgaagtccaccttcttgagttctttatatatgttggatattagccccctatctgatttaggataggtaaagatcctttcccaatctgttggtggtctttttgtctaagggccagaaaatactggttcagattgccctgataacgaccacctccaattatttccctctgcattctttatccaagcttccacacttgagttttttccctccattctccagattcagtctgtaaatattctaggggtaaggtagtggacatttaagggatgcaactgcatggggatttcgaaagtcttcttttcatgaatgagatatcgcaaaagtttcatctaggaaattctgtgtgtgttctgttgtatgtaagttactgtgatggccatttactgagaggatgcgcaatgaaatcatagaaacaagccacaaaattaaaaggcatatagtgtttcagataattatagcaaccaaatgtgtcgaaaagctggaagtatagggaaacagttggaatggataaggaacaacaaagttaggtttccttgtctttcatataatccttgatgaatagttaccaaatgaagaaatatggcatataggtatctgggaataaactatggatgcagaacaggcagtgttgttcagtagtatgtatttgtctagtgtgtgcaaggcctagggtttgatccatggcattgaaattgagagaagatttagtaagtgctgttctctctgactagaggatatcgtggtattaaaggcacaacaaagataaaagatgttactaagtatctgtagataaataaaatttcaattatagagctttaaaggatttggaagaaattcactcgtgcattttttatttataactcacagcttttcattggcttcaaatcttatctcaaaaataatgtaaatgatgcaaaaactgaaaattaaatggagagaaatagatttttctaaatttaccttgcagtctcatgtcctccagcaatcagcacctttgcctctagaagttccttttttcacaatgaaagatgtgttgctacacaattatgccatagcaggtgagaataaatgctttagttattttttgtgaaattgttatcttagcaaatcttttcaacaagtctgtgaagtgggtattttcccctctgttttacagatgagttcagaacgtgttgttgtttcaggtcacaagaagcagaagttaaggcttcttgatggttaagtatacccaaaacacataggtagtttttagaaaatataatttatttagttacatcaaaattgagattcatttcattgttgcttgttatagacatggaaagctaaacaatcatatgggagtgcataaataaaggtatcaagattggagctcaagtgaagcactcaaaagtctttactttggcattggaaatgaaatgttgagtccattatgcagtcattaatcattgattcagtcatcactcattaagtatgtcattcagctattattacacaggtattattatccatcaggcagcagtgtaagagatgaagataaattcttactaaaaccaactaggtctttgtctctacatagcatgtatgtagaaaaagagccaatcacagatgcttataaaagtagctttatttatttatttatttatttatttatttatttatttattttttgcaccagtgtctattagaaagaattgaaatcattggatagagtctgatgaggaatctttcacaaaaggagaacagctcaaatatatctttaaataataagaccttttaatagaggcctgggtaaatataggggctagctactggtaatagggaaatacttcagacagggtgaacagtggttatataggcagggctatgggacacattaggatgtgtttggaaaacagactttgagaagaatgagcacacatatgcatggtagcatctgtgcatatggatgcacatgcatatataaaaacagtgtgtgtacttctatttaattgaaagctttagctggagggcagtacggggatcttaactgaagtggaaaagtaaacactgctctgtagaacattacgattgggtgcaagggtgcaaggatttgttttggttttattcttagcttttattaagtttatttctgttacatacgttctcttcaaataaattctttcacatattaatcacctaaggtcttgtaggtactgtctatttgtataaacatcaatgtctacattcatgtggaatatcagcattcctctacttctctatgaggtagatttgaatgggtacattgtgctttctgaataattaaggaatatcactgggaagcaaagcatacaaactaccatgcaggacaggaagtatatgaagatttgaaaccagaatgatgcagtttagaataaaatgataccaaggttttccagaacaggagagatatggagggaattgtcctatacttaatccttctccccaccatcctttcaccttagaggcagtttgttatcaattctccagataatggttgttgaataagttctaaatcatcatctataatcattcatgtgacagtgcaagacaggaaagttgaaagcataatccaggtgaacaggatgatgtgatcaatgaccagggtgaaatatagataaaaataactatgcaaatggaaatcaacaaagtgaggaaatgactgaataaagagagtagattagttttagaatcaggctaatgaaatctctagtggatgcattttttttttagtgtgtttcccatcacagacatggttctgttttgccaatatcaggcacatgcaaatctgtatccatttcatgaacctttgaataaaattgacctacccttcccccctcactgctttgggggtaataaaatctgaaaatcaaaaactcctggagtgtgtattgatgagctgatgtttcatacttcatgatgagtgtgtctgtacacatatataagggcaaatgagcatacatatgcacgtaaaggtttgagtatgacatgaaaaatctcccttgattgctttttcacctaattgtttttatcaggcatctctatcaaactcagagcttgcagatttggctagtctttcaagctttctcaagggatctttatttcttctttcccaggtggaattgcaggctgctcccttgcttactcctccatttaagtgggttctgtggatctggtattcttcactgaatgacaagtgttttaagtgctgagctatctccctagttcaaacattgaattgattttttcttttatttatgatggtttaatatagtttcatcatttcttcctttcttttcttccatccagtccttctagaggccccctcttcttgtcttttaaattcatggtcttagttttgaatgtaattatatgaatgttttgaaaaagataatgtgtatgacataaatgtaaacattattttcattaaatgacatgtgtttaaaatgtattaatttaaaggagtgaaataccttttagacgtgacagataaatcagaaaagtatatgtcatacctcagatgtgaggcagaaaaatgcttttgctcatcatgtctgagtcaagtaagtctaatacctgggactcactagaagtgagacatagtagggtacattctgtttttacaccttggatttttattccttatactttcctatgaagaaagtctgagatacaaattgtgcatactaaaactttttgaggttgtgactaatgtttaatctaaaaaaacataagctcataattagtcagtaacttgattaattgtttagaactaaaatttcatggatttactcaaaggatatctgaaactgatatcaaattcgacagatatgtcatgaataagatgaagtaaacaccccaatatggtccagtctataagaataaaatccatttcagtttctcctgtttgtagatatatacaaggtagacttagagcaatgtataactaaacaagagcttgtattgctcctgctcgcatgtgattctgaaataataatgaacactaacaatttttaataattaacattttttctaaacaaaatattttcataatgaattttgcacataaattcgcttagagtcaatgtgagtgtaaaattctatatcatgtgctaatttttctatagagaaaaatagagtgttacatatcatcgtggcaacttctagtctaccatttttgaatgcagttacatatttagatgattttccaaattgacatatttttactttgctcttataatataataacataattattaatgaaattattcagattaatcctatatattataatataattaacattaaaaccaatgtgtaggtacaacacaaacagtgaacatttacttttcttttaaagatcaaaacttctatgatggtctttcttatgactctttctttgatcattcaaatctgagagatggcctctctgaaatccatctagtttactaatgcatatgacttttctagtaaggacacaaagcactctttatttcctttaaatacccactacaaactatgtatacttaaagtatctgttaaatgaatgtctaaagaaaaaacattcaatttatttaattttaatagtcatttccgaggctcattgtcaacataattacttgttttgacaattgtccatatattctcatatgcagagttgttaaagttcaaatacaagctctttcagtgaggtatattataactgacagaactaaccactgaaataagcgttaacacggacagaataaacatgaatgggcagctaactcagaagctcgttagctgttcttatttgactttgattcttcccctggcgtttgttctctcagtatgctctgagcattcctagtcaatctcaccttcttcttaaagaaaaatgttcatgctgagttctttaacctatgatttgaaatataagatatcagagaaagataatgtttacaaataccttaataagagtttataactagaatattatttctcattacacactcactcaaccgaggatattttggggatacaggctgtggtatttcccacaaaaggtgggatatatatatacatatatatatatatatatatatatatatatatatatatatatatgtgtgtgtgtgtgtgtgtgtgtgtgtgtgtttaaaataaacagactatcagccagcctatatataaaaacaaattaaaatgttgtggaaaatatgaagacttattttaggaatggatatagaaaatgataaatccaatggttcacagacaaactggtctgggaaagggacttagtcttcagaaggacttaggtgaatcatatcatcaattaacaatttaaacaagtgtctacttgcttacactgaaatgaaatatcagggcccagtcaaactaaaagcaacttgaaaacagggaattataggagatcttaataattaaaagaatgaacattagtgttctaaatgttttaaagtcactgtgggaacagagcacagtaacatcataacaataagagttagcttgaaaattatatacaatttgcgattatatatgaagccaaagtaatttaagtataaacgtaagtagttaaaaaaaagagtatgtaggtagctaaacagtatggacggagcttgggaactcttatgaaagagtaagaggaagagttgtgggcccggaggggataggaactccacaggaatcaaaacagagtcaactaatctggacccttgggactcagcgtctgaaccactaaccaaagaacgtactccggtcttacctagatctctccacacatatgtagcagatgtacattttggtttaactttgggtcctgaaaaagtagaatggtggctatcccaaaaaggtattgcccatactcgagatatgttcctcgagcttggctaccttgtctggcatcagtgcgaaaggaagtgcctagcactgcagagatttgaagtgccaaggttgggggatacacaggggactcccacccactcagaaggaggaaaggatttggataggggtggccggaagtaggacagtgagcaagatgtaaaatgaataagtaaaataaaacttaatttaaaaaatgtgtgtagaatggtgaagattaccttgaggtcctcatctacagaggaaaagacagaaacttaggcttagcagagaatcaaatttagcaaaataaagttggtcgcctctccatatgaaagactgtgtgctgaagatgtttctgaaaactatggggaaccttatgtatctgtggtctttaatagtagcacatggataaaagatattattatgtcctttattgtttaagactattatacataacaaattaatatggattggttatagaagtgtattgcaaatatgctcttaaattctatttggttaggaaagatattaggcatcttgattacataaactttaacttttgttaaaatgtataaataaaattcaaagactaaaagagggaaaaagaataaggaagatgatctaaccaaaagttggatgaacatgttaataaaatttatggagaccaactaggaaaaagaggcttaatctcaggagttaagccattaaatatgaaaaagacaaaatatgtgttaattcttacttacatatttgttttggaaaaatatgagattaatgaagcaaaatgtaaataatatcagagtatagaggttgtgctggttgtgatggtggtatacatgtatatgtaacaggaaagtaatcacaataacaagctaggacatatatatggctgccaagtgaatgtagtgttttataccctttacttaatatggaatttaaattattcacttttctgagctccttctatacagttttaaaatatgtgcaatatagtaatataccttaacttttgtagttacaatgaaatttcattgtttgtagaatatttcccagagaaaacaaaaatatgtgatacatactaaccatatgaatgggattaaagaactacaagatgcacaagatgatactaagaagaggaaatagaagatattttaaaatgagaaagattctttcacttgaattataggggcttagggaaatgacttaatgattaaaacagttactgcccaagcataggaactagaatttagattcctggatattcataaataccaggaggttacagcagcccagttgagtttctagcaccttgaaaatagagatgagggagtatgcctatagcaagatggctatgcagactaagcatattagagaactctggatttaattcagagatcctaattcaattagttgaatgggtaacaatcaaagaagactcctgatatttctcattctctctctctctctctctctctctctctctctctctctctctctctctctcatgcacacacacacacacacacacacacacacacaaacaaacacatctcacaacatttgcttaggaggaaaacatccttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactgggatggttggacacgcagactttgtgtgccccggtacaggggaacgccagggccaaaggggggggagtgggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatgaatattgtctcctagagtataatattgggacgtaattgaaactctatcatggcagttggctaaaaaggtgattaggctctgtatgagtggaagagcagaaggacaatcaggaaaatgcttatattatattttttgattaaggaaacaagggaaaaaccacacattccttgatagaaacagaaaaaacctttgaaatcacaatacttaaaaagtgaactactctgtgttgtttgtttgtagaggaaaagaagacagtggctataaatgaaaggttgtacctatgtatcaagacatatgtactcatttgtgtgtgcaggagtgagggcaaagatttgatcattctttaaaagaataagccagcagcatagtaaccaaggtgaaagtaaaactaaaggtgtaaatgacagataggggtactatcaaagacaagagaggttaagtcaagaacatagatggaagaactagtccaatgaaaggaaaattagttgctttgacatttgaagaaggaaactgaattcacagtagtgagagtgataagagtctgcatgtgggacagacaggacattgaagtttatgcctctcagcctaaaattagtctgtggaaaatataaaaacaatgttcacttttgaggagaaaatatgtgtatgtcttgatgatatgtcttttctttatgaagagtctgaacagaggaactggagagctatgttaagaatttctattaaagagaatgaatttatgaaattcctagccaaatggagggacctggagggcatcatcctgagtgaggtaacacattcacaaaggaactcacacaatatgtactcactgataagtggatattatccccaaacctaggatacccaagatagaagatacaatttcctaaacacatgaaactcaagaaaaatgaagactgaagtgtggacactatgcccctccttagaagtgggaacaagacacccatggaaggagttacagagacaaagtttggagctgagatgaaaggatggaccatgtagagactgccatatccagggatccaccccataatcagcatccaaacgctgacaccattgcatacactagcaagattttatcgaaaggaccctgatatagctgtctcttgtgagactatgccggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcacgggaaagagaggcccattggacacgcaaaccttatatgccccagtacaggggaatgccagggccaaaaagggggagtgggtgggtaggggagtgggggtgggtgggtatgggggacttttggtatagcattggaaatgtaaatgagctaaatacctaataaaaaatggaaaaaaaaaaagaatttctctggatggctgagagcatccatcgttgtatttgccaggcactggtaaagcctctcaggagacagctatatcagactcctatcaccaagcacttgttggcatccacaatagtgtctgggtttgttgactgtttatgggatgtctctccaggtggggcagtctctggatgacctttccttcagactctgctccacactttgtctctgtaactccttcccatgggtatttagttcccccttctaagaaggagcaaagtatccacactttggtcttccttcttcttgagcttcatgtggtctgtgaattgtaccttaggtattctgagcttctggactaatatccactcccttggtcctatgaaggctctatgccccagtgcaggggaatgctagggacaggaaatgggagtgggtggttggtaagcaggggaagggggagggaatagggagttttcagaggagcaaccaggaaacggaataacatttgaaatgtaaataaagacaatatctaatttaaaaaaatgtattttaatgggaacactagtttccaggccattgtgcattttatgatttttctgtaggtgggcaatcctttcacggagctccaaactatctcactgatttcagaaaaccatgacatgtccacctaagaagaggatatatagtagtaatttggcaaggcttttgtgaaacagacgaagatttcagttttccaaaatatgcatatagaggttgcagtactaattgaacacataatctgtaactacaattttgtaaaatgattaatacactgctagaactccaaagagtcatgcctagtgacaggcttctctatgtcccttcaagaggatcacactctaagtgacacagggagagcagcatcctcctgagttgagtggcgtgggctgatgttggacttctgtgatttattaaatgtccttctgtgatatttctctgtaacccccattctcttgttctgaagagaggtgtcaatctgattggtgttttatgagcacaggtcataaggtactttccaagttgttgcagtcatccattgagtgttttattgttttcagataccttaggtagccagcaaaaaaaacaacaacaacaacaacaaaaaagcaaaagttttcatcacacacaaaagactccacatacataccttaatagctttaaactattattctcactgcataatgtttaatgtcacataagcaatgcagaacatatgactacctcttatgtaccagctattactcccattaatcatcccagtacccagtgaggtagatgttttggcatagaatactgagtgtaaggatccttctagatttagttaatactccagtatcaattgaattcatatgatgtctgaattgaacaactgtggaatgaggggaatattgaattatttgtcttgtctgtagttttgatggacaaggaaaggctgacttcttttagtattcaaatatcaactttatcatcagtaaatctatatgtataaatgcacataaggtccaaatccatttttcaccagtccagtgttactagtaggctaaaatttgtccctagattggggatcataattatggagtcaatacatctcatggataaagatgtgcctcatcacttccaagaaacaacagtacaaaatcaatgctgcccaaacccctgactatgtgaggagatgacctccagacccacaccttattgaggagctattagcatttgatagatactaaggagagcctctctctgtagccactggtaagttttcattgtctaaatgaccctatatcttatatgggtaaattgtaccaccattttcctaaactaacatcatctccaattttattctaaatatttattgttatagtcatggataagtgtgactcaaaaccctcttcaaaaatgcttccatttgcaaaaggtatagactcctaaggggatccaaaaactaagtaatcctgatcaaaaatcagaaataagtgaccactaagggatgcctaaccaatcgatacatcttcaacacaactcctataactaaggttcaaagaaaagtcacctgagagagagagagagagagagagagagagagagagagagagagagagagaagaaagattacaaactcaaagctctagtacatctatgctacatagtgtcccctctagaaataaaacacaatatatacccatgaaatatcaatattaatgttccttatatataaacagtaaaaaaatagaggaaattctataaggtctttttcataactgagtatctacaggaaggcaatgtcttctgattccatttcctacaagagtaggctcactcataggctgtctgttcatttccaagtgctcatccatggatgcatgtatatacgtacaatgcttgatagattcaattagttgtatatacatagtgtgtgtttgagtatgggtatgattatgagtttttgtagcaataattaaagaatttattaaattatagaaagcaggaacatgaagaaattgagaggaggaatggaaaagagtgacataaaggtgtttatatgtaacgttcttgaaattttttattttctgatgtgggcatcctatttacgttggtctgctccacataaaataaaatcattaaggtggtaaaagcgcccccaaatttttctttttctttttttttttattatttttttcttttttttttttttttactctttttttttttactctttttttttttttactctttttttttccattttttattaggtatttagctcatttacatttccaatgctataccaaaaagggccccatacccacccacccccacttcccctacccacccactccccctttttggccctggcgttcccctgtactggggcatacaaagtttacgtgtccaatgggcctctctttccagtgatggccgattaggccatcttttgttacatatgcagctagagtcaagagctccggggtactggttagttcataatgttgttccacctatagggttgcagatccctttagctccttgggttctttctctagctcctccattgggagccctgtgatccatccattagctgactgtgagcatccacttctgtgtttgctaggccccggcatagtctcacaagagatagctacatctgggtcctttcaataaaatcttgctagggtatgcaatggtgtcagcgtttggatgctgattatggggtggatccctggatatggcagtctctacatggtccatcctttcatctcagctccaaactttgtctctgtaactccttccatgggtgttttgttcccaattctaaggaggggcatagtgtccacacttcagtcttcattcttcttgagtttcatgtgtttagcaaattgtaccttatatcttgggaatcctaggtttggggctaatatccacttatcagtgagtacatattgtgtgagttcctttgtgaatgtgttacctcactcaggatgatgccctccagggccatccatttggctaggaatttcataaattcattctttttaatagctgagtagttctccattgtgtagatgtaccacattttctgtatccattcctctgttgaggggcatctgggttctttccagctatttcctggctattataaataaggctgctatgaacatagtggagcatgtgtccttcttaccagttggggcatcttctggataaatgcccaggagaggtattgctggatcctccggtagtactatgtccaattttctgaggaacctacagactgatttccagagtagttgtacaagcctgcaatcccaccaacaatggaggagtgttcctctttctccacatccacgccagcatctgctgtcacctgaatttttgatcttagccattctgactggtgtgagttggaatctcagggttgttttgatttgcatttccctgatgattaaggatgttgaacattttttcaggtgcttctctgccattcggtattcctcaggtgagaattctttgttcagttctgagccccattttttaatggggttatttggttttctgaagtccaccttcttgagttctttatatatgttggatattagccccctatctgatttaggataggtaaagatcctttcccaatctgtcggtggtctttttgtcttgttgacggtgtcttttgccttgcagaaactttggagtttcattaggtaccatttgtcaattctcgatcttacagcacatgccattgctgttctgttcaggaatttttcccctgtgcccatatcttcaaggcttttccccactttctcctctataagtttcagtgtctctggttttatgtgaagttctttgatccacttagatttgacattagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtacagctttaggtcaggcatggtgattccaccagaggttcttttatccttgagaagactttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagttacgccaagatattttatactatttgtgactattgagaagggtgttgtttccctaatttctttctcagcctgtttattctttgtatagagaaaggccattgacttgcttgagtttattttatatccagctacttcaccgaagctgcttatcaggtttaggagttctctggtagaatttttagggtcacttatatatactatcatatcatctgcaaaaagtgatattttgacttcctcctttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttgaatcttgtcaaatgctttttctgcatctaacgagatgatcatgtggttttttatttgagtttgtttatataatggattacattgatggatttcagtatattaatccatccctgcattcctggaataaaacctacttggtcaggatggatgattgctttaatatgttcttggattcggttagcaagaattttattgaggacttttgcatcgatattcataagagaaattggtctgaagttctctatctttgttgaatctttctgtggtttaggtatcagagtaatagtggcttcataaaatgagttgggtagagtaccttctacttctattttgtgaaatagtttttgcagaactggaattagatcttctttgaaggtctgatagaactctgcactaaacctgtctggtcctgggctttttttggctgggagactattaataactgcttctatttctttaggtgatatggggactgttnnnnnnnnnnnnnnnnnnnngtgatatgggactgtttagatggtcaacttgatcctgactcaactttggtacttggtatctgtccagaaatttgtccatttcgtccaggttttccagttttgttgagtataaccttttgtagaaggatctgatggtgttttggatttcttcaggatctgttgttatgtctcccttttcatttctgattttgttaattaggattttgtccctgtgccctttagtaagtctagctaagggtttatctatcttgttgattttctcaaagaaccaactcctcgtttggttaattctttgaatagttcttcttgtttccacttggttgatttcacccctgagtttgattatttcctgccgtctagtctactcctcttgggtgaatttgcttcctttttttctagagcttttagatgtgttgtcaagctgctagtatgtgctctctcccgtttcttcttggaggcactcagagctatgagtttccctcttagaaacgctttcattgtgtcccaaaggtttgggtacgttgtggcttcattttcattaaaatctaaaaagtctttaatttctttctttattccttccttgaccaaggtatcattgagaagagtgttgttcagtttccacgtgaatgttcgctttccattatttatgttgttattgaagatcagtcttaggccatggtggtctgataggatacatgggacaatttcaatatttttgtatctgttgaggcctgttttgtgaccaattatatggtcaattttggagaaggtcccgtgaggtgctgagaagaaggtatatccttttgttttaggataaaatgttctgtagatatctgttaggtccatttgtttcataacttctgttagtttcactgtgtccctgtttagtttctgtttccacgatctgtcccttgatgaaagtggtgtgttgaagtctcccactattattgtgtgaggtgcaatgtgtgctttgagctttactaaaatgtctttaatgaatgtggctgcccttgcatttggagcgtagatattcagaattgagagttcctcttggaggattttacctttgatgagtatgaagtgtccctccttatcttttttgataactttgggttggaagtcgtttttatccgatattagaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattaatattaagagatattaaggaaaagtaattgttgcttccttttatttttgttgttagagttggcattctgttcttgtggctgtcttctttttggtttgttgagggattactttcttgtttgttctagggcgtgatttccgtccttgtattgcttcccttctgttattatcctttgaagggctggattcgtggaaagatattgtgtgaatttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtaggcttcttgtatgatcatgggcatctctttctttatgtttgggaagttttcttcaattattttgttgaagatgtttgctggtcctttgagttgaaaatcttcattctcattcactcctattatgcgtaggtttggtcttctcattgtgtcctggatttcctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttactgtgtctacttccctttttagttctagtatggttttgttcatttccattacctgtttggatgtgttttcctgtttttctgtaaggacttctacctgtttggctgtgttttcctgcttttctttaagggcctgtaactctttagcagtgctctcctgtaattctttaagtgacttatgaaagtccttcttgatgtcctctatcatcatcatgaaaaatgcttttaaatctgggtctagattttcggttgtgttggggtgcccaggactaggtggggtgggagtgctgcgttctgatgatggtgagtggtcttgatttctgttagtaggattcttacgtttgcctttcaccatctggtaatctctgaagctagctgttatagttgtctctgttaagagcttgtacttcaggtgactctgttagcctctataagcagacctgggagggtagcactctccttggtttcagtgggtagagtattctctgcaggaaagctctcttcttgcagggaaggtacccagatatctggtgttcgaactggactcctggcagaagttgtgttccactcaccagaggtcttaggatcccgtggggaatcctgtgtgggcccttgcgggtgtcaggcgactctgctggcaaggaagcccggggctcgagtggagtggaaggggcttttgtcccgggtcaggcccgggcagtctgcttccctatgtaccgcagtcacaggttctgcccttaaaaaatttttaagaaagtttaaatctaataaaattaagaggatacattattgaggaacacaatagttgaatgtcgaaatgagtatgtaaattatcatatgtccgtgtatacatttataaaatcctcaaaaatataaaaaagaaccactggcaaatgtcttatatgcttcttatgtgccaacaagtggtgatatatacttctgcctcatacctctaagaaaggcaaagctgtatcaggaggaaaaaaaaaacaggataattctctctaaacatggcacatatatgttctgtaaaaccaaaacaaagcatcaaataaacaagcacaatcaataacaaatcaatccttcaagctgcattcatttaaaacatttaggtttttcctttctgcttccatactgtgagcttgatggatgagtacattgattcattcaggataaagccccaggtagctcacacaccaatatcagtgaaaaagcactgcatccgaagaattcagtgtgctagattcagagtacaaacccccactgctttgtgggcagtgcacagatttagacttcaggagacttgtaaaggctacgttaaaaagccacagttcatcgggctggcattattaggaactgtcacataccagctatgcattaatagtagcctaaactctgaatcctctatgaatatgtgcaggtggtagaatgctctccctttctgtggcatggtctacataagccatagagaaccagttctttactgtacatgaatatgtcttgatagctcaattttttgccagacagtattgcttcaagagtgtggttgtatctgtcactcatgaagactgtgagtggctggctctttctttgaatgccaatagtatgtatagacaaggatttctaaactttcaacataagcatgattattttgcttcagtcaatggtaggttcaacaaaactttgtaattattatacagacactattttatggattaatgagtgaatgaatacgaagaaaagtagaaccagaactagtgttaatttttccctccactgagcccctgtattgcttcccctttgtaatacatgcaaaaaagagaaacaaagtaaggctgtgtttctatagcgaaacctacctctcttgtatacgctgatttctccattctccgatctgaaagacatgatcatttcctttgcaaatatagcacaccgtatcaacagttaacttgacatccataaaataatggctctaattcttgtgcaagacatacatttgtttgtcttcatttcctttgggaaaggataaaaatctctcttttaaaaatgatccccaggtattaaattctaaatcataacaacagctagcattttcaaatgtctgtatgcatggatgctatgataaacacttgacatagattatctcatttaatcctcacagaaaccaaatgaagtgtttaccgtcattatctctatttgatgaagaggatactggggctcaaagagacttaataacttgtccaagatcacctaatgctgaataatcaagaatgagtgccatgaaagaacaaagaccagcctggaccagcatatttttgagaggataagccacagggtagcaggtgagcagatttctctattctaattgaactggacacctaaatatcagaccaatagtggcaaaagaactcagccatgggcttatctcattgagaggatcaccgaccttctgaaaaaaaatcagaggttgaatctgatactttgaagttgcatttctgagaagtaggcaagtgggttgacttatcgtttgtaactagctcctgaaggtgatataagattcatgtcatcttgcgttttcagtggtgtggtgtcagagattgctggtcatgagcttttcttcattcccatgaacatcccagaattcctgacttaaacacttctctctgtagacagtttctacaagctattgatagtgagtttccaaataatttgggtctctggtacatgataactgcatttcacgaaggcaagcctgctgtgtttccaatctcacaaataactttgcctgtcacttaaaaaaaatcagaggtggaactgttctagaagtatttttttcatctaaaacctttagtcacatgctgtttacaagatggacttgttatgaagtggtgtgctcatgtcagaaacatcacaataaatagctttccccctatatacttttgtcttttttttttgtagttgaccatttccaatacttaggtaccattctctcatctttcatcttcatctcccccctgtggtactctgtgatccaatataatgtcaaatgtaacttggttgtggaaattcttagtcaatgtgttgttggccagaagattgatgagtttattctctggactgaaaatgagaagtggggacagggcaagtctagagtgacacaaaagaaatgaattgaaattcagaatttttgatttctctagtgaaaggcagcatctttgggaacttgtggcagatgcactgaaatactgttgctatcttaaactctatttgtaaataccataaatacaatttatttctgtctaaacatctcaatttaaattaatgtattcacaaactttatacatataaaatgtgtctcaacctaatagatttcatttatatttaactattgttaaatctatctttgcaactattgttaaaactatctttgcaagtcaatagatagttatgtgtcatagatgtgatatagtttttactctactgaaggtaataagttacttgtttttacaaggaagctgtgctcaaaaacaggccatgattcttctattgtgaaaattattagattctttgaattttcataagatggcaatatgatttgtatgtttatttatatcatactgtttatgtttgaaatgagataaatataataaggagaaagtgattatcatttgtgctttatctcacaaaattttatggttcttagaacaaaaaaaagcaatccttctagtagttttaattttcagattgtaccttttactgtaagtgttcttagatatgtagacagacacatatgtatgtctggatacagatctggaaacatgatctgttttctaaagaatacactgtgttgtctatgtagccagagagagcagggaagggcaagcagaggcacagacagagggagagggagagggagagggagagggagagggaggcgggacgagggagtgagataatttgtgaaaagcagagagattccttttttatagatttatgttgcaggcaatatttcaacctaagagcatggacacttatttgctacttggatgcccttgaaaaattacttcatctcctgcattgtttccattgttgtcagaaggaccgcaataacagcactgacctcaaaatttattatcaaaatcagtaaagctgtgcatatgaagaatgaagaattgtgtctagcataaagaaagcactcagcaaacatcttcacagttgttttttatttcataatgcataaagtttcccattactcaggaaaagtatgccagtcagaaatggtatcaaccttgatttgggtttcaatatttgttgattgtaaagtaagcctttacaactctctagttgtctcttaatggatatcaaggttgaatcagactatgtgtttagagccccccgtggtgccttttctgtgttattgaaactggattgcagagcactctctccagtctaccatggtaagtccacaatttctaaatgcattctgattcttgagtgaagcttctttaaaactcaaacaagctcatgcttggcaagaggagcagatatgagagcatcatcgaactgcacctccgagacccgagctggagaagaattaagtaaacaattcctttcactctcataaacaaactaacaaaaaatccttacttttaaatgggaggcagaaggttaacccaatgtgtgtaatattttttttcctattgaaaaaaaaaaaaagagagagagagagagagaataccttggcaaataagtagaaatatttttaggctgtgggaagttcaacagccttaagcactgttatgtagaagcacctatacacatctcactgcatttcaagaaggttcagccattgatgaagtgttacttgaaagccacctttctattttggcttctgctaacttcctctggtgtgctttcttccctgctggcccttttccatttgactttcttcctgatgccccattgtttgacttgctttagataatgtgaaaatactgactgcagatgccaagcatgagagggctcttcttcctcactgaactgcatgtagcaattcgcttttctcacttccagggtgactttgcaatcttttggtaaatacttcatatatgtacattgtggtcatatagatgtgaaaatgaacaattctgcttaataacttaatcatctcactccagtttcagagaaaaacaaaaccaaattgcagaaccaaattattaactatgcttttaagttttgagatggtttttaactctaataaaatggtgaaaataacagtggatttattgttgctactttaaacctttaaaatccaatgtctttcaagtaaaaaattgaatgcttgtccttttaagagagaaaatgtaaacttagtttaggtagcccatttatatatcacatggaagttaataaatctcaaattaaaacctgtacattaaatcagaccatttccagatatccctaaaccatgttatgcatagggtgcgtttaggaatgctaaaatcccaggtcctttttgtgttcagcacacaccctggtaagctaagaagaactagcaccctaaagtgcaccccctttcttcttgtgtacggatggctaagcaacaggaagcttattgcttttagtggattcttgtttgtttgtttgtttgtttgttgacagggtttctctctgtagccctggctgtccttgaactcactttgtagaacaggcttgcctcaaactcagaaatccgcctgcctctgcctcccaagtgctgggattaaaggtgtgtgccaccactgcccggtggcttttagtggattcttaaataaagtagacgttaaaagtgtatttttcttcaggggatgctttaaatacttcctggctttgcttcataatactcaagttgggtaataactgaactagattttgttttctgcccttgtagtagccatgccatttagggaagagaatcgccccaatatctaagaatacattgcatgttttctgtgtagaactatggaagaacagagaagggcaagcccatgtttacatgaaaagagacacagagtgaggctaaatatcactaaaagaaagacttagttagctaaattttgcatggtaagtggatttttactgggaatataatatattttaatatcaaattcctactacactgtattcccagttacctactaccttacccaaagcatgaagcaaaatgcaattgctttgctttctcctcttttttgtcatcaagatgattctcagccttaggaagaaacaacaaagaaaactcttgtgcttgtgtatatggtgtatttgtttggttctagtcttagatctcagtcttaaatgcattccactcactcaatggaccacaatgctttttaacacttgattgtatgttctcaagataatattattaagtaacattgcttgctgtttggacaaacttaagtaggaaacataaatatttcttttgttattagaccttggacaagttgattaaacttcactattgtttatttttttcttattttaaatggaaatagacaagatttttattttaatgttttatattataacataaatacatcatttcccatttcccttcccccaaatcttcccatatacctcattttgctctaatatatgggtgctttcattaattgttgatgtatatcatattattatgatatgaacactatatgatatatatatatatatatatacatatatcacaaacaaaaacaaaacaaaacataatgaaaataaataagtgaaaacactagaaaatcagtattaactactcatttacatgtcaaagaggtaaaatgacattgagataaacaatgttgagatgagcaaatatatcatccaaatgaccaaaaagaggagacagtagagcagataaacttgttatgtgcattggataagttagtagggaactatgaataatattgtaatagagaagtaactggaaattaatattcaatataatatactcctgctaaaatccatttatcattacatatatgggtgcatatatttcaaatagtcatatttataaatacatatgcaaacttttatgtttcaaaatataaaggcaataaggttatattaaattatgctttagaaattagataaatatttattgatccacatattttgaacatcgggctaaggtaacttctaaaccctgatatgataaccaggtgttctaaatgtgttaatttaccatctttagcaactataataagaattaagcaataactgcagagtgaaatgaggatcttatgttacattcatcatgtgaatcaaatctcatttacttgatcatataacttactttatgatagttgctaattctctatgctcagaaagtatgctttcagtgtagaaatgttgtagtactaaggagaccaaagtctatattttattccaaacttattttattctgcccctgtcagtctgtaggaactttagtcagattaacataaaaaaagcataagaatgtgtgttctttcttcttttaataaatgagtcacctaaataaaagtgctgagtagacagaatccatattcaagtaatcattgcatttcagaaacagcctgggtcccattacttactgaaggagaagggatactgtgcgaagtataaacttctctcacaatgctctgtgtgtcttactttctgcattatattgatgtggggtattgccttgaaggacttggatttatttttgaactcctgtcagcgctccataattaacattgcccagaagagaaatgctattttgcctcctgcatcatcaacataactgtcagcgaataagaaagtcctctttgccattacagctcttaatgtaggaagcagaatagagcagctggatggctccacactgggctgttaggaggactggcatttggtacgatacattgtagacccacccacatatttttgctttaaaaatgagtcttgaaatgacattttaatcccaatatttttccaattttctaatatgatatatctgctgatctcagcattgtttatctcagtgtcattctacctccttgacatgaaaatgcaaagtcaatgatgattttctaggttttttttcacttatctacattcactatggcttttgttcatgttgttgtttttgtttttggtgatctatattccaaaaaataattcatggttttctatcctgtaattttgctgaaatttataacaacaataggtaattaaactttccatgaaatgaaagatagtaatagctcagtcttactttactacatgagaggcatctaagcacagatctttaatagtcaaaaatttgtgcagcctctacatttgcagtatgctcaaaagtagcattaaataatgtaaggtaattttcttatataaggtggtgcttatataagaagttttaagtgcatgcatagtagtatattgaaatgatataggcacttcaaaatcattttgacatgtattaaaagttagaaccattcatttccaatacagccgagagattttactattatgtttctcctccaaactaaaaacacagatccatacaacagtgtttataagaatatttacagaaatattattcccagtatcccagagctgaaaataactcaaatgtcagcttattaattgataaacaaaatgttaaatatttatacaactgaaatcacttataaatttgaaaatataatgaaatactgatgtatgttgtaacagaaataaactattaaaacaattatgctgagtgaacatagacagaaaatgtcacatagtttaaaaacattataatgaaatcaaatcaatattgtattaaatgccaaaaataagcaaatgcatagaaagcaaaagtgaactcatgccaggtatcttctacagaactaagctaactcgtctcacaagacagtttcagagggtgagtctgagcctggatacctgagttcaactcctgggacccacatggtgtaaagaaagaaccagatcctgcaagttgtctctgacttctggatgcattcggtggtgaagaggcatcatcgtctgtccttacaaataaataaggaaatatgatttaaaaaataaaaatctaagaaaactacccataagcctgacacaaaaggaacaagacacacgggatgctgaggctgactttgttttttgaatattgctctaaaacactagcttcactactaacaaagaagtgaattcagttattgaggcaagggagatagaaatgataaaatgttcaaaaacacaattattcatgatcattttgcaagcatgtggtgatattaaaaacttctaaattatgctttttgatcaatggtatttttataggtaaattatatttaaatataactattacagagatttatgatatattagacttactcgtgaataacaatagagagtgagaacaaagtaaatgtagaaggaaattatgaataaaattcaatttagactttagattttatacatacctgatcaatatttatactgtgataacttcagagtatcttgtaataagtaaaacatgctgcttttatatttcttaagcacaggtggatacttactcttcacagttcaaagattgattgttaagtgttgttaataagaaaaaagaagtagtacttttggtcattgatacatacttggtccatcctttgagactcgctaaggaattacataaagatgaggaagcaaaaaatattttcttaggcaaacggatggatatagagggtatcatcctgagtgaggcaacccaatcacaaaagaactcacatgatatgcactcactgataagtggatattagcccagaaacttagaatacccaagatacaatttgcaaaacacatgcaactcaagaagaaggaagaccaaagtatggatacttcgtccctccttagaatggggaacaaaatacccatggaaggagttgtagagacaaagtttggagctaagatgaaaggatgaaccatcaagagactgccccaaccagggatccatcccataatcagccaccaaacacagacacaattgcatatgccagcatgattttgctgaaaggaccctgatatagctgtctcttgtgagactaggtcagtgcctggcaaatacagaagtggatgctcacagtcatctatgggatggaacacaggacccccaacggatgagttagagaaagtacccaaggagctgaaagggtctgcaatcctataggtagaacaacaatatgaactaaacagtacccccagagctcatgtctcttgctgcatatgttgcagaagatggcctggtaggccatcattgggaagagaggccccttggtattgcaaactttatatgcctcagtacaggggaacatcagggccaagaagtgagagtgggtgggtaggggagcagggagggtatgggggactttcaggatagcatttgaaatgttaatgaagaaaatatctaataaaaatttgaaaaaaaataaaagaaatactagagatgctgtttctctacatcatgatccagagtaagaatagaccacaggcaagaaaaaaaaagaaaagaaaagaaaagaaaaggaaaggaaaggaaaggaaaggaaaggaaaggaaaggaaaggaaaggaaaggaaaggaaaggaaaagaaaagaaaagaaaagaaaagaaaagaaaagaaaagaaaagaaaagaaaagaaaagaaaagaaaagaaaagtagagagtagaggaggtgagggaggggaggggagggaagggaagggaagggacagaagaaaaagaaaagggcaagcagtgtcaggtaatgcacacctattgtcccaacactagggaagcacaggaaggcagagggaggcagatctctgagttccaggccagcctggtctacagagtgagttccaggacagcctggtctacagagtgagttccaggccagcctggtctacagagtgagttccaggacagccannnnnnnnnnnnnnnnnnnnnnnnnnnggagggagggcaagtaaaggaggaagagagactgaggagggagggaggcaggtagagagggagggagggagggagagagagagagagagagagagagagagagtccagtgtttaaagatgtctttcctgtttttcatatccagggtaaagtgtgcatgcctaaattattttctcactgaaaacatatttcagtgttttatctacccatgtgtaacaggtagatctttcaaggaactttaggccatcaattctgatgctgaacatgtagaataaggaaagaagcttgtctgaaagcatcaagagtcttttcctaatggaagatttagtacacttaagaacgttttaatgagttcaaatcagattcacggcagactgcacaaatgagaataacaaacagaggtcaaaatgtgctttctgcattctttgttgcatctgctagatctttggggaaaggacttaatgtacgttgatatgtgattgtttcagttttcagagaatgtaattcagtctatgtccggtttcattaagactgctacaggatcgctggagtaattcgaagagaagagagatgtgaagggtagtgagcgtgctcactgacgtgcatgtttatcttgcagtttactcttagaccatgcataaatctattatccgatgtctattacaatttaatgtttggtatctttgagtaactctcctactcaagtattgtaatcactttagatttgggatcctgaaccatttgttgcctgtgacacatctaagatatgttaacaaagactgaagtagtagacgccgatgtatggctccctgatctgtttctacatgatagatgcttagactaaattgaaatgagttgactaacaccttctctgtccatttgtgtttcatcagcctatagctatttataaaagaaagaggcttttaggagagagggtctcaaatgaaaactaacgtctcgtctctctctccttgcataatttatataaactaaaaaatctttggactttgttaccaagtcattttatgaatcaattatttcacactccataataaacctattatgaatttttatgctatgtctataataaaatacaaaaaccgaggtttagattttaatacaatttgaattatcagtaaccaaagcaagaggaaacttaaaaaaagaaagtcagaaatctttcatgaagttttatattattctaatacaattcctaaagtttgaaaataagaacagctttagttatgcagaaaaataactttatttattgtcatttcatagaggaggaaactaaaggaccgaggttataaacctagctcttcatagggcaaggtagtagacttcaatacttcagttataaagcatatccctgagccgagacatgtcaggtgttggggaggtatccatctttgttgtgatggaacatgcgtcatctcttcctcaagctctcactctatttcctagtgcaggtgtcttacttatattttacttattcatgttcattttcaaagaggttatagagaattggacatgctcaatatcgaaaaacatttgtggaaaatgagactatgcatttcttgtagtcagagaagaataacgtttaatctgtccacctgaccttcctgagatacactccttattctcacataaagccaagtgaacagaaggataagtattagttgatttgagagtagtaactggatattatagaccgtgtagatccattacaatgtgatagaaggaccaccaaacccttcttaacttccactatgacttcatgagaactttatatgttatctattaggatatctttgacatagagctgtgtcctatacctcaacaatatataaatgagaaacagtaagatttctatttctttctcatctatattttttatttgctctgttcttagcctagtttgccaaagagtagaagagaaaacacttgtgccttcaggtttatatacatttatatgttagacatattcaccagcctattgctgacaattgataatgtgttttcttcttgaacttccatagcaaaatgccactgactgtgtggtttaggcaacagaatttaaaatatatatatattctcacatttcaggagttctgatattctagagaagggtaggaacatgattaagaggggcatgagagacagagagggacttatgtcttcttttttcttacacaatataattttctatgactaaaacatactaggtgtcctttttcattttctttttatatttaattttaccttctgtgaatccagtgtccaagttgagtcatgttcgagtttaaaagttcaacgcatacatttcaaggacacagttctgcccgtgatagtttaagagttgccaagattcgtgccttgtaacacatgataagcacttgctccactgaagcagatgttaaaagtggtaacttcatttcagaatcaacccaagagtcaatctcagctgtagcagtgagaggtgaagagggaaaggatgtgttttgagaaaaactttatccccagctgtgagcttgtaaaaccagaagctttcatgcaaggtttggagaagtataatttagataatcacattctaaaggagaggaatcagaaaatatcaagggaaaatattcccaagaaagttcaaaatccatcaaggcaatttcaattgattttaaagattgaaagtaaacagctctgcctggctgctgggtacttcaggcttattaagatgggagcattgtcttttagcttagacttcctcatctctcagaaaaggtcctaattgttcagctctacagggtgcccaggctcacaatcctgtgcccagcctgtgagttgctggccaattgttccctaacttgctaacaacctgggggtggcctctttctttgaatcttagaagggagcaatattgccctgtaggaagagtaactgctagaatggcctccaaattgtctggtcagtcaggatttttttctaaagactattcaaagtcttggtaagaaagcattgttccactccctagttcctgaatttggacagcaggccttcattctgccctattgtttgtctcccacttagttccagctggcactatctgctagaacaatttcatttctatttttgactgtagttaaaaatggctagtaaaccctcttcatactctctttcagaaaggaattatgggtagcagagtcgcacctttgatgttcaatccagaaaatggttttagtgttttgttttggtttttgttttgttttgctttccctatgggctatggcagagcatttttcaaatcttcagagtattttttgttgttgttgttgttgttgtgattatttcacctgacaattcctttgatgtctttcacacccatcatattttgcaaaaagtactgataaaaaaaaaaagctgactgtgccttcaacactattattatattctttcaaaatgaaggtatacaattgtacaaaggtatgtcttacacaggtcttttgcaatgtactagataataatttcatcatattcttgcatcatattcatcacttacttgttaacctgtaatgactcaatcctcattcttctctgagatgtcatagacatgtctctcttgtttctgaaacagaatccagtgtatactcagctggcctcaaattatacagcacaggctgacactgaactcctaaacctcctgcctctgtctcctaagtactagatttacgtggctacactattaggcccagaatatacagtgctagaaaaagaacccaagtttacagatcctaacccagtgttccatcaaatgagctctacacacagtctgagactccacttcaatggtgtcatttctcccaacattatgtttacaataataggtgcattttgaaagacgactcagctgtgttttccaagctcccctcttctccaggactcagatcacttctagttaaatgagaataataatagtctctgcttcatagcgctttcatgattgttagattggctagcacataagaaacagtagtgctcaatccacaggtacacacacaaagaagataaggattgggggcttgaagtttccctgccaaatctactgtaaaaggtggtaagcagtggggatggaagcctgtcttgatctgcactagtgtggatttgaatcctggccattatttagaagatatataagtttaaggaacaaggattgacagctttgttaattcatagataaagttaggaaaatacaatatctccttttttttacacagaataacgtttgagtgatgtcaacatttactgtcaacatcatctctcaccgtgaacactttcgcagcttcccaattgttctcaatgttgccagtcttatctgtacaataactcattttccacacaattttccaagtaaagtatacattgaagtaggagacttccctgtgtaatatgttcattgacattctaccatgtcaaaaataagtgccaatcctaaaagggtggtctatttgttcctatacagactctgaatagcccaatctcccatcttatcaaaagtcacccttcctttgtttgctctgctccaatcatgagtgaattctgagcatactgaactgtttcttttctttttgttttttgtttttgtttttgtttatgcttttgaaactttgagcttgatcaggtcctttgtatatgtttacacacaatactcatttccataaaacccaggaagagttatttctcctagcgtgcctctcctcaaggacatccagaaatatcattttccatcatctcatctaaagtggacaactctccaggctaatctacattctctcacacctttcacatgacttttcaaactttacagacatcatgtttatcgggatctttacttatacattgtttctcttgtctgacacttaaaggtgtaagtatttcctgaattgttcatattatctttcacagtatgtaacacacagtaggtgttcagtgacataatatgaagaaacgaataaggcaagagagagatcctcttacaacataaaaggtttttagtatactttttgcaccactaagagaaattaagccagaagatggaggtctgtgtagacatgtttcactgacatgtggagaatgccattcactgtggaatctggattccatgaggaaagaaaagaatcactgtcaagtcttctgaagccaggagtctgagaactgccaccattcagaagaggaagtgtgtgtcttttcaggtcttgcttctgacagtcaactcttggattgttaggtgggtctgtgcatggctgctggaagctgcttagttaaggattctggtatcaaatactttctgccatagtcactctgtctccctggggttaagtgttgaaaacacgagattgtaacaagtctaaaccaacacttgttttggcaagctggttaaccaggctggcatttaccaggaacacctctaccttgcatcatgtcttttttccttcaaaaatagaatagataggaggataatcgtagttcctggtcatctgcatcacagcctatctatttctagaaggcctggagaatactttcttccaaaatctgttctcagcggcagccattgtcttactgaaattgctttttctgcctccaccagctggacactcaaaaacatgatatgacgaagtcctatttaattttgtcatcctatcatctcaacgaacgaggaatgtgaagcctcatcctgatataacaattgtgcgtggcagattcacatccagagtgggaatggcatgcctggcaaatgccttcttcctgtcagtgatttcttcacatgacatcctcccacaggttgtcttgaagggcaagcattaccaactgggaatattgtgtacacagatatgtcatcggctatattggcactagccctttgatggctaactttattacaggtatcattgtaataaatattagccaacataaacattggtaccttgaatgcttaatgcagtggatggggaagctgaaacaatagaggttaaatttggcatataaatttacccaatcatgtcacaaggcaacctggcatattatgttgtatagtgatagcatccgcttgatcagtagtcatccctttatgtgcattggctttctttgtctggcctgttgaatatagaactatttgcatttatcaaagtaaagacttccactttaatttttaatgctacttatctaaagccaataccttcaaaggggctttttgtgcatctctcagcaagattccagggttgtaattataattctgcatctaactttgccggtgttggaatgttatgaccaaagcaactgccttccacttagttcctaaagtgagattttcaaaaactataggatgtatgttctatatcatggtagaatttttggtaatgggtcatcaaaacgatgccatatttaggatgaaaggtaagggccatggaccccttattttcattatccacatttctatgtaaattccatcttcatggaaaataaagcaaaaggaatagtgaaccactgagaatgaagtgagtttaaggggtctttgaagcaatagatcctccatgatggctacagcccaggaaatcaaaaagaagagcacaattgcaatgcactgccctctactgatcaggcattacacaaatgcagctcctatatcttatcaaccctgtgttagttgaatttttgcacatatacgcgtttcctagacaatcactttaatattaagtagatctctcttttatagcttcttttcttttttattagatattttcttcatttacatttcaaatactatcctgaaagtcccctataccctccccccaccctgctccccaaccaacccactcctgcttcctggccctggcattcccctgtactagggcatataatcttcgcaagaccaagggcctctcctcccattaatggccgactaggccatcttctgctacatgtgcatctagagaaatgagctctgggggtactggttagttcatattgtttttcctcctatagggttgcagaacccttcagctcctcaggtactttctctagctcctccattggtggccctgtgttccatccaatagatgactgtgagcattcacttctgtatttgccaggcactggcatagcctcactattgcatggaatttccacttcatctttctccagcttcagagacattcctgtaaagattaccaccatggctgaaagcacgttcccatagctttaggattcccagttatatgattaacaactcacagaatgtcacttgccttaatcataaaatggcaattttagaagctcattttcaaaacttggtagaaggaagaatggaattaattatacagagagtgcaaatttctctaaggtgcataggtaaacttgggggagggcaactgaattctttttctaattaattgatgaagtagaactagtgttataggaatggaaatttagagttggaaagtcaaaacatttctgcaattcttttaatttttttttatagacagaaaaggttaatccaatatctgcataatcatttttgacatcacttcatttttaaacacaggattttaaatctctccatccattcaccaacttatatatgatgactacatgattattaaggagacagagagtatttaaataatctatactcagtaaaaagttaatgtgtcaagtaggacaagaactatttccaaggaagggaataagaatgtgttgctgaaaaacttgtctggaaaggctcctaccaggctgaatataaaaacttgattgtttttctcagggtgtgtggacttatacatatacatatatatgcatgtgcttatgtgtgtgtttgattattttggggtacagagaaaaacctaagcaatagtgaaaaaagaaaacccacgtaatacataaaagctaaagaaatcagcgttttttttaaataaacacttctgaataattaacttttttgtgaaattttgccagtgccaaaatctttcagagtaatataatctcctgagatggtttatcgcacttattaaagatgcaaaattattatttagaagaggaagggaagggcttcagatctttgaatttgtaaataggctgatgttagatgagggtggagaacattcttcatagattccgaggaagaaacaatttacacatgagggctgtggaaacgaggttgggtagcatcttcaaaactatggagttagcactttcctgtaaggagcttttgtgtgtaattgattttccctgtgaaattaatgaactcctttccaaaaacgcaattggaatcaccgaggatgaacttggagactcaataacgccagcaggacttgaagggttaattcttcagtcaccactaggtgtcaggttgggactggttttgggaacttgcaggctctgactggctttaagtgagaacagacaacctctctgttcctttctgccaccgtgctgcttccttaaatagagacttttacactgcatatgtcaaatctttggaacctttcttttttgtctcatgggtgtttacagcatttaaacttttcaccccagcatgagcctcacaggaagggagttttgaagaggagaaatacaatttaaagggggtcagcatttgtgggcagattctttttgtcagtatcccccagaaccttcttcattctctgtcacgaaacacttagagtttacatgcaagttgacaactaggtttgcttaggccctgtaaccttcagtagagataaaaagcaccgaaagcaaggaggtgcagactcactatgtaattttgagcatgtagtaaaggtttgattcattcatctttacatctttaaaatgagtatatcacttgagtaagaaagaatacataaattttataaaatctccctagaaactgtaaattaagaagtaactttatagttaaggtcttgattctgagacagagtaaaccataagcttggtgcccttgtttgcatagaggaaataccactaatgcaaaactgcagtgcttggatctcttgtagaatgtcactggaacaattccttataggaaggttagcatggctggggtattataggcaaaggatggagctgtgtaggaagagaagatgtaaaattaaagaatttgaccattatgttaaataatctgacggaattactctagcacaggcagcaatcaaaattgtatacagaagaaatatccaaaaggttcacaataaaatctaagctaattaatatagcctacacggtcttatccatctttgcatcttcatatcaacttttgctccatttaattgccttgtaaatctgtaatctagaagtggaattattttatgaccaaaactactcgtcactgagagcctttctcagcccattttgatcatgttagcacagctcagctctctctgtggtgagtacaatcaccagctcttcattaagtcagttcaataccatgcattgatatataatacagttctaggcaaagagacacgaggaaggctaacgctttatggtccaagtttaagaaagaaacatttaaatatacagataattcctgatttgaggtattatgccatatgtgccaggacagcacacccacgatctgatggttagcaaaaatgttgtgtaaagctgagcatgtggagtctatggaaataccagaggcttttgaagatgaaattgaactactgaacaaatccaagagcaactatcttttctcccactgcttgtaagaaatcactcagttttagaatacatggtaaataaagtagtcatcttttatattactgtaaaaatcaataatatagagagtatggagagagagctcagagaataagagcatatattgcttttcagaggatctggattcttgtcctagaaccaggcatctcacaaccacttacaactatggatcagagggcatctgacacctgtgacatgtgtgggcctcaccacacacatattcatatgtataaattaacacccacacatacataattaaaagtatgttttaaaataatatagcattacatgattagagccatgaaaggacataaaacccacgctcatgcaacaattattgagcatgatgagttattaatggtaaattcttcattacacatgcccactagctttttttttttttttttttttttttttttttaaggaaaagaaagagtgactggagatgaaatcactaaaacagttaaaaccaagttttagagtctttttttcttcagtcttttcaattttccagtgaatgtagaatatccaagagaccggctttccctttataatcctgtaacatctgagctccgtaatgatctctgcattatttcggagtcttcctgtatattaataaaagcttgctcaccactaatactcacgcagctcgtgtatttagtgaaatgcccccgcggaaattctcttttcccaagaccactggtgggtgctgcttttgcatcccaggcttctcactcacaccttctctttgccacttgctttttctaagtgttatcgtacacagggaacctaggtgttatgcttcctttttatagacttgaatttgttcttagcttctcaaacctgcatgtcaccacctccttgaaataactgctctttagatccaactctagtttattgacattttttcctaagtactgaaaagtcttgtttttaataacagaaatgatagatatttaaatactttctgacttctcacttcctgaaaagatgatattataccagaattattctttcaggcttagtacctgcaatgcttattcataaaaatcataggttgtaacacactattgtttaaataaagttataaacaatttatacatgtaaaacttgcaaatatttgatggttaaggtcaaacaatagctaagaaataagacataaaataatataactttattgtttcaaaattctgtggaattgttccttcccaaaattatctgttattatttaaatgttgggatccaagagcatatcatcaaattatgatggtctttaaaataaggagtacattaaatgccatatatctgttttatacccataaagtttctactccagtctcagtgagatatgttagtgtttggtattgagttcaagatgaaggtgatggtagcgagttgtgatagagtgggtagatttttactgccactgatatcagtttatggatgctaaacacttcctggtcaatcggcacttagatgagatgtttatttgcattgattgtcgattatttgcttacccactaacctgcaatgtttatgttgttattttcctctatacatgataatacacctctaaaacctcctgagtgttcctgttaaaaaacatgtgtgtcatcgtctgtcttgaggggcagtgccttgaaagatactaagcaaacaacggacagctgggtggcatccagcacttcctaggtgtatgagtcagaaggaatatctgtttatgatgcaaaggcatcctatgggaatcaaaagaaagcgatccctatctcagttttggttttgctggaaaagagtttagggaggcttttccggtctccttcaaacaggtgctgttcagtgctcagctacttgctgaaaaataatttcacacctgcaaattctctcaagaacgaagcgcaatgacatagaggacaggcaggtagattttcctttcttgttatttcctgacagttatttatttatttagcacagcaccagtcagattgcagagcccaataaaatgataaggctgccctcccgaatgtcaggataggtatcaagatccactcctttaggggccttttagaaatagaaagatccgaatctgagctttatctgctaaaaagcttattttctaaaatagtgttgtcttatgttgtgcccatgaaggacgcttctgtgtgtagacatcccaggcttatttcactgtcagacaacagcaaaaggctttactttatttactacaacactaggacttgatgaaggtgcagtatcaacttcctgttccagaaaaccggaactgttatatacgacttttcttgcttttgaccaagagtccacttcttatagtttagtccagtaaatcacagagggaatttcaagttgaaagcaaaattgcacatcaaaagtttcaaagataagtatgatattacacaaagaatgaaaaccttcatcagacatttagttttctgtctacaataatatatgatttgatgtcttggtggagcctggtattgatggcctttatctccaaacctgataaatatgggttataagtgaaaaggaaaccttgcagaatcaccaaaatattgtgggcatgtgtgtgtgtgtgtgtgtgtatccaccaatctatatacctgcccatttaaccaactatccatctttgttttagcgtatacattcattcatctttctatcagactgtccaaagtgagacctacaggcagatgatgggccatgacagagatggatagtcaggccattgattcagagatgttagtccttgccctttcattccacatctatatccaaaaatttagcatcgtgagcaatttctattacttaagctttgagtcaagtgttcaccaacacacagcttgtgttgttgaatattttcaggaatggaatttgaatctcctatatttcatgtgcagcatatctttagtgatctctacttcatcgtttgcacctgtcatatgcttttatgacatgtgccttggagacttgagagaaagctcagtagtaaaggttgacttaatgggtaagccttaaggcctgaggtgatctccagagtctatgtataggtagaagagacaatgttacagagttgttctctaacctcttcacaaatgctgtggtacatgcacaacttccatgtcttctctacgctcccttcctccaccccccctctctctctctctctttctctctctctctctctctctctctctctctctctctctctctctctctctcacacacacacacacacacaaacacattaataatgcataaaatacttttaattatgtgagccttttatcctaaattgcgaataatctgagatatttattgaagctttgagaaaagtgctgttttcacacttttatatgctgcttgcttactcagttatcacacgcagacccttctctactccacttaaaggaagcatcatgctgacggtatcgtgtagttattcagagcttgctttgtgaaatatcaaagaggtgtgcagcctattattcagttcatacctcaatatcagttctttttcatgtgatttatttattttgcctgcttgccctcaaacacatactcctaaaaagtttatgaaaagcaaacgcagaataaaatttacctatattaatgctgggagtttcttggtgtattatctgtctctaaaatgtaccatgtttgaaagccaaggagaaaaatgacactttgcacaatgggaatgattctgtataatcaactgactttatctaggtacaataattaatagtgtcttttatttgtggcagaattatggttagccggtgtgttatattttctgttgttggaatttgaaaaaggaagagtccggtcctgaggaacctcattttaataatatttaccatggtgaacaatttacaaaaggcatttgcccacaatctgatttgttttgttaatcaaaaaagaagaagcctgtcatggtaataataactggagagataaaactgggctaggggtgtggggagagaatgtattgagggcactgtaggggtgtgcagaagagcaaaatagaaactttatctgaagcacatatttatccactccacaataagacaaataaaataaatgtgaaactaaatgaagctttcatttggtgtgtatgtgctttaatgaagtttatccctttgttactctctgcaagaacagagtctagatacagtttccctagttaactctatagtcaagtgattcctctccataactactataatcaatacattccactgcaaaaaaaaagaatagagcatatttatattatctattagcacatagcagtgtgactgtacacagtatgttgaaacaatatacattagggtagcacagtttctgcataggcatctaataggatttcataatcttgctcagttcaagaactaacaggactgcaattaatctcttgtttaaagcctagtttgcctatcaggcttgattgggaagaatgctaatgtaggtttttttttttggtcaattttgataggcttttggaccaagtgtcttggtttcttcctagctgtaggttttaagagagctctctgttcccaaacataagaacttttcaacacagccatatgtttcttctaatcagcttcttcaaacaggagggagtctaacaagattggcattccaatcccacatgcgtggcttataatatagaaatcttactctgtatttgtgttggttagtttcctgtcacttgatacaagctagagtcatcagcgaggagggagtctcaaaggacagaaaatgtctccataggataggatccttggtaaacctgtaggaaagtttcttatttgataacttatggaggagggccaatccattgcgggtggtgtcattcctgggctggtgcttctgatttctatagaaagcaattgggcaaggtttggaagcaagccagtaaacagcactctttcaggtcctctgtgtcagctcctgcctccaggttcctgccttgttttagttcctgcactgagttcccttgctgataaactgttatgtgaaagtgtaagcagcacaatttgctttggccatggtgtttcatcgcagaaataataacccttactaagcttgcattcattcttgagaagacacaaaggtttggggctagggtaccaagaaaggaagctcatgggttttatatctattttagaaaaatataactgttcccttaatcttgtgaggtgaactaattagccatatgtaattcaatgtgtctccaaaaacaagaggactagaatttagaaactcaagaagataatttgaaaatcttcttaaaatttctttggtcatttcctagaaatatgtttaactcattcatatgacaaatgtgaacttatgtagtagaatatatatgtatggatacataaaaaacttatatgtgccagacactattacaatgctgttaatgagttcataaataaaattgattttttgctttcctgaacccttcataagcatgaggagacaatagtgaatggataacaaaatgtagtatgctaattcagtagatgttccatgtctaaaaataagtttatatacattgctggagaatttggagcatgtggtgtttcagataaatactcatggaagaattcttgaatatgcagatattgaagcagaaagttaaatgaactgtgtgaaatggaggtgtaaatatgtggtctcaagaagaggaataacccagtgagtcttgtattcattgtaaacagaatgatagaaagtcagtacttccctgtcactctggatgagatgtcattgtctttctttcttttcttttcttttcttttcttttcttttcttttcttttcttttctttttttttttttttttttttggtttttggtttttgatttttcgagacagaatttctctgtgtagccctggctgtcctggaactcactctgtagaccaggctagcctcgaactcagatatccacctacctctgcctcccgagtgctgggattaaaggcgtgcaccaccacgcccggcctaagagatgtaattttcaatgcaggcagcaaggaagttccatatcagcttagaatccttgcagtactgagttttgtaccagacactgattagtcattgaaacagcagaatctatttcaaagatatgttatgctttaacaagtaaagtggacataaatggagtttccctgcttcctgtagaaagtgatgttatctaggactcatctattattcatccctgagtttcccagctctctagttgcagattgtccttaaggttaagactatagatcaacatttataaaccttctgatagagtctctctgggatcacctttacttggcatgacctaataactttgcaaagagctctttctatgtctgcctcattcacattctaacagagacactacaaagcttggatggtgtgctaggagttaatgttgcttttgttattccctgtcattcatgaatgtctaacaggctgaagggcaaatggatttagttaaatttgatgtggggaataaaagaacacctttagatagacattaagaattattctataatacattaaatatttagctagtgaaggaatcaagataatttttcatgacataagataagagtggccatacctgtttcctctaactccatgaagataacattaaactaaatgcaaataaaaatattttaagcacaccataggtctgaaaaactgcatcttagctatgtctaccctaattaaataactgtgtgagactcagttcaaaccaatattcctgatatgagtaagaaaccccttggtagatttctacagttacaaactaaaaatattttgctattaaggagtaaataacttgtaaaaaagggaccagggaggactgaatagagattacaacaatcaattataaatacagatgagccaggagagctgatgctatcatacttcatcattcacattctcatcattagaatatataacagttaagtgtctgcagcagagcttgcttctctgtagcaagagatgttaatttctaaggaaccaaaccagtgacagtgagattcaggaggggctgggagccaaatgattggactgtaattattctgaaagggcttttatcatcattacctaacattttgcagaggcagcatgtttgaaaataaactatggccaagatagtgtcacgtcatcgagcttctggtttgctgatgtatttttgtgtttgcaaggatagatgactacaaatgtactcaggcaagcatgtatcattttcaagttattcagccaaggcatttgctttgccacagattaattgaacgacgcatacagttctctggccctatcaaatgcgatagtgggaagttttcattcatttttccttgccatgataattcctacctgaaaatcttgatcacttactattgagatgttacaatagtaatgaagatgaattaaactcctgccatgaagattttctaactgctgagttcttgtagcaaatgttttaactctcccccttgtttacacccttaaaggacaagctaattgtctgtttaactttgttaggatgctttaataataaggctttcaaggccattaacagataaagctgtttctataccacaaggatgtttaaatttcacctctgcagcatcaaaacattcattcacatccttggagttcatgctgaggtagaaggaccagtgggcagtgtaatagactaaatagacacttttactttaataaaatggtaatgacagtaactttgtgtgagtttcattctatcaccccacacatataattataaatgtcagtttacaagtatgcataatatatgtgcatggataataacttgacaacctctttctgttatctgcaatctaattatagtacaaggacatggaagttaactagctatggtactaagaatcttgtcaagaaaagacccagaaaatgagggagtatgacttacttaatagtagcacattctgagaaagtgcatcctatgtggaaacaaatggctttgggaagtaaagaagtgacatattagtctctagatagatttcagattgagtaaaaaaaaaaagttctcctattttacaatctgagattagttctcttgaatcatgaatctaaaatgtctttgagcatcttagaccctacactcctatgaaatatgaccttgaatagaattgtattgatgatacctcacttttacctataacacacataatgaagatagtttttaatcatctgaaatcaacaaatattttctccgctagcatctcagagactcaagtcttcttcttataagatgttgggaagaatgggcatgatcacttcagtaaaaatccagttaagccaatctcaattttgagcttccattactactcacttttgaggagggtgatctcaaaggtggagaaagttggtgagatcactcatctatgcaccaggctccagcagagcagcagtgctcttatgaattaccttgtcttattgtatcttgttttgttttgtttggctatagtctcttggaaacccgctttcttttcttttcttttcttttcttttcttttcttttcttttcttttcttttcttttcttttcttttcttttcctttcttttcttttcttttcttttctttttttattagatgtattatttatttacatttcaaatgttatccccttttctggtttcccctcagaaaacctcctatcccatcctccatccccatgaccaccaacccacccactcctgcttcttagccctggcattcccctacactgggatattgagccttcactggaccaaggacatctctcattgatgtccaacaaggccatcctctgctacatatgcagctggagccatgggtcccttcatgtaccctttgtttcgtggtttgttcctgggagctctgggagtactggttggttcatattgttgttcctcctatggggctgcaaaccccttcagctccttaggtcctctctctagcttctccattggggaccctgtggtcagtcccttggttggctgtgagcatccacttctgtatttatcaggcatttgctaagcctctcaggagaaagctatatcaggcctctgtcagcaaacacttgttggcatccacaatagtgtctgggtttggtaactctatatgggatggatcctcagatgggacagtctctgaatggcctttccttgagtttctgctccacactttttctctgtatctcttcccatgggtattttgatccccccttctaagaaggactaagtatccaaactttggtcttccttcttcttgaattttgtgttgcctgtaaattgtatcttgggtagtccaagcttgtgagctaatatccaattatcagtgagtgtataccacgtgtgttcttttgtgattgggtttcctcaatcaggatgatattttctgctggcaaggatgtagagaaaaaagaaaactcctccattgctggtggggttgcaaactggtacaactactctggaaatcagtttggcagtccctcagaaaattgcatatagtattacctgaggacccacctatatcattccagggcatatacctagaagattctccagcatgtaacaaggacacatgctcctctgtaaactctgaagacatttctaaaacaagatactggtcttcagcatgaaacagatgacctcaaggccctaatattcattatgctaataaacaaatatatttcctggcagactacaacagaagtcagggatttcacatgatagcagtttggtatgactgcaatgagatttatagcctgagtgtgatttactgctcccacgggtggttcaaagcagatcattaagaagactgtgttttgagcagttggcatttcttttcaaggcgatctattttctgttctaaaaatcattctatcagtatgcatcaaattcccttatcaaaattcagtttttataaaagaatgtctaaaaaaaaatcttttgatgccattttgataaggctttgtataagcatctgtataagaggtaaagaaagaaataagaatcatagcacaaaactgtagaatagaggataaagtcttttactttgaagtttgctgatccaaaaagaaaaaataatgtttttatataaaaagtcattttaaaatgtacaaataatctttttgtgctattaataaattcagaaaaataagttcagcttagtaataattggtagttttctacatgctttttcttattctgaggactgatctatcattttgtctaagagaacatgtccccctatagaaaccatatgttcaaacatgagaacatcagatgaagtgtaaccatgatcagttatcattctcttatagcctctcaaaactataagcttattattattcattttatactatttttgcagtagaaattttctgatgtgaaagttgtcttgttaccatgataaccattagccaacagagaacatatgggtatctgactggtttgtctgaattacatagaaaaattatgattcaataatggaagactcaaactcagcccttgagtaactttaataggatcagcaatgtggcatccacaatactatgtgtcattctgaagactatacaaatgatacactaaatggaacaaacacaactgttctcatacacatacacacaaactgtcacacatgcacatatacataaaacagacacacctataccaatgcatactcaaacaaacacatacacacatacatgcaaacataaacatatacatgtacatatatactgaaacacatatgcacatatatacaatcacacataagaaagagaaaattcttttaataacccacctctctttacactcacatttaaaagaactttaaatgccatccttagcaatgcaaagcatagttatatattcatcatgtatcagaaataacttccagtgcctattgaaaacagtgcaagatgaggtggtgatagtgagcaataccactcaaggagacagaagagagggaagaaaaaagaatgaacatgacttgtaaaaataaattgtactttgaaaacaaagaaaaaattctaagacaaccacaatcaaaatgtcatgtattgatcaggttcttaggacattaatgtatatgacttcttttgtccgagtcacatgatctgtacttcctcagttttcagttttggagttgttatattttataatccatgagattctttctatatctgaactccatatttgctgcccaagtatttttcagtgcacagagaactccatttcaaagttgtgattgaagctgtgcaagaagaaagaagcttgaatctcagctttcctgaatgatcacatttttatgaactctgcttctcctctctgcatctcccatagctaagaaatcactttttaatctcagctctaccaaactgttctgttcttaccctgacaagtaagaccagtagcatgtgaaaaagcaaacttgacccttgctttgaatagcatgatttagaaatttctccatgggcaccatggatctagaatttattggaaacttctggtaaacccaagttaaatatgttaactgctgagattccaagaaagactggcttgattcttcagtagttctgaggtatcagagaatatgaaaaccaagttaattctttgtgcacaagaaagtactagaccacagtaaaaatatgttcgatcagatctagctagtgttctatttcactgatcaacatatattaaatgttccctaccttcctgatgcagagattcattgaggatgcctggcactgaggtcaataatattgaatgatcactgccatgccctaactgtgacgtgacattcttcacagagatagaagctttaagcaagctaacttgtaatgctaataatcacagtgcagcttctgggttatttagttaagtttcttttcttttaattggaaaataataatagtaattaataataatctttattgactataatgtggtttattgttattaataatggctgatatgtattgagtaatcctgggtcttgtggtaggtacatttgcatatactttgattattaattaagttaggtttgataattgcatacatgtgaatgatgtatgttgattgtttactcttttgtttttttttccatttttattaggtatttagctcatttacatttccaatgctatccaaaagtcccccatacccacccacccacactcccctacccacccactccccctttttggccctggcgttaccctgtactggggaatataaagtttgcaagtccaatgggcctctctttccagtgatggccgactaggccatcttttgatacatatgcagctagagtcaagagctccgggatactggttagttcattatgttgttccgcctatagggttgcagattcctttagctccttgggtactttctctagctcctccattgggagccctgtgatccatccattagctgactgtgagcatccacttctgtgtttgctaggccccggcatagtctcacaagagacagctacatcggggttttttcgataaaatcttgctagtgtatgcaatggtgtcagcgtttggatgctgattatggggtggatccctggatatggcagtctcgacatggaccatcctttcatctcagctccaaactttgtctctgtaactgcttcccagggtgttttgttcccacttctaaggaggggcatagtgtccacacttcagtcttcatttttcttgagtttcatgtgtttagggaattgtatcttatatcttgggtatcctaggttttgggctaatatccacttatcagtgagtacatattgtgagagttcctttgtgaatgtgttacctcactcaggatgatgccctccaggtccatccatttggctaggaatttcataaattcattctttttaatagctgagtagtactccattgtgtagatgtaccacattttctgtatccactcttctgttgaggggcatctgggttctttccagcttctggctattataaataaggctgctatgaacatagtggagcatgtgtccttcttatcagttggggcatcttctggatatatgcccaggagaggtattgctggatcccccggtagtactatgtccaattttctgaggaaccaccagactgatttccagagtggttgtacaagcctgcaatcccaccaacaatggaggagtgttcctctttctccacatccacgccagcatctgctgtcacctgaattttttatcttagccattctgactggtgtgaggtggaatctcagggttgttttgatttgcatttccctgatgattaaggatgttgaacatttttttcaggtgcttctctgccattcggtattcctcaggtgagaattctttgttcagttctgagccccattttttaatggagttatttggttttctgaagtccaccttcttgagttctttatatatgttggatattagtcccctatctgatttagggtaggtaaagatcctttcccaatctgttggtggtctttttgtcttattgacggtgtcttttgccttgcagaaactttggagtttcattaggtcccatttgtcaattctcgatcttacagcacatctaaaagctctagaaaaaaaggaagcaaattcacccaagaggagtagactgcaggaaataatcaaactcaggggtgaaatcaaccaagtggaaccaagaagaactcttcaaagaattaaccaaacgaggagttggttctttgaaaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccatctaaacagtcccatatcacctaaagaaataaaagcagttatcaatagtctcccagccaaaaaaagcccaggaccagacggatttagtgcagagttctatcagaccttcaaagaagatctaattccagttctgcacaaactatttcacaaaatagaagtagaaggtactctacccaactcatttaatgaagccactctgatacctaaaccacagaaagacccaacaaagatagagaacttcagaccaatttctcttacgaatatcgatgcaaaaatcctcaataaaattctcgctaaccgaatccaagaacacattaaagtaatcatccaatctgaccaagtaggttttattccagggatgcagggatggtttagtatacgaaaatccatcaatgtaatccattatattaacaaactcaaagacaaaaaccacatgatcatctcgttagatgcagaaaaagcatttgacaagatccaacacccattcatgataaaagtgttggaaagatcaggaattcaaggcccatacctaaacatgataaaagcaatctacagcaaaccagtagccaacatcaaagtaaatggagagaagctggaagcaatcccactaaaatcagggactagacaagtattagccagagcaattcgacaacaaaaggagatcaaggggatacaaattggaaaggaggaagtcaaattatcactttttgcagatgatatgatagtatatataagtgaccctaaaaattctaccagaggactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtggctctaactaaggaagtgaaagatctatatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaatcctaggatagcaaaaagtcttctcaaggataaaagaacctctggtggaatcaccatgcctgacctaaagctttactacagagcaattgtgataaaaactgcatggtactggtatagagacagaccagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatgattgtttactctttacactgattttctgttatctctctctaccatttaccaaactccctcaccttttcttctaaatggttttggattgggaatatctgttggcatcaatagtgggtacagagctaaagacaatgacttttcctcctcctaactatatcagtagcaagcagtttagcagagagtggtgtggccaacccagctactcctctttttatttttatttctttttgtatgtctgttaacacacctagttgagccttgtccagaagatggcttgtctcagccctgttccccatcttccagctcttttatttctctgacatcctttcctctgtgtttcctgagcttgagagagttactctaatatctgtttatggatgagtactcaattgtttcttattttcagcaccctgtgaatttatttatccctgttcattaggaaaaagaagcatccttaattaaggctgagagttacaattggctaagggtataaatatagacattgagaagtcagtttgaacttatttaaatatggctaaacaacagagtgttccttgggagggattgtgattcccatgtcatgggcttttgaacaggatgacagtatcagatatagatttctttcagtggagtagatttccaatccaatcagaaagcagtgaaattccagtgtgatattctgaagcatgcaaacatggtaaaaagacttatcctgctgggcggtggtggcgcacgcctttgatcccagcactcgggaggcagaggcaggcggatttctgagttcgaggccagcctggtctacagagtgagttccaggacagccagggctttacagagaaaccctgtctcgaaaacccaaaaaaaaaaaaaaaaaaaaaaaaaaagacttatcctttttatctagtaagtattgtatctgttgatcagatgaatactttatctctcctttctgtgccaactgttcctcccacgactggataagaccaatctagtctctatttcaatgtgatcaaagtgtttagattccacagctcactgaaatcagtatttatctttctgtacctgcctaattctacctaatatgatgtcatctaggacttttaaagacctaacaatttattctgtgtatgatccggaaattccatcacatgttagagaaactcccaaaggaatggaaatcagtatgtcagaccgatatcagcacaaccatgcttattgaaatattgttcacagtagagagtgaatagaaacaagagttcctgagtgaatggaagaactaaaaacaagttcaaatacaccatagaacaatcttttacattcaaagacgttttactgcatttctcccttgctctgactttattttgtggtggacgatctaattgcccatagatttgctaaagttattaggaatgcttttggagagatgtgtctacagatggaagttgttattggatttaaactggaatttctcttcgaagtttgagagctttagaggcaacgaacttctgattgctggggaactgacagtttcatattgttgatgaatcagctcatctaaataaggaccctggtattgaacaccattcatttaagtatcaatatatcttattgatggtggtgaaggcatggagagaagggtttgtaggcagacagatgataagacagacattgagatctcatgcttgtttttaatggcagttttgattgcacagagtcctcagcaggtcaattagaattatatagtttattgtcatgtcctctagaagtgctgccggtgaagagttgcctgtattgctcagaatttctagaaggttcaaacagcaacattaacctcttctcacagagcttaatttgatattactatttttttttttttactcaaaccaaataaaatggtcaaagaaagccaatgtctttgtccatgagcactatttgcacttttttgttgggtggacctctaaaatggcctctcattcttcctttgctactcactgtttatactccttatctggatgttaatcagaaatggaaggcaaaacttcttctcagggactgtgcattgctcttctttgaccacaaaataacttccctctggtgactgtctttagctctccctcaggtccaattcagttgcatatgggactgtgcggatgaccataactgtatttacaagagcacattttctcaccattccatttgattgctatgtgagtcatcctgttacctcatcttcgtagcatgaaatcgtagcagatactgaatgaacactacttacttgttgatttattttcacagtctctaagtgtaagtgcaacaatttagttgatattaattcatggctatatgtttaaattctaaactatatctgaaacatgatagccagctactcagtaaattcactaaatgagtgggctcataactgaaaaattaagaatatgatgcccaatattacattcacagtcacctacatgcatttaaaaacaaaacacacgagcaaggaaaatgtttatcatttcaaactttcaataaattgaaatttatgcatgaatatacttactttttcatgtcattttataaagagcaagaaacaaaatctctgttttgatctggaacaacctatatattgaccccacggcataacttgtctcatctatacatctactgaatttctcagagtaagccaaagaacttctgtggagtaaagataagatagtgaaaagtgctgatgttcttctgagattaggactgcaatcgttccttcatgttcagaagacattattccacaagtcttcactattaaaccttcttttccagtctataatgttctgtgagccttgtgtaagtgtatatgtggtacagatgtcacatgtacagatcaacagaccatagtcacttaatctattcactttgagcagtagagagtctctgtattgattactatccattgtgacaagatctaagtagtatgcactacctactgagagaaaaactacacaagatcaaggcaaccaatgcaagagactcatgaaactctacctctagctgaggagctactgactgatgtagatataatggaaagacagtaggtttcattttgtagtacagcccatggaagattacccatcatccaaaggatgatgtctttcagccatgtgcataaaagtggcatcaattgaataaagtgggttatagaaaaaggaaaaagaggaagagggaagaggacataaaggtaggagatggacatacagttggagttggatgatgatttagccaggcagggattgagagaaaatataaatgcttttatttgtgaggggaatcatacaatagaaaccccacactgagcttcttcattgcatttgtgggtgttttttttgtctgtttttgctttcttattttgttttgttttatattgttttggggggagggtgtacaatgtgcatgcagcagaatctaggaatacatatctattttcattattctgcttttatattttagttagacaagagggaaggtcaacaaaacaagagtgtagcaacagaaaatgcctgacacatatacagcagaggactgcctggtccaggcttagagaagatggacctaacactcaagatacttgaggtcccagggagtggagaggactagtgatgttgggaatggggacacaccgttttggagactgggaggggagcaggatttatgagataaggaatagtcaaagggtggatcaggaggggcataataactggaatgtaaaaaaaaatagataaataaataaataaataaataaataaatgcctttggctacaatgagaaaagaatggtgtgaaataaggaaacaaaacaaaaagaaactaaaaccccccaaacaaaacaaacaaacaacatcaacaacagccaaagagttgttcatataggagtttggaagctgttacaatgatttaagggatcaatttagaggaatcacatgcattttgaaaatattataagattaagagatgcaagcaaggtttcagggatccaaatttggaatagagaaagattgggagattcaaattttatttgggaaatagagctaagcagactgattgttaggatataagcacacgaaagaagataaggatttgtatagtagataatgattctggattgtttgaatcgatgcaatagtgtaagcatatttaagaatattgtcattagaatgaggagatataattgtttcagtttgagatataatgtccctgttgaaatctatgtccagacacatatatttgtaataacaaaaaaaaagaatgccatggatttgaaagagaacaatgagtttgtttgttttcatggtacaaaaaaagaagaggaaaattatgccattataatataaagaaataattaaaaataaaaattcattgatttttagatatcttagatattttagtatttcttagatgtcatgggctcctctattctaaatacatcaaagtgtcctgctatggtaactgaccattaatttgtcaacataggatacctgagtattttcaaatatcagctattttacaaaacaaaaatatatctgttcttgatgacaacagatgacaagttaaatcaaagtgcccatttgctatttatgtggtagacatacactataactttgaataaattggaaagtaaattaatcataacagaatgataataactgaactcatttctgggcagagcttattaaatagacaaatgtaaactaacaaaaacaaaagcaataactcagtgattaaaaaaaaaaaaaaaaaactagcaccaaagaataaaagaagaagatcctgtactaatgttaatgagatgatcatttcagctatagttgtaaataagtttagcttgggagtgtgtagtttacattcaattaagcttatcacagaaaagacccatgtttagctagcaggaagcacatgaaggggctgcaatgctagttaacctttggaaacaaaaaccaagaagtatagaaagttgacacattattggaccatcaatatagcatcagtatttttccttatcattttcctacactgaagactggaccacttataaattatgtatttgtattgaaagcaccagaaatgtaatagttgactatttcaaagatcgatatcttcacagatgtgcatatttgtatctttattttatccttaccatttgaatgagcaaccagcaacagaccttagacattaaactggagataatgtttctttgcactcaagtattttgaaaggactttaaatgataagtgtattcaggttacaatttgtctgtgaataacttaataagttcagctgacaattgggttcaattatgatacccctcgtataaagttacaagttttctttcttatttattcaaaattatgttttatatggttgtcatcagaatagcacatgggttctttgacttaacttatcatctcttatagggtaatgatcctttacaatactcagggatcctacactgatatattaatggtcagttataataacaggccatagaaatgtattttgaatgaagcaacctatgaccttttcaaaatactaaaatttctaagatatctgaaacagtagagtttttacttttaattataattgcatatttttctttgctttcttccatgcaaaaatgaccatatatgcctcctctttaaaaaacatgttcctattttcattaattttttgtgacaagcatatgtatatatacataaatccatatttatccctaaattcataaatacaaatgaattttgtatttctcatgctgcaccatgttgctttcatgtgttttcagggttcactatttgatatgagcttatccccaaaggacacagtctgctgtgccaattgtgtgattacaaaggcgaagtctctcagtatctatatagtttgcaattctaatatctctaatatggagaaagtaccctctcacttactgtcctggatcattcaacagcaatttaaaatgatatccagagaattattttggagaaaagcttagagaatgtatatcgatcatgtgtataggggccatatcagagaagagaataatttcttagatattctagtgacattggatttgaaatctatgaactccaggttcagtgagagatcctttctcaaataataatgcagagattgaagaagatgtctggtttcatcttctaagccccatatgcattattaaatacttatatatgtgcaaatgtatatgcacacaatcttgggaacctgtgtgcatgagtgctcacacatgcagacacatgcatgcacatatatgtgtgtgtgcacatgtatttcatttaactcatgcaacagtttctatgcttatttcaggactatggacctgtctcacatgaatttgttcaggataacttgctttatctcgtaaacacagagggtgatatcttattcttgctttggtttcatcttttctttctgagctcggtgtgcatcctactttttcttgtctgtgtggtgagcctagataaattttaggcaacatatgaggcaggtactgcattcatattcttctatagctgccaatgatggatattagtagtcttcaaaatacaaacagaaataagcatacacttcacactagacccttctgtgcctggttataatcaagactacaagcatctatactgagtcactagctaatttttgctaagtaatccaacaaacatatcttctttttttttttctttttcttttgtgattttttgagacatggtttctctttatagtcctggctgtcctggaactcactttgtagaccagactggcctcgacatattttcatgagaaatattactgttcaattttaaatagaatttttcgttgtgtggtagttcatctaaggtcaagtttgcatgctaagtcaagaagatttgctttcagttgaaggatcacaattcatgacttatgtgtgtttccctttgatgatacactatccacatttctttaaaaaatagtatacttgaaagtaagtcttctgagtttggacaaaattctctcctagtaattaccataataatatttattggcacagatacaactaaatctctgataactagaaacaatttctctgatcatggcttctctgcatataggggaaattaaaggacaatattaaaacatttgtttattttataatataaaatcataaattttatactttccattgtttgatctccttgtagaattttcttggatagtttttttattatgtcaaaggttatccactttgaagtcatttttaattaaataatatcatgcatagggactttttactattatgttcaaagaccaaatcaaattataggaaggaaaatgttgtccaggcacatatttaaagtagagagcttatttgtgattctcttataaagccttactacatatataagcacatatgttcatgtccaacagtgttaagaattggtagactagaatttactatgataccaggctgtacttgaacttgcagaacccctctatctttgcctccctaatgatgttgttatagatggacaacatcccaaggtgacagcagaggggaacctggacatagaacaatctacccatgataagttctctatgaattgtgtgacaatgtgaataggctcaaggaaactgctgtagtcatgtaatataactgagaggggctagacttcattcattagccatcttgtaggctatgatttattttaattaatttccatctgtgttggaaattatacaaaatattcaataaaggaacatgaggaatgcttgggagtgttttattttctcttagtcttcgaattgttatgagaatatttataaatagagactggaaatcatttgaggatagtttacaaatttggaggcaattgacttaaattttgtcttttactttcaatgatctttgattactcctcctcctctttctcctccttctttttcttcctcctcctcctctccttctcctccttcacctcctctcctccccctcctttgccacctctgtctctctgtctctgtctctgtctctgtctctgtctctctctctttctctctctttctgataaaatatatcacacagcctcaactagaatggacaatggcaccagtctttccttgaacttgcagaagtcctctgcctttacctcctgaatggggcatataatatcttacctgttagcaaaatttgaattataaattttaacactctgcatagcattctgtttacaattgagcatgttaatttaaacataaagttcattttatattaatttgtaaaagaaagaagatagttctgttcccaatattcacgtgagggagagtgatagccatgtgaagtgtttgtcaaagggcattaactataaagaataggcgccttcgcctactgtctcttcaacagtgagatgagaacatgcagggatgaagtagcgattttcttattcacttcatttctgaaaacaaataactaaagtatcaggcaacaattcttcaacctccaaaagacttgaaaacagttacttcgggatcaaataacaggctattccaagggcctatcttatctgtagctcccattggtttctgatggttctgtacatgatgtatccctgcagcagccattagtaattgaaattgtattagatgagagctttttttcttgaaacaattcaagaattgccacagaaactattcagacatgtctttgagcaaaggaagataatttaatttattgatgatagcttatattttggaagcaaactttttgtgtctattctgtacttcaccagtcatcaaatgtgtcagcaaaattattaaaacctctggctttggctttcttatcatatttaaaatgaaattatataaaaatcaaatctgttaattatgaaaacaagagatcaatctttagcatacagatagtcaataaatgccaggtagacctgcaacacaaggttttgatccacagattatcaaaaaagaaaaagaaaatcacgtgcctgcagaagtcgtaggtctaggtctttctttttttggttattttatttatttacatttcaaatgttatcccccttcccagattcccttccacaagccacctctctcctccctcactctctgcctctaggagggtgctcctctacccgcccacatactcttcttacctcactgccctagcatttccctaccctggggtatcaagccatcacaggaccaagtgcccctctcccattggtatcagacagtgccatcctctgccacatatgcagctggagtcaaggatctctccatgtgtagtctttggttggtgttttagtccctgggagctctcagaagtctggttgtttgattatgttcttcctatagggttgcaaaccccttctgctccttcagtccttcccctaactcctcctttggggtccttgtgctcagtggaatggttgactatgagtatctacatctgtattggccaagcatgtcactcttatcttccctatccattgacttgcattaataacaacatgcaaatgattagtagttacaacttcttaggaatagttgtaatagcccttcaaattactcagactaccttctaaaataatattcagtgcagtgtgtagtgtttatttcaattttgctattcactgtaaaaattcatcaccaatgagcatcgtagatgagggggataagacctgaattattttcctatgaaagatagagttttattgtcacataagagtaaaaacataataatatttcctttatagactctaacatttttgagagatgccattgtatctatttgatagataatagcattatttgaattttgaaaatattactgagcttgtataattatttatggcgtcacaatctccttcaaagtagctattgaacagcaaattttatatataccattttattgttaatttacttgtcacttttaacatttgttggctgttcagtaaatattaactgctattaacaattgtagtaatttctttttaattggtggacatttatatgaaagacagacagatgctgggcagtttctgcttggtttaattaggtgacactgttctgaatttcagccaaggaaaccgtagcaacacagtaattttattattagtgttgattagatgtaggtatcagaaaattgattcaagttgtagagttgattaagtgaaatggttcttcacaatttgattactttcagacagataagaatgaagctttaaggtcaaccttctgtagaaaggaatggtgtgatttaggtggtaaaatattttttttattagtttcactacttgataacgaaatggcctgatctactagtactgaaggaagttcatgttctctatctttctgaacacagatgtcactggcatcatcacagttcttgtccaacaggcaatgacagtaagtggctgcaaattagtaggaaaattaaacattatttattgtagtgttgttctagaaaagagtttattttctatttaagtatggcaaaatccttccacagttatacatttgtaaatttaataagtgctgagagtaaagttgttattaaaatgtttggattacatatgatcttacagaaaagaacaaaaaccctgtccacatgcatataaatgccgacttatatatgtacctaaagaaagtgtactttgctacttttactatatctattatgtcctcataaaacttagagcattgtaacagaatgaattcacctccaaatctaagtcctgctgctaataaacaatcaataacttcagtcagacatttaactcttctaatctttagtgtactggagagccagggatagtgttactaatatccatcacagaacactatatggacagattctggtgatatctataaaatgctgatgagaaataagcctcccactcatgctggcttgcctttactccctggcttgatttggaccatgttcaatcaattcagttagacaaatattgattgcttccctagagctatgtttgactctaggaaaacaatagcaattctgagtccttgcatcttttcggtgattatttagttctgcctgactgtactcttatctgttacccaatctgtttcagtgtcatatatggagctagattaatggaattaaccaggagaaacagggggagtctaaagaaaacgactattttcagcagaggtctataggcatatctgagtaagtgaatatcaaccctgaaatcctctttttttcaattcactgaggtgtattgacagttctgaggtgctctgtggttgggaatagagggttatgaggagcccagaagctcaaaagtttgcaggggagcttcagacagatgtggcagacttcactcactcccttcaagggctcaaggacattaatataaaatcacagaaagtgacatattatctggtttatggaatagctaaataacagtagtttccattgttcacaacagttcctagtcatgcattatctcccttcttcgatgactcatcctagatagcaatattagcattatgattcaaaacctttatcttgcccttatggtatttatttcctacacttatctgttcaccaattataattttatgtgcttgtggatacatgttagaacataaaattttaactaatgattgtttctgaccccaaggagtttacattaaattatgaattgatatttgtgttaaaataagaaattctatcccaattttgctcttgttttataaccgtagaaatcactaagcagagactggggaaagccaatatagaatatgcattgttgtatcaagttttaaagatcaaacagttttaatatatatttttatgcaatgttcaacattgaataatttatatgtcatattgtattttgtgctacaaggtaagattgattattatgctttttaaagctaaataaatgaaaacttaaagtccatatttcattaatttaagatgacagtattagaactgatgcaaacccaaagttttgtgactctgtttaaattattaacaactacaagtcaacggagggtctacagaggtttaactgaataatgtgaagttaaacattgtagaatatgttgcatctgttagtttccatggagatcctaggtaaatgctagcaatcattttgagtagtagaggaggaagtttataagctacatgtcttagaagaaatttcaactctctgagctacaagttccctgcaagtgacaatgttaataatgtttgcctcacctcttggttgtggacataaagtgagtctgtctaacatgctaaatgtagcacatagagcagagtaaatgttccttttcaaatctactaaacaatttcctttcagtcagagaaaaaaaatctgtgatctgtatcaaagtaatacctttgaattataagtaaaatggagatcaccgagatgtttagtaaatgatattcatacttcctgattagattttaaattagtttaaaaatgggcaagatgaggaaacaatattggaatgataaaagaataatacattcattttcttgatggtgaaggtaatttttaatttttttattacatattttcttcatttatatttcaaatgctatcctgaaagtcctaaaacctgtaaagatgttttatcctcacctctcacttgcaaagctaaaggtgatactagggggttgtttataacatggaagaaaattagggaatcagggttcttggtaaataacaatatgcatgaatattatacccagtgtaaaatctacaaaaatttcccatatgggaagcaaaactgcataatgaggactagagaagacattcatattcctgtctttcttatcaatagaagaaaatattagaagtaaattaaaattgttccatttaaccatagggtgtagtgagcttgatgtgttttgtattgatatcccattggttgaactatccacacttgctagtaacaccttctatgagttttggacaagccatttgatggtaaaatttagaaaaatttattgttctaagttaaatgatgagatcataatatacgaattgagagaaacaaagtaaattattttatgttaacagaaagtaaactaaaattaaagtaaatataaattgataatttgtacttgaatcaatatagaggaaaatctgttcaggacaccgaatatcaatggaggcacttgccaccctttttcaaaaaagaagagagaatgaggctgaccatctcaacagcatgtgctggaccaggggtacagtaaattctgtggccgtttctgcatttgaccaacagcattcatcattgtaaagaaggcagtcatgcacctttcttgcatttgtcgtgagtttcactgcagtttttttttcctcagtggatcccatctactgataactttcagaaatttctcacaatctattttaaaatgctgtttttaaactggtatataacgtcatggctaaggacatgtgctttaaaatcacagacagaaatgtggatctaaggtttgatggagatttaacaaacacatgtgactctgcactctctccatagattataaaaagagtagatgtattcaaatgtgattgcagtatctgatgtaatacaaccaatgttctaccatggtacaaacaaggagcattatattcacttgaacaccctgtagaattcaacctagctgcctgggctcagcctatctattcgagtcaacattcttcaatattttagtttccattcatagacttagagtgcacatgtgaaaataagcaaacaaagatgtcaaactccaattcagatataaaacagtgtcctatttcttttctctgtgtatataattttatctgtcctgtgatatagatgtcattaatagaaagctgacaaggcacaaaaatgtgtctttcaccttagaagcaatagaagatagtttattctagtatcaaatatggccatgaacacagctttagattacacccagtacagtgtccctgcatggtacttgtcatatttttaacaataacagcatgaaaaaatttcagatgtcaaaaatgcttttcaaatcttttgtttggtgcattaggcaaattacagccaagtgggaaatgtcttgccctcagattctatttgatcacagagttagcttttgacttgatggaatctatttatatattccaaaattatttacctaatgctcacaaggatgttaggtcacacacagaggtgagaagtataatagctatttaggctttaataactcaagagctttgaactttggacatgcaacattccgacatttcataataattaaattttggatcagtgagtctgttttgaagatgtaaatgattgttgttttctgggaatgtcagcaagtttttacaaaatacaagacttttcatagaagatcaaaggagctcaattatattatttgttatttctgccaatattgtgtttgaccaatataaatatatttagaacagaaaggtattgttaagagtataaggagatagtttactagttaaagcactaaccactaaataaataggaccagagttagaatccccatcaccaataaaatgacaggtgagtgtagtgacccttctgtaatttgaacctcagaaagtatagacagtgtattccctgagcagttttttatcagaagacccataactcgaggaattacttggaagattacatgtaaacacacgaggaatgcaccagaacttgtattcatgttcatatatgtgcacaacctacaggtgaacaccaatgacaatcaatcaatcactcaaacaagcaatagttaggtgcagtgataacactgagtccactgcattttccatggctctttcttgctgcagttattagaaagactatagatgaactaaacagtcttcatggtctggcatccctagtttccctagcattttttttcaattaaccatccttcagtcaacctccagtccagtctgtctgatctgttaggcaatcattatatgcattagttatcttcttaaaggacattgcatttatcgtgcctaggttaatttccccattccttactccttccttgatgccatgtgcatttcttgagagtgagttatttactcctgaaagaaagttgcttcttacagttatggagattcagaagtccaaaattaaagcagaagcaggttcaggaactactcagctccctgcttcaagatcgtgactcaaacctttccacctccatatggaagcaggggagcagcctatgttgccctcacattgtgagagaagatgagagctcacactcttccttttcataccagcattaagccgtcaggactaaaacatctacaatatcccatcatctaacactgttgcactggtgagttccaatttgttttgatggtgatcaaagcataaaatcatgctacccaaagaggccctatgtctttaattacctcaacttatttaagtctcaactcttacatctcattacatctaacacaattaccacagttaacactgaagcctcctcccctgattctcaagcccctttgttattgtacctttcttgatttccatagtctcttccatcctggatgagaaattttatttatttagtgtagtcatatcagcttaataaagtcacggcattaatctctggttaattgtattacctacaatgctttaaagagtgcccgcctcctggtagttgcaaaattctttgtcatataaaataaaggggaatttatcactgtaaggtagaatttcttttggcctgtttatagaaaaggaaactggtcactaagttcctgatcctctgtttccattgtgagataataagggatgaatccatttctgtctgctttcgaaaaaaacaaacaaaaaaaagatatttctcagtatctagacaagagttatgacaggattacatctaaaatagttagtacgagatgcttagagcctatatgggggcaatgcaagtaatcacgtccctcactcagcttatcaggtcttgcttcgtgtgactgcattgatgtttgtgcacacacacatgtgctactgttccttctattgctttgatcttttctaacaagtctgtttatttttgctttgcgtagatgggtccgtgggttttacaaagagttgattcagatcattaaatcctacacaaggctgaataacaaagcagaaaaatctgtcgacaaaatgctaaaacccttcctctgactcagaacctctcttttctcactctttgagtcatcctgtggaagatggctttatttgtttgattctagatttatggctcagtattcccaaaatggatgtgtgctaagatgaagcatttgtttagtgagaaggatcatattttaatttgtaaaaccataaaaagcttaaaccactgcctcaatttaggagagaggagaggaggaaggagagaaaggaggaggaatgagcgaaatgaggagataatggggaggtggggagaagatgggagagaactgtaccaagaatgaataaaagagaaacacagaaagacagtgatgagagaggatgtcccctggagttttacgtgttaggataaaacagttgaaaaaaactatttaaagaagacagcatttatcttgtatcacagttacagtcaatcatggcagctttcaggcagctgctaccattgtacccatatggagagagaactagagaaggggagagggtgggagggaaggagaaagaagagagaggagaggagaggagagcagaggagaggagaggagaggannnnnnnnnnnnnnnnnnnngcacctaactattgcttgtttgagtgattgattgattgtcattggtgttcacctgtaggttgtgcacatatatgaacatgaatacaagttctggtgcattcctcgtgtgtttacatgtaatcttccaagtaattcctcgagttatgggtcttctgataaaaaactgctcagggaatacactgtctatatgagaggagaggagaggagaggctagtgctcacctcttttcttctttgaattcagtacacagtctcagttctcagaatggtggcactcttttaaggtgaattgttcccattaaatgttatctagaaggccccatacagacatgaccagaggttgaatatctaagtgatttgatatcacttcagtttgaaaatcagagttaaccaacacattagatattctgctttactttgtagcttacagtaagcttttgaaaggaaaagtaatactgtctacattaggaaggtcagattagagaaggggaaaacacattttatggtgttctcctgtatcctatgaactggttatgtcctcggttatgtaataatttatcttctgtcagagatcatcttttgaggtgggaaaacacaaggctgctttctgtattggaacaccatgtggggtaatggtgaattaatccatttcttccaggagtcaaataacattgtccatcatctcctctcctttcttctcccctcttctcctctctccattcccatcatcttgactcccctcccatctttcctctcttctcctttcctcctctaaagcttcttgtgtgtggtatattcatgaatatggaaacatttatccatatacttagcggtggaagttcagagaacatcacattatcatcaatcactgttttgacagtgtttctccctgaatttgtgtctcccctttgatttgggctggctagtttataagaccctagtggtatggttacaaatatgctctacccactcagcatttacatgggtgatcgggatctaaacacagagaactctatgttttcacaacagttaccaacagactcatttccttaggcctgccaatttttcttcatcaactttaatgtctcaatacctgaactcatcttaatagagtactctgagggtgtgatggagtttcaagataaatcacaataacacaggatgtgtgaaaaatatgttattttgttctagatttatttttaattatgtgtcagtgtgtatatttgtatgtagataggtgctgtggaagccagctctttcagatcccctgaaacttgagttacagatatgaggcacctgatgtggtccttgtaaatagaactcagcacctctggaaagtcagcaagtgcttttaatctctgatccatcttcccagcctcaaaaatatgtttgtggtgaaaggaatttgaaggaggtttcatagacatgtttcttgcaaacatataattcttagcttcgaagtgagtagaaacgttggggctgcgatggtccatgattcatcctttgggttatatactgcaaagatattgataggaatcgtgcaaagacttcacctaagctggtgttggcaaggctataggagctgtctctagaacttacattgtctacttagagcaaagctcagaaagacagcagaactgaaagatgatctttacacagagagatgcacatatattgcctactctaactatatttttcattttgatactgactagaccacactaccaagtacctttctattgtaatattatagaaagtttttttatgcctaactatttagaatctattttctttttctgaaactgaatttcccctttatcatataaaattgccccaagaaacaaccaggataatgtcattgttcaaatttatgaatctacagactttaagatgaacacattctgcttttgtattgtaaatcataccgcttagttttcaatgtaggaaggaccattcagagactgcctcacctggggataaatcacatatacaatcaccaaacccagagagttttattgatgccaacaagtgcttgctgacagaagcctgttatagctgtctcctgagaggctccaccagtgcctgaccaatgcagaggtggatgctcacagcctaccattggactgagcaaagggtccccagtgaaggatctagagaaaggacccaaggatccaatgggtttgcaggcccataggaggaacaacaatatgaaataaccagtacccctagagctccttgggactaaactactaatcaaagaaaacacatggtgtaactggtggctctagctgcatatgtagcagaggatggcctagttggtcatcaatgggaggagaggccctaggtcctgtgaaggttctatgccccagtatagaggaatgccagggccaggatgaggagtgggtgggttggggaacaggaggagggaggagaggatagaggatattcttcggaggggaaactagataaggggataacatttgaaatgtaaataaagaaaatatctaataaaaatttactattttcaaaaaggaaaaaaaaagcataaatttttaattcacttaatgaggaatcacacaaaacccttatgcttttgaaaggttttattagatctttgtaattcaatttaatttacttcaccaaatattttctaagcatattttcacaggcagacattatatattgtcctaggggaagaatataaacacaatatggtcctctttctttaggtgtgggacttttatataaattagaagtatcttatgataactgcaataatgaaattaagtacatagaaaccataggatgtattctaaagaatgaggttataattttttttttataaaaaatttcctgatcaacacacacacacacacacacacacacacacacaaacacaaggccagggttaatgctatatttttgatggtactatagaaattatcataaccttggtagcattaaacagcaaagctgtattctgtcataattctagagaccagaagtctgagaattaaagtcaaatcaaaatatttgcagggtgatactgccccaagagtctcctgcatctgcaggttccttgaattttctgtcttctgatgattggtaacatctaaatatctgggcacattccttcaacatctgtgtaaagtcattttgtaaacctctcttttatggggccatccttctttatctcctttgtaagagtgcttgtgatagcactcagggcccttgtggctaacccaggttattgttatgtcagcatcctttacttaattacattttcttttacatgtagaactggaagggtttagaaatgaggctatttggaactactattcaatccactatgatggataaaggagaaaattacaatattgtagatttaagggccaacaactatgccaagcatgctgagagtttgcttataaaaaactcatgagagagttttctttcctctcatgagagaaaagaaatcctaaacaatgacatagcaattgtattcaattaggttggggataactgtgatctagttaaataaaacgttctagcttagggtaatcttgtaaaaagtttgcctcctagaaatttactctgtgttactccatgacttacaaagtttcaataggttttaatatttggttgagattattccatttatttttcaattaaacaaaggaatccctctgttccttgcttcaggatttcaatcaatcacaatttatatatttattcactatgtatttattgaattcagtgagctacacactgccttctatggataaagatatgaataagaaaattcaaatacaaggcagttcatgccttcaaagagtacataacaaaacagaaagatgtacacactcaatatgcagtaaataaaatgtagatgacactaagttctatatgacatactaatgtgctagtggagatgacagtgtttctcacagaaatactttagcatgttcacacactaggacagaagggaagagaatcccagaactttaaatttaatatggaaaatgcatatgtgcctagcattatgggctcagaaaggtttaagaactttgattatgctggagtctgagatgaaactattggtaggagataaacatggagagagaaaaacaagcataatctgaaaaaaatataccctaagttctttctggggtagaatggatggacctgggagagaagactatcatctcatcgcatggcatatactatcataatatagcatattattacatgctattacttttgtgagataaatggaaccagaatttatcccttttcctccagaaagaagaccaacttctttataaatggcatgtcctccaagtgctatatactctgcttagttatctttggtctatgtctagttctctcattctgcacagcattacctattcacaagtcatgatggcaccccagacattcattaggccagtattggaaaataaaattatggagtttccttgaagcatcctctctcatatttgaaaacatttagtggcacaaatgggtgcatcttagaggtaatttaccatgtttacatttaacagattattttaatagtttcttttctcttctagctagaacatgcttcataaaactgtacttcttcctacagtggatgaagatattactaatgcctcccactgatccaggagttgaatttccgtgttctctacaggcgtttgggctattaagatcttcagagaaaatggtgtttgaaattaggattttatagtttagaaggagaaaagttaaaagacatcagaatgttttggaatatgatttcatataagcttagttttagactgactgtgggtatttattttacctttatcctttatgacttgtcagaaatcagataatctctctgaacatctgctccttgccagtaagttagaatcacaatctagtagcaattatttttaggaaccattcacacaggtacacaaagcacaagatacctatgtgtgccaatgtagtgtctgggagctactgaacatattctcttactgtctatagtcaatgcccaagagggaatagatgactggatgaatctgaagttacagagaaatgtatgtatgtggaactgttggcaagggtgttcaaaatacaagtgaatcaacacataagaatgaagtgtaagaatgtacagaatatgtcgctacatcaatggaatctgtctatcatacaaactgtttacttcccaaggacccaatgaaattgcaacaaataatccatataaagtatcttgaactgagatgtcatgagatatgttataaaatcatgttaatactgtttgttttccttttgaaattacctgattagaataaatcagtctttaagttgttcacatttatctaaactatttatttgtagtgtgttaagaggggcagaggtatttattacacacttttttaggttattcttatgtcaattatgtaaaatgattgcatatgtacaaaatagagactgtggcattagaaggcccaggtttgaaaaacataatttcttgcaaatacattacaaacagactaacttccttcagtcacattattcacttgcaaattaataatgcagacttaagttcctcactcaaactcttatgagattagttttgtatcacacccacaaattgaccaggacttcctactattctactcctttcctctctcatgcagatcccatgtcctggccatttaccagaatgtgatagaaaacaagacaagtctttaatactttcagtagcatggactccacttaaatcctgctcacctgctatgccttttacattgtcaacaactataagcattagcaattggaattcagctgacagttttctcagcaaggaaaaactagctcccttttaacaggaaggtctgttcctgtggagttaatcagaggaagaacttattagatcagcagttatatcttaacgttccaaaccacaacataatattttgttaagagtcatgtgtgtaaaccgttttagtgttagctgacagtgtacttatttgcattagtcttggtaagtggagaggaggaggatggttctgaaggtttctacctgagtagcgatgcactattccagtttttctcattgtttaaatctctgttctgtaccacttaaaagctatactttatattagtaaaatggaaaatagtcaatgtagagagccagagagctgagcttttaagaacactagctgcttttatagtagatctggtttgagtcccattactttcaggacaacttgcacctgtgtataatttcagttatagcgattgtctttgggtatcagtggatgatggccatatacttggtacacacacatacattcagacaaaagacttatacatgtaaaataaaagtaaatcaatgtttgtttgcttttcaagtcaccatactctgttttctgtcagaagaaagaagtatttttaaaaataccaaggtagttagtagatgactcaatccttgaagtgatctgccaccaatcctaataaccagagttcaatcatcatgacgcattaagtagaaggagaaaaatgactgccacaaattgtcttttgacttcttcaatgtatactgtggcatggtgtcctctagtctaaacacactggcatattcaggcagagagagagagagagagagagagagagagagagagagagagagagagagagagagacagagagagacagagagagagacagagagacagagagacagaaagagacagagagacagagagagacagatagaggcagagagagagacagagacagacagacagagacagagacacagagataataaataaaagataacaaaattaaataaaaataaacactagaatgtgtttaccttaaaggttaagtctcaaattggaggaaacagccaagcattgtgatcaaaacagaagataacaatgttttctaataaccttttcttgagaataccttataaacttgtcactacaactaaactttaacaaacaactagagctcaaaacaaatatttgaactctaccagcagtttcttgagctcaatggaatgagatgggaaagaaaacagccattgattttttacctgatgccttattagaaaatggcactttagagggaacctgaatgaagatagccagatagcctgatggtgatagccagagtaacgaacggcactttggtaggaaggaaattggtcagtaaaatgaatggttatgtcccaagattgtggtccatgaaagaatgtttctacagttatgaaatgaagaaatcttgacatggattcattctcaaagatcgattgacaaaaggagcacaaaatgggcactttctctattgaaagaaggtcagactgacacagtaaactatatgatcttgatgaaacatttctgatgacctctgttaaaaaagaatgtgtatttggtcatggtgccttcccaaatgcctttgacttctgtttcttgagttcttccttcatgttagccccgaaaccttcttccattaagtgcataaggttagtgaaccttagttccttgtgggaatatgccttacccaaatgaattaaacctatcaacttcccctgaaactttccatatatcccatttgtggttaagaaagcaacatgtatcctttgctttctatcagaatccttttatcctccttagctacacaatgacgtgtcacttactgcacagtcccttattccttttctctactgctgtgatggctattctaggttgcaaacttgactatatctggagtgaattaactaaaacccaatgcatatgcatacctgtgagggactttttttcttagtttaatcatttgaagttggaagatagacttttaatataaacctttgtagtgggaacactaatccaaaccttttgatgggggaaggtgtacctttaatctggaccatcccttctgctggaagactatagaaagggcatggaagaaagaagctttctctatctctttgcctgcttgctcctcattttgccaataagtccattccttcactttcattagagactacttcttcaagagaataggaacaacaatatgaactaaccagtaccctgcagtgctgtgtctctagttgcatatatagcagaggatgtcctagtcggccatcaatgggaggagaggcccttggtattgtgaagatcatatgccccagtacaggggaatgccagggccaggaagcaggagtgggtgggttggggaccagggtggagggaaggtatagggggctttggggatagcatgtgaaatgtaaatgaagaaaatatctaataaaaaagtgccttaataaaaagagtatgtcttctactgaagatcagctgaaatgtctaccatcgtgaactgaaaaagtactgaattcttagtgcagctattattggactaagtaaacaacagtttgtaaaaatcctctgtgtgtatatgtgagtattatatataaatatataaatatatatataatatacatatatacatatataggtatgcatatatgtttctttaaattccgtattttagagaatgctaataaagctattcaatattatttttatttaatgtacatgttctaaatactaaaatctcctctacatggtataaaacaaaggaatgaagacctttgctttttattctactaattgtcttaagggtgcaatgtttcatttgaaacattgtgttgtgtcaaatggtggaaattgtctaggccaattcagagtatttcctgcaaattgttctgttggaagctggagaactaaggtagacatgctagggagtaatgtatttatggctgacattacgattcagtaaatatatggataaaagaagaactagtatattgtttatatgccaggcactatggcaagtgaattctttagaatgtaacactttctctgataatagtctaagaatataaatgctaatatttccattttgaataggacaaatatgccaactaatgtattttattgctatcttatttatttacatttcaaatgttgtctccttcctattttctcctgcacaaatcctctatcccattcccctcccctttacctctatgaaggtgatcccctactcaccaacccattcccacctcaccactctagcaaccccttatgctgaggtatcaagtctccacaggaccaagggcctcccctcccaatgataccagataaataaatcctctgctacatatatatctggagccatggttccctctatgtgtattctttccaaccaaggtattttattagaaagtgattatgtataatgttaaactctaacttgaatggttcttcaatgctgtgttatacttgtaatatcccacagagctaatccagaactgagtgctattaataatttgggggtacattgatgatggtgtatggtttacaaggacattgtcataacccagttttttggtctttgaatttgcttacaatgttccagacaaaatattatgtacatatgtacattgatgtcttacaagcatgtctgttgctctagtaaaacactatgagaaaaaaacttgggaagaaagtgtttatttcacttcacatgtctcaattacaattcatcattcgtcatgaaggatgtcagagcaggagcctaaccttatgaattgatccagaagctgtgtgtgtgtgtgtgtgtgtgtgtgtgctacttactattttgctcattcatgacttactcatcctgctttcttgtccaatttaaatctgcctattcagaggtggaggagtgtcctaccctgtggtgttggccctcccacatcaatcataaatcaagaacatgctctattgactttccataggcagtctgcttggggcatattcttaatgaaagtttctcttctcaaataactctaggatgtatcaagttgacaaaatctaaactagtacaattggctattgcagactcacaaaaaaccttaacctcaaaatgcagttgtacttcattcagtttttattttttgaatgataaatgatattgagaattttcctgtgcttatatgctatgtgtacatccttttggcaatatatctaatcaatgcattttttctgcccacatatttgtcgagtctgtaattgtaatattcaaattccagtaagtttgaagatttaatcaatgaaagatgggtgacacatgttagttatatctctcatactggatacatatctccaaacatagtattttccttcatgaatatatatgactatgatttattgatttaaatcatgttgattttgaaagcataactcgagtatttcatgctttcatttgttatgaccccccaaattcaaaacaattgaacatgaaataagttgataactcaaggatggaatttttaattacttctacaaggctaaaagggaccataacgaacacagctgactagttttcatatttatgaaactataggcagttgtgaatcttcagagattattttgtctatttataaccctctgaggtaagtgagttctttgaaagttggggttaacgtcccacatatctaatttcagtaattataaatgtataggttctttttggtttcaaaaaaaagaaaaaaaaaacttgtaactaaaaaagttgagaaaaaacagaaagtgttaattgtctaactaatttctataattagaaggttattttcatcgtgccaatcattagggaatgcttaaataaattgaaatcactctagaactacacaacagaatgaagtcttagtgagtttgggtggcatactataaaaagtttgttaaatatataagttcacaatgtcaaataatgctttataaagagattttgaaggttattcatggagttttctactctgtgagaaaattatcccttgagagatatacttgctatgtagccttggctagtcatgtatgtgattggcatgtaatggttggttatcactttttgtttaattttatacttaaaatagcataatttcaaatgttttacttgaaagaaaaaatgtctatttatatttcttgctcctgtgctttagaatgatattttgtttattcattcattcatgtattcatctttgaggggatgatattgtgagttcttccacatgacttgctgtagagtaatgcccaattgatgtgtgttgaatgaataagctgaggaaatatagccattggatctaaaacatagccttattttattccagtaaataatttaatagatcaaagtgagaggatgacttctgtttctgggacaatttgctacaaattaattctagatctacacaaggaaaaacccactgtggttacagcaactttctatatgccctgagaagagagtgatgtctgatcagtaaagctctttgctatagcgtgaactgaattgctcttgaccttgagagatgataaagaaatatattgtatagtgtttaaattaatgttcatgaaagttaaatgacccaaactaaaactaacaatgagtccattcttcattcactcatttaatgaatatttaatataagaacattactggctagatgctgattgcatgtaaagaaatgcaaaaacagtcattaatctaaaagagtttataatttttttaaagacagatatacacaggaagatgaatgtgagttgtaggttaataccagactcttctatatcaaagacatcacaaatttcaggctcaaacaaattcttagaatcattcctcctcaatcctaggaattactcttcatatatagtgcttgaacacctgttctaaattacagtatgaaaacagaactgtgtttgttttattttgttttgttttattgttgtttttctaaaaaccctatagttcctgatatagaattatttacgcttgcttgtttggtaatgctataggttcatagaatgttttcacattatgcacaccatgaccttggtcttgaaaaattaataggactttgtcagtcagagagagtgagtgagagagagagagagagagagagatcttaaatatgtggcagaactcatatacttaaatttcttttttattttttattttattttattttttaatattttattaggtattttcctcatttacatttccaatgctatcccaataaacacaagctccatcttgccaaatttgaaagacaaagaatacacacatatgacatgtgccatcctggtactgatagttaatgatcatgttagtcatgggcatgtagaattactgtggatcagggtcaataaaagctttattgaaaaggattagatagtaaagagtttatgctgtgtgaatcatgatgtctctccatggagagactcccaggtcaactctgaccatataacatgaaacaatctgtagattctatgttattgtatgggtgtacatttatctgagtaaagctgcttttaccaaaataggtagcaaacatgatttgggatacatgctgcaatatggctatccctgaaatataaaatgtaattacttcatgaataaatgagtaaagatgtagaatcaattactttgaattacttatttaaaaaaatcacagataaggtgacaccttcactgaaaagaaattcaaattaaaagaacaaaaaccattgtgttatttgcaccattaatatgatgcaaaataaaaatcaggacaaagtcagaaatggatagaagatttgctattcttatatagatctacaaatttatttaaaattttatgaagctttaaaagaaaaatacgtgtagattatactatgtatttttgttttgtacattaaatatatatatatatttttttttcaggcctcctagcagtcattatgagtagcatagctttttccatttcacaaaagaattctcaatccagcttgctaagtaacttgccttcttaataagatagcaaagacagtttctcctttagtcttaatgtgcttgctttcttaactctctgatgtacttgatctataataggaaaatttaatatgtgcatcctgttttttttttctttcttcattgaagtgtttcctcaaggaaaatggatgcatattatctcagtcctaaaaaaaaataacacttccataaatctcaagcagtatatgactggagaatgactcatctatacaactaaatacaccatagttctctaggaggtgatggaggcctctgtgaatatagaggagtgggtagccaagcacagattaactgagggaatctatgatgcattaagtgtacataggaagatgcatgtgagctgtatgttaatactggactcttttatattaaagacatcacaaatcaaacacattcttagaatcaatccctcctaaccctaggaatttctccccctatataatgcttacacaccagcatagaagcaccaaattacttttaggcttcctatgatacactataaatactatatgataattattatacactatattgtgtttaatcagtaaatttaatcgtgcacatacctacacacattgaactacccagcacacagaatcatctatgtatcttttttttcagcatttatatagtactttgctaatctgcatgttgttcttgtcaggttcagggctgagttccaagttttccattatagaatctcctggaatttttattttctatttagatttgtgtgtttgttgattccacagatgcagaatccatgcatgaactaagctactgttacatactctaaaaaagtaatgagagctaagcaaagcattcttatgtattgtgttcaggcataattatttgtgtatataccttaggcaaagaagtgcgaattatgttcttgctactttaacattgtactattcagagaaaagaaatatgctcttccttttccttcatgcattttgtccttggtctctgaagtggtgtctggagtgttttgtctgtcatatctgggttcaatggccatttcctgctgtgtggctaccttgaaaagcaatcattgcatatccatgcttacagccattctattcccagctgagggccacggcagagcagagagaacattacattccatcttgagcagctctggtttatggtttcatttgctttgttcaacatcatttccatctttccttatgcgtctgtagggtaatgggtgagggggggggggtgattgaacagaaaagtcaccgttagtatcatgtttgaaagtagggattattgcaagtggcactgagcaagtggctttttttgttgttgttgttgttctctaattcttgtatattctagaaagagtgcttactgaacacaaaacaggtttaacaccagctgacatgccctttgacagtgctaacaattatgagcagactctggtttacactagggatatgacagagtaaatggagaaggatgaactacagaacaagcatgagaaactttcttgctcttcagttcatttttctcaacttcatttgcacagttgacatatctgggaagcttatattcaactcagttagccccagaccctctatagagcataattttgttaatctgtacttgaatccacaatgaaggtgaatcgtttgatcattttccagacaattgtaactaaaagtgctaactactcttctgaaggccttattttggatattacttttgaatgagaaatttaaggacatatctccctgccttctaatagactcttctctcttccccagcttaagaaacttcactgaagttgttggtaatagcactttgaacctaagtctgttttgtttggtttcagaggcacacagggacaaattggcatttgaatgataccagcagcacttcttatcttattttatttattaatatattaatctaaccatgttttatataaaccaaaatttaaagtgatacacattaataaaaacagcaaatgtcttttctggtccttgaattaaaattcataattattgctttagaaaagaaaacctttgttttacttttttttttctttaatctatttttacagtccaaactttatccccctcctggtcccacacctcctacccctctgtctccaagaggatgtccctaccttcacccttataccacccttataccttatactccccaagtccctagggccccaagtctctctaggtggatcttctctgactggatccagacctggcagtcctctgctgtatatgtgttgcctcatatcagtgtatgctgcctgatttgtggctcagtgtctgagagttgctggggatccaggttagttgaggctgctgatgtttctatagggttgcccgactcctcagcttcttccagcttttctctaatttaaccatggggatcaccagcttctgtccattggttgggtgtaaatatctgcatctgagtctttcagttgcttgctggccattcatagggcaatcatgataagaccatgtttgcaagcacaacatagcatcagtaataatgtcaggccttggggcctccctctgagctgcattccaattgggacatgtcactggacctccttttcctcagactcttctccttcctggagttctttcagacagaaacaattctgcgacagagtttttgactgtgggatggcaaccccatccctccatttgatgtcctgtctttttactgaaggtggaatctacaagttccctctccccagtgtaggacatttcatctacggcccctccctttgagtcctgagagtctcttacctcccaggtctctggtacattctagtgggacccccacctcctacctcccgaggttgcctctttccattctttctgttgtccctccgggcttcagtcctgaaccaacattacctgatatgttcttctcttcccctacctgtcacctttcacatccatgtccctccctgttcctgtgattgttttcttccccctcccaagtgggattgacacatcctcactagggcccttcagcttgttaaccttcttgaattctgtggattgtatcttgggaattctatatttttggctaatatccacttattagtgagtacatactatgcataacattttgggtctgagttacctcactcaggacaatattttttagttccatccattttttcctccaaaattcattctggaaatcaatctggaggttccaggttggaaaactggaaatagatctacctgaagatccagctatcttttgggcatatacccaaaagatgccctactatgccacagggacacatgttccactatgttcatagcagcctttttttgtgatagccagaagctggaaaaatccttatgtcccacaacagaagaatgaatacaaaaaatgtggttcatttatacaatggaatactgtttgatttttgaaacaggctcatgtattcaaaccaactcataccttcctatagagtgaagtttgacattgaacttttaatctacttgtttcccagatactagccttattttcttctctaggtatgccttgcttattctggaaagttgtcatttaaggtgaataattaggacctggggcatttgtataacacctataatcctagaagcagaaaacaaatgactgctttaggttaggatctcaggaatacactgtatagataaggagaacctagaaagggaaaagaggcagaaatagagcacagaagagaaaaaggaagagaagagaggggagaagagagaaggggagatggaggggaagagagtgagattcaagattttcaaagagaatgtgaaatatactatttggatttttgcttaaattttttatcacatttgttgctctcaaatctgagtcatataaatttattttactcttcattggttttagagatattgtgatttttcttaaaaagataaaacattctatcttatacagttttccattgtcttctctcttctgatatcaaaataaaatggttaagagagacataagataagaaaagattgcattttaaattttcaggaacacaaaaaacctgttattcttatgaaaagaatggagctttattactctatcaataaccagaacacatttcttggcttctgaaaaaaaatgacatacacactgcttctctccaccaaagtgggaaatgcttgcttttgttagactgtatttgtataagtcactaccatggtagcatagcgctttgtcaagcatgggatttttcttaacacaaacaacttgaagtctctgagctgaattttaatgtgtcttttatatatcaaaacagactgcattgattgatttaaatttgcaagcttttttgttgttattggaggtaatctagagtttaacatgattgaccattcaataacatcacccattctattgtacttgttgttatctctaagacttaagaagatagttgaatcttctgcaaaacagtggaaaattttgattcaatgccaacaaagactcaaacagtaagttatcatgacgaccacacccatggaaaccatgtgtttcctaaagtactcaggtgtctgtagcaacatcccttatgagcgtgttagaaatcttttttttttttaattttttattaggtatttagctcatttacatttccaatgctataccaaaagtcccccatacctacccaccccaactcccctacccacccactccccctttttggccctggcgttaccctgtactggggcatataaattttgcttgtccaatgggcctctctttctagtgatggccgactaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagaggcagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactccttccaagggtgttttgttcccacttctaaggagggacatagtgtccacacttcagtcttcatttttcttgagtttcatgtgtttagcaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgcgtgttagaaatcttaatgtgattctggagagatagctcagaagttaatgggtttttcaaaaagacccagatttgaatctcagcatccatatacaggttaacagtactataattccacttccagtgggcctaaccccctcttctggccttcatggacactggatagatatgataaacatatacatgctgcaaaacacactgataaaataaaatggacctaaaacaaacaaacaaacaaacaaacaaaaaggtgggttttttttttgttttgttttaagaatattcacatatgtgaatcccatccctgatctatggaaacaaaatcctcagagtccagaattcctgaaattcctggtggttgagagatattgggtatgagagactagaactaccatatctatctgattctcatgaaggacagcaaattctctcaaatatggatcgatttctccagcctccatcccaacagtttgaacagggcttcaatcctttgctactacatggtaacatttaaactaagctgtccctgcatcagatgtgtttctgatggtagatatcatgtctcccataatcctgtagtccttctaaccatagaaggaaatgatttattaataaatgtgacagcctcctgaaccacagaaagcgctaagcacttattatctcacagaaggtaaagccaactgataacctgcaatccatgaggggctaattgattctttcatcattgttataaaaatccagctcattagctctgtaggtgcaccaataaataatttgtgatctataattgtttatcaaatgctttcatcttttgtgaatcttatttagaatggtattgtgctgtggatggcacgtattgctattaatcaatgagaactaatctttaagaagtacaatttgatgtgacagtgaacaaaaatgataacaggtgactcagctaacattctgatagcatatgtggttatgtggagtccaacaaaatctggtgtcatttgactaattgataaaaaacaaactctgggggaaaaaaaaaaaaactctggctttttaaggctgttagatccaattctttagaaaaattttagccaatcctattaatgtggaataatggggatggaacaaatttgctttatgctcagcagagattgcactgtcagcctcatgtgttagttggtgtcttagtcagggtttctattcctgcacaaacatcataaccaagaagcaagttagggaggaaagggcttattcagcttacaattccatactgctgttcatcaccaaaagaagtcaggcctggaactcaagcaggtcagaaagcaggagctgatgcagaggccatggagggatgttcattactggcttgcttcccctggcttgctcagcctgctctcttataaaaccaagactaccaacccagagatggtcccacccacaaggggcctttcccccttgatcactaattgagaaaattccttacagttggatctcatggaggcatttcctcaactgaagctcctttctctttgataattccagctgtgtcaagctgacacaagaccagccagtacagttggagtggagattatatgctggggtgcagccaaacagatgagtcgagaagcatgacttaaaatgctttgttctttgaacatgctctaatccttgaactttaaatcaacacttctgtattatttttccagctgcagaaagctgttactttattgtttataagtgttgattcatgtcaatcataatacgactagatttgctttggggaatctaaatatcccttatgtctcattccttctggtatatttttgatcctttcttttctaagatgtaaaattgtactccctggattcttcttctgctctcagaaagaactaattaaaaagaaaaaaccctataaattttgtaactattttcatctccctttaatcctttagtagcaatatagttagagtcaacaaaaaacaagctttgactcaggtaagaaaaagccttttttaaacagtttaaaaataatagcagtaatagtagtagcaacgtcaatagtagtattagtagtagtaaattttaggaaagcagacatgagaactgaatgaaagagaaatattgcagtgcatgagactttctgaccatgcaatctccaacttcatagattaggaagggaggatatttccttttatagcaaagggtaaatgagattaaaatctcctcgtgtaagcaagtgagcatactactgaggtggagtaaaagaggtacacagaacaggaagaatactgaagaattttcacaccaatgtgtgtctgttctctgctctgagtctgtgttggctctagtggaaggtattctgaagttcaaggatcttggtgaaggagaatcttaagaattacaagcagatggtaccatgaggtcactagagaatgtgatgacagatgggaactggtaatctataatctgtatctcagacacaggcaaatgagggagcatgctttaatcttactggagtcatatgaggaagactatgttgtactaaggtattttccaacgacataaagaggttggtagtaggttagtttcttagggccattttaaatgatcagtgcttctgatgatcacaaagctaaagtcacttttcaacaacatcatctattccatgcagcttcttggtaactagtagtggtccttcaatgggaagagcagttctatttattgaaacttggagataggagggagaggaaaaaaaggggggggggcaggatcaggtactgaaggggacgggagaaaagtcagaaaatcaaataaaaatatgtagcagtgcgggatgaagagctgggtatagccactggtgagtcccagattacattccaaggaaaagactcccagaccaaaaggggagaatagagaaggggagatagaacttgtagagactgcctccagtagataggcacagctgctagtcaagagatgggccacccatctatttcctagattttaacccagaaatgttcctgttcaaaggaaaaacatagacaaaatctagagcagagtctgaagtaagggccatcctgggaccgaccctgggcatccatcctgtctgcagataccaaagctggttctgttgctgttgccaagagactattgctgacatgaatctggtatggctgtttcatgggaggttatctcagtacctgaccaatgcacatgtggatgcttgaagccaaccattcgactgaacttagggacccaggtgggggagctggcagtagggttggaggagcagagggggattgcaaccccataggaagaacaatgtcagctagccggatcatccagtgttgccagagactagaccaccaaccaaggagggattccatagttgcagatacataggtagcagaggatggccttgtctgacatcaatgggcatagagattcttggtcctgtggaggcctgatgccccagagtaggtggatgctggaagcggtgaggctggagtggatgggtggttcgggaaaataccctcatagagacaaaagggagggtggggagagggcagataggatggggagttgtggtttgataacaaagaggggaatttcatttgagatgtaaatgacaggaatgattaaaaaaaaaaagttggaaaagttgttcctaagatgacaataggaactttcaactccaggctgtgttttttgtttgtttgtttgtttgttttttattttttatgtaaaactagccctagttttactttgatgtcaaaactataacgattaggatgacaaaccgaagactattctatgtaataggtgcttgagacaacgctggattacaaatggttttctagaacaaagtaaatcaatgcctcttttagtcatgtcttcagcaagcatcatagaacaaggaggggtcaaaaagaaaaaaaataggcttctgaagaatctgcttctctgtttcagaagaaaagataattcgatgtttaacttagagcttctgaccagaatttcattaaaaaaaaaaaaaagaaatcatctacttttcaaataaaggtagtaacttaaggctttgctgagacttgaagcatgccctagatcaatgaggattcttctggctaaattcctaaattctagtatgggcttttggaggcttggatagcctattagaccagaggccaaaattttcccttgttggtttgttttgttctattgtttagttcctgtcagcaaattatgctttcacttctgtctttctcttccaaattctaattgcctattttataaggattctttcatggtattattataaatcaatatattttcactttgctcaataactgctctgtagacgttgcaactctagttgggagaatctagattattgtgtctgaagaaatgagcaccacatttggactacagatctgagcaaatgagatcataaagaataacaccacatcattgtacaaattcacactgcactaaagaccctagctaggaaattagaggtaccagattctcattattgatttttgaccaacaacatgttgcatgtacaatacaagcatagctgtgtaagctgaaggttacgatttccagagtaagcaatttcaaagttcaagagatttttgcaataaaaatacctaataagataattttaggaactgtttgattgactgtacaaaatgatgtcaatgcaatggcttctcctttcttaaaaacagtaaattattcagccagacaagagtgaaaattttttaggtatgagttttaggctaggctcctttattttttttctaaagaacaaacatatatctgtttacatttttttaaattaaaggaaagtttaaagatacagaatgatgagtggtgtacatcaagcaccttaagatcaaggtgtcctctctacacatgtcctttgctttgtttttaaaggaggaagtttaattaaagaaaagtttgagttgccccctgggggaagagttgtttttataatgataacagccttttccagtggtaatcttttagacataaagaatgcttctgtttggagcccactggaatttaactgaaatgcatctgtccccagtgggctttctgaggatctacttagggaagaagactgatacaatcttaacagctgacatctggtacaattgccttcgcagatatcttttcaaaatgacttctagagattgttttgtacatactttgttttagaaatgctatttaatcttttcaccttcacatcctttttaaataacctctatttcattgtttatatcaggcaatgtagcatttccattaattgctttctaagtgcatattccaggctaattatcttttctaacaaactatttaaggggagacctggacagtcccttccctgtcttcttttgtgttgtcctagataatcttgtgttttcatgaagcatctacaggcactgctcacagaccaaattgagacgcctctattccatctcccaagagatagaggatgcctgatcctctgaagacataccttcagtcccagcatatgctgcaagattctaaagtcatcagccggaggacggtagtgacatgagcatatttgcttccccccaagttaaatccatagtagttcccttaggatgtattgtttgtataatatgagttacaatatgaaaggagtagctatgtaaagtaacaagccaatgtataaataaaaagatcaaatatattggcataccttgctctggctttattcagttagctattttacttcatgagatctacgctatcctacaagggaggaacccaacacaactgataggaaagaacaactttggtttgagataggattcatttgtcattaccacctgggaacccacatcagaggtaaatctttcaaaatctacagtcaaattggctatagttttgtctcagactgatggatgaattgttcagatttaagcttgtctgttacaaattcttaattttttttcctaaattgtatttcacacattggaaaaatatgtttgaaggctgacaaaaatgacaaatgaagttgctggtagacacgcattgctgtatttatcttggtgcttccatatgttttcatgaatcaattttaatgtcaagatgcatttttttttgagtttgcaaaaattttattttcaaaatgcttactcattaataccttcattatcaccattaagtgtggtcgaaatctattcttagatagcttttattcagcccaaattaactcagagcattctagaacaatgaagaaaactgctaagtaaagatgaataatgtgaaagtgtgtgtgtgtcaagcctcttgttcaagttggtgcctatataataaaaaacattaccgctccctcaaaagcatgatttaattatttgagtatttttagtttaaaagtatgtgtgtatacttgtcaatgagaacagctttgctctaacttgtgaagagccatgtacattatttgttgagaggaggatttttacaggggcaggcagactgaccagacattcccaggaacctcctgttaaattttaacctcctgttaagacagaagtcttaacattggaacttaaaagctagccacccccactcctatttttttctaatgtgagcgttagagctcaaactcagatacacattcttttacagagaccctttactaactgaaatgtctcctagcatctttctttctttctttctttctttctttctttctttctttctttctttctttctttctttctttctttctttctttctttctttcttccttccttccttcctttctttctttctttctttctttctttctttctatgtatagactgtacatgtatatgtattattactgtacagagtttggtcatctagaacttactttgtggtctaggatgaccttgagcccttaataatcttcctgtgtcaacttcttggcactagaatttcaggtataagccaccaaatctgactcattatatgtttctagttttgaaataaaagagtttgtttgtttttcttacccattttacatgtgtagttttatgggagatattcaattagcataagccattaatatatatgtatctggtccctcaaaagggtcctcttaagtgaactaagtcatacattttatatagattatgaagcattcaaatttaagtcaaagatctgaaacatttgaagctaataatggaagaataattttattcgctcccaactacatcatataggtaattccaactggatttacttgcaagctgttggtaaatgttataggtagattaaaatatgggactccagaaactgaactaatttgatagctactaagtagggaagtgggaggaaaaagaacattgacagtcaggagccataacactataccatgtctaagaaatgatggttgaaaggaaacctatttcctttaattccttgtctcttcattaagattccaagtttgaataactactgtcagaaatataacgtttatttacaaagatgtaaagatgcttctgtcagttgaattgctttattttaggcagtgctgtactttttgttatgctgcttgatattctgttgagaacttcatatctacacccatatctatgactgcaggtgtcactgagtgctaccttgtctcttatcaaaatatctaataaggacagagttgacactctgattacttacctcaaaatatacctgttaccctttgctcatattttgttatgttctaggttcatattaggacctcacctccagaaccccaatgttcccacatatctaaaactttatctccagtgcttcgtgtagcagtggggggaaaaaagctagctcctcattatctctgattattcaagctgtattctcccatgaaaacaaacttcctcaaatcaagtgtaggaaaaaaatctttactatatatctactgcgatgatcagtaactgggacataaataacaaacattgtaaatgttgtgtgaataatctgcagaatggatagattcatatacatagatgaatatgtggatttatgtgcctgaagatgcataggtggacagtctataccaattagcagtgactttttaggtttcattaaaggttagcaattgtaaaccctacaaagactcttgggactggatctgtttctgatgaaaacttgtcagaattttaactacaatgcttctaaacttttatataaaaatgttttatgtcttgagttttaagaggcactgaacatatctggatgtattaggtttctttagaggaatatgcctgtgagaatgaacttgctacaaaggggatttattagattgacttacatagtgcatggtatataaccaaataatgattgtcaatataatacagaacctatgaacatggtagttgcctaatacataaaactggatggctcagaagtcacaatgtgataatgaaggttggaggatacctggtatttctaattcttcagtcatgttagaaatccaaataattaggttcatatattagcagaagatggcagcaactctgatatccatagactagatacactcacaagcaagaggtgaagttgaacaggcaaaagatgataatttttcttgatttcccttttttatagatcactgcatgaacatgcaatgccctccgaggaaggcttttctcccactcagttagtgttaccaagaaacagccatagagtctcaatcagaagcatttcccttctctgattcgatgtttaatcaagttgaccaacaaatttaactaccatgccagtgcatgttgatatagcagaagaagcaattaacggaaggaagacacactcatttctgttgataatctacttcttttgtctctgttagatttctattactgcgataaagaccacgactaaaagcaacttgggggacaaagtgtatatttcagcttgcaagatacagtccttcatcaaaccaagtcagggcagtaatttaatcaggcaatactggaacaatacttactggattgcttctcctggcttggtgggtttgcttttttaaacaccctaggattacctacccagggttggctccacctatggttgtacttccacatcaaccatcaattttctcagctgaatttcccccttttcagatgactctagcttgcgtcaagttgactaaaactacaagataggctctgcctatgggttttaataaataatcttaccttttccttttcactaaatagcattgcattttattctaatttcatgtataacacttgtctaaatttaacctacatagatcaataccacagtggcaatgggattgaaattaagatttacaaaagtcatgtgataccaagatgctcaaattcttgtgctccctaaattaattaaacacattaaataggtaaataagatgcatcttttcctttgtttttcatattgcctctaaatgtcggactctgaattttggttttctttttgtagtacttatgtgacactacaatcaaaaggaaattgttgatttaggaagaagtagaattccccaataatttacaaaatcagaaagaaaattagcacattagaagaaaagcaaattttcattatcacagataaggaaaaagagaaacatattctttatagtcatgtgtttatctcagtgaaatagacataatattagattcaggtggttttgtgtgtgaatgtgtgtgtgtgtgtttgtgtgtgtgtgtgtatgtgtgtgtgtgtgtgtgtatgtgtgtgtgtgtgtgtgtgtgtgtgtgtgtgtgtatgagagaggaggagagagagagagagagagagagagagagagagagagaaagagagattgtatttgtgtatatatatgcgtgcatatgtattgttgttggtgtgtttaaatcagacatatttccatgttatatctaaatgagtcattagctcatagattttcaaatgacataactttatttttaaattctcaattctccaattataatgtacacattactaaaatgaatgggaaaagttgtcattttttcattttaattttgcttttattgtttgcatagaggcccttttcgtcattaccaatctattgtttaaattttaactaatgcaaatataatgataaatcgttacttgtacttcctcagaatattttctttttaacatagattttttttttgcagatatagtttctgtactatgaaaactgacactgattttagtgacgaatgcctttcctagaagaggccaaaatgcctagaatttaagcagtcagagactagagagaggaattttccaagttttaggtaatccttggctacatagcaaggaagggaggataagagagtgaagataaagggaggaaaaaggaacagaggaggcaagatgagaagaaaaaaggaagaaaagaaagttgggtgaggaatacaataggaaaagttctatagctcagagctttcagagagagatgccatcaccttggctctgcatttctaacctctcaagttacaagatagtctttgtttaaaccatcaatttttttgatacaatgtggaaataatccaggaatctagtgtaatagcctccctcgttcatgcttttattacctgcactttcagtgtctagtgttcaactgcacttttacaatatccattgcaaaacttccagaaataagcatttcatgagtactaaatccaacatcatccatttcagcaaacaagttcattgaaagtgagtgctgctccactctttgtccggctcaagacttgagtcatccatgctctaaataccaccacccatgagttggttagcaagctccttgttttggatcaagtttaagctattacagatgaagtgatccttctatagacacatttaaggacccataattcacctacgaatgataccacaaactcaaatagtatgtgaaagcaaatggtgtgttatcctccagaggttcagcatgttggggtcccacattctaagatgaagatgtccaagtgagctcacaggccacattaggggaatttctggaagagataggtgaggtctattattgactctatctctaggaacattccagaaccattggggaagtctggaaactggtgctgaggaattctggaaactgctgctgacccattgtcattgccttagattacccaggtatcaaggcagcttctgaggcctggacttgcttggatttgcccagttcttggaaacagatatttaagcctaatctcctaaactgacaaattgaagcctgtcacgtagtcaacctgtctcaaaattttgtttgcctatattcccatctcattttctccccatcttatatgcattatgtcattgcacactacgaggagaaaagggatgattttttaatgccttatttcaagagggaaatattgcatgtagataaccacaattatgaaaaattcttttaagtgttctatttgttatcagatattatagttgtttacttcaccagatttataaattcagtatgttatcagtagtatggacgcataggataaaattttatatatatatatatatgcaacttagcaccacttgttaagttattcttgagggttttatatcatccttataggaaaatagtgagtacagtgtacttattttaggataaaataccttgtaattttgttgacaatccaaggaagagattcataggacagttaccctgatggacacttctagaacacaattagaactaaaagaacttcttatgattttgaaggtgctttcgattattggtcccttaactatttcttttccttttgagaaatctgttttctttaggctgtacatcacttagagttatctatggactttgaaaaagtggtgttttggtgtatgcaagagtccaagtataaaaataaatttgtaactgtcattgagatgtccttaacctccaaaaactttcacatcttttagctctggccacatttaagagattaacaccaaatggacattatcttcacgtgtgtttagtctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagataataggtatataaaatccattttatttcccagatacataatagaaaaacaaaatcttttcattttctgaaagaggtcattatgttgagtttgagatcatacattaggtatcttctaattgatatgctctttggattgcacaccgaaagtcaagcaccttttacgttaaaataaatcatctgtatcctcattactattccaggaactaacaatgtgcagtgatttgcatcatgcttctatcacattgtcctattcagtagtgattaatagagtaattacttaataaaaggagattaattcaatttatgtaaattgagccactttgtttaaaaataacaaaatacattttatttcactgtgatcatgaaattaaaacacagtcttggttgaaaatttgaatcaaataaataataaaggaaataaaccacccacacttgatccacttttatattttaatttccattatttttccattaagctttaatagttgtgcttaagcaataattgtgatttgttagcttcctgtttccactttccactataatggttttttatatcatagagaatgtgctccaaagcaccattgtatgtataatgtttttgtatagtgcgtaaagtttacccttatgttattcaaatgctgatttttctgtcctcatatcttgtttcaattgagacatgctttgcaatgcttataccaagaatctcctgtctcaagtttgtgtaaacagttcttactatttattctctgacttgtcaataaatgatgagcacccaatggctgagcagagaaggaagaacagtctggaatgtctgccagcaaaacgacagagagggagcagagacagattcagatcagtgaggatgatggaggaatcagagccatgaggaaggagtccagagagacatctggaatcgcacatgaagcccaaagatactgatcaataacaatatgcaactactatgggatggagctgggaggtagccaacttagcatagaagggtaaggttaactgctcagctattgaggtgtagcttgaaatgaatcttagtttctttgtgtgtttattggggaccagcataaggtaaagaaatacagctgccagattaattcactgcttacatttttattaaagacaaacaatttacacatcatcttagatggctgcacactattcctttatagaacatatattaacatatataagtttttacattttacactgtaaaaccacctccttttaaaagacttgaaacaaagcttttagaacccccatatatgttagtagcactgagttcaattatattgtaaggtagctaatgtttaagcttcctctgattattggtattattatatttaagtctgacatctattcttttcttcctcaaacctcgccatccagaagaacttatgtgaatatggaattataacaccagtcattttcatctttgtcctgctaggctctgtggaagatatccaacataatcagaaataatacctatattctgaacagtgataagaaatcatatgaagtgaaactttaattcaaaggaaaaaattatcatgcagacacatgcatatacattgccattctattacattataaatgggcatatagtttgttatgggtcatcagtgaactatatatggaaaatgtagaattcgtgttcttacttaacattgatacatttaaaacacctctcacattggcaaaagtacaaacccatagttaaaaatgacttaggatatgtgatatattttaaagattgaaggtacacttaatatttgctatattgcttctccattgttgacggtttgtatcatttcaataagcataattttaattatcaatgaaaagtaaaaagcattctataatcaggtttttcaaaagaagtgaacataatgaaaggattttaactccatattttttttggggggggatattttgaagatgatgaaaaagctggggaaggaagcaagcttccctggaaggatcagtgtccaccaaggtcatccctatgtacttacctaggacttccccctgcctggtattcaccaagtcttaaggtggcaaactattgagcccccaatgaagccttggtattgcaagtacatgccacaccacacaacattgcccttgttttctgaagattgtacatgggctccatgtttacagagcaatcacctaacaagctaagctaacacttcagcccttaaagtgtcttgatcttttagaacgtggtacctgaaacttgtttgctaggaagacttggatggagtgattggggatgactctcttgcagctgagtcatgtgctcctatctaaatgttggtgttagttgcatattgagtgaaaaggtaagaatccatgatatctgagatgtcattcatgagctcagtgaactagttaactacaatatatggaccattcagggagttaagtaaatgcctaggatagaaactcaaaatcaattcagtgactggcagcatcaaaaagatggaccttcaaaattaaaaaaaaaatacaataaacataatgagttgacaacattgtgttctaagataaaaactacaaagaaaaatggtgaataaaaaaagatgaagccatagctggaaaacctacctggattttgacctgaaataatatatcatttatgaattacaatcatacacttctaagcactaagtaggtatatctgttaggaatgtatgtcagtcacataagcaaacttgtaacaaaccaactgtgcaaggttcagtgttgggaatctaaagtatgtcacatttgttagtatttatacctgtctcatcatcaaacctgtttctgtcaaacagaagctttctctaagaagtactatctgagaggcagggaggcattcagtgatgaagaacactgttgtcctacttcaattcccagcatccacatggtcgcttaaaaccaaccctaaatccagttctgaggacacctgaagcactcttctgctttccttaggcattaagtacacacattgtacacatacatagaaacagacaaaaacttgcataacaaaataaattaatccttaaaaattcataggtattaaagaagtaatttctcttgctttgaaaacttcttgcacacctaccaagcacaaacactttgaccctctttaataatgcatttatctgtgtgccattagtttacacaatctgtgaataataataaacagtgtttgattaaagcattctaattaatccaagggggcttatgcataatgcataattattacagagctagattcaatcatttaagtttggcaaatacgcatatttagatctactaaagaaaagttatttgtcagtagaatccttctttaattttctcagcttacataccaaggaacagacttcatctgtggtgactaactttgtccataaatttcaaattcaaaagcaatataaggagtgtatttactgtctctgcttcctggtcagcatgataagagctgctgagttctgtatgcccttgaaccatgatgctctgagacattctgaatcaaatacctgagaaattgaagttctttgaagtattagtctcatcaatgaaagaatttataaatggacttaaatggaagcttgagaaccatttaattattttgggaaaaacaggacaggcaagcataaatcttggtaaaagaagcagttttaggcaaggaacaattgcacactctctgtgaggtccttactctaaaaatagggaatacagactaaatccaattctaataaaactacaacacaaaacaaatgatcacaccaggcaggctgtccagattctggggccatatgcctcttctgcaatactgttcctccctttgatatggggctctttatgctctgacagtataagtaaaattatgtaaatctttgtttgattcaaagatcacagttacattttccttaggtatcaaaagacatggtaaaactatgaaagtctgacttagatgaacacgatcctaagtttaactctaggcattgttaagaaaaacatcaaacaactgtcttttctattaatattatatatattttctatgttgtcataagattgtattatgtgtcttcactcattgttttatatgtcttgaacccgagctgatagatgttttctcatttagtgtcatataaaacttgtaatttctaatattgctgttgtcatgagaggaaatagaaccagacagttaaagtataccattaaacagtttactcttgatatcaatttattatgtttcccctcttttatagttgatgccttagttagggtgaagaccacatacagtatgtatggagaacttgtagatatctcagtggtagaaacacttgctcccaaatctgagtacctgatctctatcccatataatctcttcttgaaaggtgaaaatcaactcccatcacgtacataccatgacatatatatgccttcatccacaaaagcatatccactatccatatgaaaaataactagtagaactataaagtatgcatatggagttgcattattcttgactaattataattactgaagaaatatactatcatgaatttatagaatataacattagacttaccatcagcaccaggaaatagcaacaaaacaaaacaacaaacaaaaccagtctggaacctaattattgaattatttttcatacattcctcatccactcattacttatgaaaattaatctcttttacaagtagatattagtaagcaaaagaaaaaataaagcagtatgaattaggactaagcatttgaagacaaatatccacactcccactctaaagttttaaatagatatctggtcacttctacaaggcataattgttcaggtgaaacaaaaccttgaaacatagtctcaaaataaaaatggaaattaataacatagtgtgatatctaccaataaaaatcatttataggaactaacccaacagcaagtataattaaaatgttttccttcatcatgttcacatcctaatttctattcaaattgctccatttataagaggaaatccaaagtagcatcttgtattggccacatcccttagtcactttgctgaatgaaaagctcactgcccaaaacaaaattttgttaatttttcacaatatgatgattgggtaaatgattttgataatggttttcttactgacttagaacacaaaccaccgatatatttatttatctatctatctatctatctgtctatctatctctctatctatctatctatctatctatctatctatctatctatctatctatctatctatctatctatctggctaggataactaaatagctctctgccctcctttctttttccatcccaatatgattttgactttagagaaaatagttttagtcagccactaacagcactcgtgtaactagtaatcttctatttgttccttgtttgtcaaagattactgggtaaaaggccagttacacactggaaacctcgcctcagtccagagatatctacacaagactgacatctgagcatgtggttctttgggaatctcagcacagcaatgtgctattgactgcccttggcccctatcgattcttccctctcccacatggaaaatatgttgacttctagatttcacaagtctcatccaatcacggcatcaagtttgatgtctataaccttagaatcaccttaaggttcggatgtagaggatgcttctctttgcaagtctttctgttctaatgtcttgtaagctattaaaactatttggtgctttctaccataactattgcttcagctttgcaaaatcattcttcactttgtttatatcctgagatataaactagtcaagttgagattcatttattttgaggggtgtgtagggaatgaatatcttaaactgtgtaagtattttatttattttatatttttctcttaggtcacaattttctgctttatttttgagcttttacatatgcagctcacattgtgccagtgacatttatatttttatttattctttgaaaattatacaagtatcttcataacatttaccaccacatcccctttccacactaatctctctctctctctcttaacatagtgtctcattattttttaactcagtgaattgcattaatgctgcctgtgtgcttttgagtttggagccatccaacaaggcatgggcaacctactagtgactactaccctaaaatttgtttgagtaagggtctcactgtataagcctgtgtaactcgaaattcactatgtagaatgtactagcattcacagtgattcacctgtctctgctttgggcctgggatttctgatgtgtttcagtaaatccaagtcaatgctggaattattaagtgactcagccttgtgtgtgtaaccactgatgctgatgtttccggaccctcctccctgtcactgggctctcacattcttcccatcttgtctttatcagtgtgctccaaaccttagcctaccaggggaagattgatataaatgttagatgcatagctgataacactcactcatttactgtcagcattttaaacaggtatgaatctctgctttagtcactactcactggaaaactttaatttttatgaagtaattgtaggtgggcatataaaatggtgtttcccctttcattgatgatcacatacaaacactccagtggttcaaagattccatcaggttatctgcatacagcttcaaactatccaaatatccagaaaatatcactttcttacatgcctatgggcagtgctcctcctcacataagccttggggctcttacactccaacctgttgaccttgtttgctaatttactgcatcctgaatttatatgtattttttttcttaagaatccatagaaagaaaatgcattctgatctatgaagatggtagacgataaagccatgaatatctccagcatttatttcatagaatttccaaaagctgtcaagttaagtgaaaagattaatgaagagaggaagtactaattgaatttttaacacaaaaataatgttttaactcataaatagtcaatgacagagcaaatatcatccatgttaatgaccaactctctgtgattttagaaagaaaatggtagtttttaaattctacaaaggaatctgattgagagtttaggaaatttcatttctgaattaaagagcacaattcttgttaagatactggttttgttagtaagtactgaagattggaaaaaaaaaacaatgttatgtttccttctataaaaaaaaaaaacttataataaaatgggattttgagttgaaagaggtgaaagaattctctctctttaattctacctaccagagagaggtaggtagaaaatattgttttcattttagtttttatttactttaaatatttaagatattatatatatatatgactgttttgtctgaaagttcattagtgtgccatgtccataccaagtatcagtattggccagaaaaggtcaaacttgtcagatcccgttgactggctacagatggttgtgagtacctatgtaggtgctggaacacaagctcatgttctctgtaaaaacaacatgtgattacatgatttttatggctgagctacctctctatgctgtctttctataagtattttagtttcacaaaatataattatattgttctcaccttccctttactgcatctaagaccttccatttcccttacctccaactcatcccttaatctcagactccctaccaaatcaatggcctattattctttgattattcttattacttgtgtgtgtgtgtgtgtgtgtttgtgtgtgtgtgtgtgtctgtatgtgttagagacaaccgctgagtctctcttttctttctttctttctttctttctttctttctttctttctttctttctttctttctttctttctttctttctttcttgtttttttgagacagggtttctctgtatagctctggctgtcctggaactcactctgtagaccaggctggcctcaaacttagaaatctgccttcctctgcctcccaagtgctgggattaaaggcatgagccaccactgccgggatgagtctctatatttaaatatgtattccacattgtcatcattcctagtcaatgtactatgtagctaaacaagaactgaatttttttctccctagatacaacttcctactcattaatcagattttcagcatcattctttaccttgtaaattcctgggtctttggtaatcacaatttattttatagtcaagctctatgaaatcagattagattccatgcattggtgatatcatgcagtgcttttctctctatgccttgcacagttccatctatcttgttctaaatgacagaatattctccctcatgtaccctacctcatccattcattgcttgacaaacttacttgtttctgtgttgtggctgtagtgaatgctactgtaattacagggagtgtatgtgtcactttgatatcctaatttcaccctattgcatatactgatgtgtgagattgctagattatatccagttccatttttaatttattgaaaaacctccatgttacttctgattatgcctactaatttaattcccacccactgtggatgagagtctcattttttcatatcttcagaagcacctttttaaaaaatatgtcacaaatatttaatatcataggtattttttatgtcatagacactgaagtcacaccttgtatagttttgattctcattgccctgatggtttgtaattttggtatgtttaatatgtttagccattgtttgccttcttctgagaattatctactcagatgatttgtgatcatttttaaataagatgctgagtaattttattgatataaacattttaacataatatatggaaagattattattcaagattagcaaaaacttctgcagatggctgaaaatttgagtgaactttggaagctaagaattactagctttatcatatattccagtgaggtcaggagtgtagtcagtgataggatttgcagaaccccaatttgaaactaagtctgggaacctcatgtaaatctagacttgcttggcagcaagacacaatgactctgagtacaaaattgactctccttgaagaaacttgaagacaaactatatactctaacattttgtggaaatttacaattgtcttaaaacattttttgagggtatacatgtctcttgatatttcagtgtatcttaggttgtctgttaactattttgtcattttttgatatccacagtttcctgattttgtgctgttttgttgaataaacaattaaggaatcccatgaagaaaagtacatcttaaataatagcaataaaattattaatatgattaaacctttttctcaccatgaaggtgacaattaaaagttttaaaaatatttgtgaatgttcatgtttgtatactgtattcattatgtgtcgtctgtgtgtccaattttatgtataattatgaatatttatttgcctctgtgtgtgtgtgtgggggggtaaatgtgaatcatggccttcttcccttttttgaggcagaatctaggttctttgttggttctaaggagtggaaatcatggccttgtgcttaaatgccaaatgctgacccagtgagctatacacagcacactagtaagtttttttttatctcagggtctttttgttgtttttttcttcaatcatcaaacttttatttcatagtaaacagatggatacattacagggagtttccaaaataaatacctgctttagtttatataataattctaattagctgaaaacctcaaagcatcattcattttcaatagaatagtaagcacaatggaacagaacagactatgcctaaaagagagttggaagaagattgtgtgcctagagtttcaccttttccagaatcatttctaccattggcagcaggtacaaaaaaaaatcatcccagcacggtgacgtatgtctctaatcccaacattcatgagggaatggacaagagatctttgtgaatgtgacaccagcctggctgcaaacatagttaactgcaaagggcctcatatagtaagaccttgtcaataataataacaacaataataataatgataatagtaataataataataacaccgagactcttgcagctagctttaacagatcctgtagaatataacaagacctaatcagtgtattgttctccactccatattgaggtgttgaactgttcccgggggcaaaggctagatgtgtcctatgtgtgtctgctgagttttcagatattttccggatgcaccatttctctgcttccctcgggtcacacccagaatttgggacttttacttttacatctccatttctccccatgtccaatataattttccaagttggaagggtgcatttcagctgtgccactaattttattttcttctgccttttcatcttcttgaagccactcttggggaatgttagaaatttcatgtttgtgtaaagtgagtgaatgaaagcattcattgcttttgttgaagctgcttccactttcacactcaagaaaatgcccccttgaatcatggaatgttttccaccagagctcattggctgactacctgtgcacttcttatctgtgttgacaatagttgttctttgattctggtaccgtttgtttctttatcatcttattttgtttaaattatttgttttcttttttattatatattttctttatttacattcaagtgttatcccctttcctggtttctcctcctaaaactccctatcccctccctgcttcccctgctcaccaacccacccactcccgctccctggccttggcattcccctatactgggacatagagccttcacaggaccaagggcctctcctgccactgatgaacaactaggccatcctttgctacatatgcaaatggagccatgaatcccaccatgtgtattctttcattggtggtttattccttgggaactttggggttactggttagaaaaaaaaaagaagaagaaaagaaaaaaaaaccattatcttgcaatgaatcctctctaggcaaatcattcagatcattctgataggactgaatttaaaaaatagattaaataaattcctattaccagcatacatctaatgtgttcacttcatagatctctcaatataatagcttcctgggtagaattatacagtgtttgaaggaataaaagacagttttaaatcagataaataccatgaaaaggaagcacgcaaaattctttttttatttaatttttacactccatattccattccctgccccctcccatccaccctcctactgcttcacatcccacacctccttcccaggcccctgtctccacatggatgctcccacctcaactgcacctgacctctaaactccctggagcctccagtctcttgacagttaggtgtattatctctgaatgaacacagacccagaattcatctactgtatgtgtgttgggggcctcatatcagctggtgtatgctgtctgtttggtggtctaatgtttgagaaatctcagggatccagattaattgagactgctggtcctcctataggatctcccttctcctcagcttctttcagcctttcctaattcaaccatagtggtcagctgcttctgtccattggttgggtgcaaatatctgcatctgactctttcagcagcttgttggatgtttcagagggtagtcatggtagtgagcgctacatagcctcagtaataatgtcagggcttgggacctccccttgagctggatcccattttgggcctgtctctggactttctttttctcaggctcttctccatttccatccctgtaattctttcagacaggaccaattatgggtcagaggagtgactgtggtatggcaaccccatccttcacttgatgtcctgtgttcctagaggtggaatctgtaagtgccctttgtgtactgtaaggcatttcttctaagatccctccatttgagtcttgagcgactaacacctcccaggtctctgttgcattctagagggtccccccaaccccctatatccagaggttacctatttccacttttttgctggtcttcagggcttcagtccttttccctcgcccaataacagatcagattcccccaactctcctcacccttgtctacttttcctcccaggtcaacaggacatgcatcgtatatactcactaataagtggatattagccaaaaaaaaaaagtacagaatatccaagatatgatccacagaactcagaatgatcaacaatctgaagagcccaagtgaggatgcctcagtcccacttgggagagagaagaaagcaatcacaagtggggagggaggaaaggaatagctatcctttttaattctttactttttaagtgatattttgattatttgagtttcatgcaatgtagtctgcatattaccactctcccaagatcctcctgtaatgactctccacacattccgcctcttcattattctcctcaatattttctctcttttttttttgtctttttgctttgttttgttttctgaaataagtccagtgtgggcttacctgctagttttgaagtggggcctgccctaacatgtggcttccctactagaggttccatcatttaaagaaaactggctccacatctcccagctgttatcaaggaccaacagcttcccagcaagtggtgggcttttatgcagtcatgtaggtacttccaaacattgacccaggaggaaagaaatgagaactgaatacctaagtttgtctcttcacctccatcgttcactgcaggccgtggagtccatttaaaaccgtacctactgatcagccatctgaagtacagaatgacatagagaatagggagtaaaggtaaccagcagacttctcagtacttaccactatacctgggatgtattagatatttgttgaataacagcatgggtagactggtaagtaattgtaaagaaaactgtttattttttcatgttaaatgaacattaattctttatttttggcagttcactttctcctatcactcccagctagaaacatttatgattatagaagtcttgtgaggtggtggtggactttcttcaaatataaaggctctaaggataaatatgtattagtaactttctatatataatgtggttcggcaatgtgatagtctgggatatctgtaaactagaggataatttgtgccattcattgtactctttgttgtatcattcaaggtgaacagagcctcatcagcctcacaggacaggatccacccaaaactgacagttccctaatttctggtgattttgtgctctggactccattactctcctgttctttctgtcaatttatttatatcctttagataaagtcattttctgcttcagttagccccattcattttcactgtttgcattatgggaaagcaccttgtgtttatcccaaagacttagagatatgagttcagaatttgctctttaaaccttagataaaaggatactgatggcagtttgaaggtagaagtttgcatataatcttgtatttgccttttttttttttcatagttaacattcaaaacccaaggttgaagattagaataacgtctttttacctaattattcaataatcacaatttcaatagttgagatatgttcaatatgatttttttctaaaatgggtgagttcgtttttaacttctaccaggaatctactaagaaacctttctggaaaactcccattcataatccggaattcatcctcttactcataggaaacataaattttagctgtaaacttacatttgcttgtttttaacattgtctcgatttgcagtccaggctgactttaaattcacgcttaaacttgatagctccttgcatctgcctctgttgaaattacatgcatgtactactacattcaggtgatatggtacatttaaaagtatattctgtcctaataacttgataatttagaaaagcctgttcatggcgtgaccaggaaagtctttagcacagtattaagatgaaaatcaggactgaagagacggttcagtggggaagagcatttactgctcttccagacatcctgaattcagtttccagcacccacatggtagctcacgagcatttatatattccaggcctagggaattcacacccttctctggcctcagtgggctcctgcacaaatgcagtagagatctatagacacatacaagccaaggtcatgaacatgtgtgcaggtgcgcacgtgcagatgcatgcaagcacacacacaccttttacaataacaaaacaacatagaacagcaaatgttttccttcagttacatttttggggcaaatttgcttaactaatgtgatgataaaccatcttgctcaaaaacaacacaaagtgttttgtgtcttttgtgttcttttccagaaaccattaaatctatcttagagtggctttgccattcattcgctattgagactaggatagataattgttcaagccctatgttttattataggttcttttctacaagacagagatagctgtagtggtcaccttagaaaagtggctgtagctcgctctgtagagagaactccctataaaggaggacttaaatgatttgatatgcagtgcagccaacgatatgcctgacatttaaagaataattgataaatacctggctaaaagataaaacaataccatcagcaagtagctaaataataattattataattatataatgaagttcataataataaatattagtaacagtagtagtactaataaacaatacagaaattctgtgaaataaaatggaaaatgacatggaaaacaaagaagagtgagagtcaaataaaatgtttcagcaggtttgctaactggtatactttccttaagatgatcatttctcatattggctgtgccttttacaaagcctcttaaattaaaaaaaaaaaaaagcaagaacaaaaagaaagaaaggcagacagccaaacagacaagcattctaaggaaggacacatttattggatgaatatagatgagatgggtttcttttcgatgactgtaaacagagtgaggcaacgagccacacccttaacaatgccattacactgaatgatgagtttcactctttgtttacttacttacttatttacttattttttagcgaacttcagtctaggtcaatggcatcactatgcagtttgcttcctcaataggacagctttctgctatattacaagtggggaggttgaagatgtggcagaaaagtggtggtggtggtgggggtattaggtggaaataagaaagttaacttgcattttcagaagatgaaggaactgtttccaggctccggaaagtatgtatggtacatggggaaattaatgtatatgtttagagaataaataaattaagtcccacaatagcaaatgtagggcatacagggatacatgtaaagtggcaaatggagaagggagaagatagtgacaaagtctaaataaagaacacgttcaggtctgaacacttggcttttgtgggaaagcactaagacagtaactgcgctgccgtctttgactcttgttcccacagttccggtttcagaatcaagggatggggtttttggatgcttagagttcaatctgtagcttcttggatgtctgacaactttgagatgggaaggagttgaggaagctgtcaaaataaattgccctcataaggcaaaagagtcaagctctgcattcttttccatgctgggagggaaagtctgtagtcagctcaaatgtagccctgtgcttcggcagccccctgcatgggggagatatattggccaagggtgaatactcaagggcacaggtttgggatccttatgcacttcttaaattttggggggttttgtttttcttcaagtaagtcagttttctgtccctaggacaaggttttaggatttgaacgttcatgactagtaaaggaatgaactatgttagtgggagggatttttcacaatagtgtcttacttagtttcaagccctatctctagaacagtcacctctaatgtaacaggattatttttcaacatgtaaggtgaggctgtcatcaatgcctttcattctttaagttttaattctcttcccattgcaatatttctcaaaagcaacatactattactttcaggatttagtgacttataatttccttctttagtattattttttattgttaaagaatttcatacatacatgtagtgtctttcaatcagtttagcatcttttgcctgtcctctaatcccctgtctacccacaccactgctttttcctgccaactccctgggctcttgttcattgctttgtttttattcttccctcatacattacatcccaagcagtttcctctccctccactcttcccagttacccaccctaccccttctcccaatctacttcttccccctccttcatttcccttcaaaaaagattaggcctaccaaggctctcaacccaagacagcataagaagatacaataagactacacacaaactctcacatcaaggcttggcaaggcaatgcagttggggtaagagggtcccaagcacaggtcaaagagtaagacacaccttcactcccaccattaggagtctcacaaaacagtaagctaacaacggttacatatatgcagagaacccagtacagcctcaggcatctcagtgatggcctcttcagtctctgtgagccttaaagagcactgcttagttggttctgtggacattgttctcctggtatcctctacagctctgccccatacaattctacctccccttcttctgctggcatttctggagttctgggtaaagggacacaacagagatctccaatttgggagctctctgcctaatgtttgtcaataatataattcttatcacagtttcttttctcctctccatctacttttctaaatttatgtgaattttaatggatctgtctctgtcttaggggcatccactgatcactgtttattcattgaaaatagattaattcattgttatgtaaataaacatgaatatatatgtcagcagttgctgtactattgttaaagaggacaagattttttttatgtcttctctctgccctctagcaactaatcatttcacatttaaacccccagcacattttaaaacatgcagaaaatctcctttgtgagttgcagagtgactttcaggaatgctctctgcctgtggtacagtttagacaaaaccattatccccccaaaccgttcggtaatgacagaacacatgccgtgtaatgtaaactcacagcccggtgctgggcaggcatgattaggctgtcatcttccccaacagcagccacaggaggagaatacaaaagtaaaattatcttatttattacaggccttttgtaggggatctggcactcttatgcaattgacatttttgtttgtgttgctgaaccataagttgagagctaatttaaattagttaattcacagtctacaaaaatactgttaataaaatgaagtcacctttatgttcactacttcagtgtgttttgccaaaaatatgaatcattaattttaaattttgattatggttttatatattgtttgcaaaattaaaattagaatatgtctgaatctaaaaggaagctgacacttcagaatatttacttgttctctacagttaatctttgtatattttatctgaacatacactaattctatgtaatcatacataaacatgaacaaatatgtatacatgtcaaacatgtatttttgcacatggtggtttttggcttttcatatatcttagaggaaattttaatatccagtgagaaatcaaaatcaccaagttcttgaaagtttcctggctttaaatgttatttgaattaaaaataattctatctctatgccttccttcctggatgtgatcattaaagaagatatatgtatccagacagtgtgggaacatgggacaaactgaaatgacagagggcttcctgtcattcctaagagaaccagaagagtggtcacaacatttcaaggatacaaaaatcggacttgttctttggcttgctcaaagccattactccaaatctcctgatttaattatgggatgctacgaaggagtgacagggaaaatttctgaagaactgcagccttcatacagaaagcccagacatctctgcccatctgacagacagaggaaggcactccccagctccttcagctcttagtcttcctgtttcatactgtcaaagagatgctgtctcctgtcagagtgctggctctccaggagatgctcagattagaaactgtccagaaagatttaacatgttttctgccattggacaatggggggctgggatgtgagtattttacttcactgcatgcaattggcatcttgaagcattagtttgtcaaaatattgacaggtcctggatgttggcattgtgggttcattttcttcccaaatggttaattcatgaaattaaccttctctgaatgtctgcttgcattttgaagggttatcaggtacagatgagtggagtaaacaaataatttcattatgtctaacatactttcttctcatctctcatttttttccttttagatagactttggtagccttggctttctattaggaatactgtatttgagacctgatgagattgtaataaattctcttatttctcttgcatattctgggaagtgtctttagctaaaacatttttttttctggaagatgcataaaaggatattgataagaaatgtttgtaccaatacagattttatacatcaaaaaacatgtaagatttttttgtggggtgcatttctatatccaggttttatctgtgttccagaaaataaacggctgcaagttccctgagccccagcaatgtcatgccaacttttcaaaataaagggcaatatgaaaagagggattactaaggaaatattctgtaggttttggattgatgatttgattgattatatagcaaaaaatcttagaagccttaggaccaagcaatgtggagtttcattagtttttttttttttttttttaatctgtttttgtctctggtggtctgtgaaatctcctctgatgactttctcactcagtgactatacctattaggataatttcttccaattcataattatagaaattgctttgtctgtgattgtttgaaatctttgcaaagaacagaaaaaataagggcatgaaaacagtcttttggaatcaagagccatcagttactattttcttctgagtctcaatctatctctcccccctcccccgcacaattacttagtaattaaaaagattaaaacaaaacaaaacaaaacaaaacagctaagtatctgaaagtcctattcctctcctatgttggcgaatgagtcaagttgggaaggaagagctaagaaatatgacaagtaagttgagaaaactcaacgattttttgctatctccccattatcaaatgaaaaggatattattttgttttcaagagagatgcatcctcatgtagagcaggccttctttgaacatctatgtagcccagggaagattaccttaaattcttgactcttctgttccttcttatcaaatgtttgattaaacatgtgtgatattatgcctgccaaaaaagaacatttcctatctcaaaattagcatgattaagagggacatccacgtggagacagggggtggggaggaggtatgggatgtggaacagtcagaaggtggatcaggtggaggaataaaatatagagtacaaaaaaaaattttaaataaaataatggaaaaaaaaaacaacaagtaaactcaagtcgtcactcctgtgtcattctcactggcagctctccttgcttttagagtttgtaggtgctcagtgaatgtggataaacttctcttctttaggtacttttcactcattattaactcggtacaccaagcaggtgaactttctggttaggtcattaattattatagatgtcagtcaagataaagatctgggacatcaaagaatatgattttcttctcatttaaagtatatttcttagggaaatattttgaaatcacttaaagtgaagacaattagtcatgggtcaatgatccaaatgaaaagcaaagttttctcaattagcaggatactaatggcttcataaacatgcagtttcaatatctccaactatataagattctcaaaccaatgagaattatatgtttgacaagaacatatgttgatgaacttgttctctgagtcattcttaatgaataagtatgaatcttttcaagttctactcaaatagagaaggctgaatggaatacccttaggttatactcagaatcatagccaagtggtaaggtctggttcataaattaaagagtatttggagactttgtcaaaagccaattccagtaagaatgtagtgtataaatgggatgctagagagaattctagcaaaacataggaaagtgctatattatagcacagtactagactctagacatcatatagtactagactaaagaataaatgaacatgtagacctgtgcatgaatgccatgtgggtcatgttgcttaaagactaagggtgaaagtgaaggatgatgacacagaaatcccaaaatatcataaagagtcaacaatttttttcttcgataagacttatgtgtaactattcattaacactaatcaggaaaggcctcaagtgttatattaaaatgtagagctaaattatgtatacactcttcattgacttcaaaagcacttttctttactcatcaaacaaaactaaatgtaagttatttcaatagatttcatatgtctaaacatggcatattctgcttattttttcttttgctgtttctgtttttaaaaagcataaacatttactaaagatgaacaatgagaaacctttttcttcatttgaaatacatttcatttatggtgttacagacaaataatattgttttgtcaaattttacttcaaaatattatattttttaacataatatttttatattacctgatcacacttccagtcttcccaggtctgccactctgccttgtgacctgctcccaacctgtccattcctgcccaaaagaaaaaggaaaaaagagaaatatcaaacaaacaaacaaaaccacgcaagttcaatttttattgcccatataatcgctggatcatggtcaaactcccagtagccagcttcttaaagaaaactgagttattccccacctatcacttgtggagaggtacatttcagcatctttaccatacttgggctgtgtcctagaactctctttgtagaccacatttacctggaacccacagacatactcatgcctctgctctcaagtcctgggaacaaaggtaaacaccaacatgttattacagtttttaaaagttctctttgatggatttcgatctaggcgttactttctaggtggagggctagtgtcatgccagggggtaagggttgtcacagaagcctcctatgaatctcaactgtgggtctgcactcatccataccactgcaaaatcagctcctttccctttacagtttgctggagcacagatgatagatggtatctggtgatagtacagaccatggacatccacatggcctttggtatcagcaagtaccatggaccacagcatgatctccagtggcaggacagaccacagacatcaacatgacattctgccacagcaaagaccatgggcaccatcacgtcccttggcagcagcacaggccatgaacattaacatggcctccagggcataggccacagacaccaatatggttaggcctatggattctaaccagcttcgtgtggcagcacacaatacagacatcaacatggtctcagctgacagcacaggccactcacctcaatatggccccaggtggatacatggctcatagacaacatggcttcaggctgcagcagagatcatggacatgtacttggcctttgttggcaacaggggccacagatattgctataactcttggctggattagaaccatggactctaggatgattacaccctcacttgtactttgagggcatgaataaaaggaaaaagaagaaaatcacaaatccaatgtttctggcactaacagggatcagattgtacatggagatgaatggattgatgaaacaaaccacgtatgcttctgtgccatgtcgccctgaacactgcctcaaacctttcagctgatattaaatgaccttccaaacatttataagcattatcttccccttagcataggtaaattcttcaaagacttgcattatcaaaaaagataattggacataaattacaatgcttgtgccccatacataagtgaagtattttcgagcaactttgccataaagaaataaagttatatgactgactgttaggtgacactcctttagccccagcactaaggaggttaagagtgaaggatctttcttagtttgtggccagcctggtctgtactacacacactttattaagcaatcacttttgttactcattttgaatctagaaacatgcagtcctctcactattttaagcaccaatttggcaggaagaaagcattcttccttcttagataccttcttttagtgttatatttaggaggattgcattatcatttaaaaaatagaaaaacattacttacgtgtttatcatctctacataactgccaacttcttcaataaggcaagttcatattactcactcctatatctatagcagttggaaaattgaaaaaaaaacaccctcaaaatattgttgctgaaatcataagattcatgttatttaagataacattatgaataactagtataataattcggtacaaatttatgatatctggtagattgtattagaacaattactgaattaagagaagaagaaccctgattttggtattggtctataggtaatggcaaaaataaagccattttgagccacagtttctgaatcaagaagggaagggctatattttaagtcaatttgtaacactgagaaatcaatattttaatctatcattgattcctctataatatgtcataaaaattgcaaaacttatatatttatagcatatatacaaacatgtgtttatatatatatatatatggaaaatatttttgagcaagtactacaattactattgatgtatgatatataaaagcattggcctcttatgagaaaacttgtactccagatcaagtgtcagaatttatgtacttacaatcattctttatttttcgctttgacctcttactttcaaatattacttttttcttttctttatttattcacattccagattttattccattcacaccccctgtccattctctgactattccacattccatacctcctcgccagccccttgtctctacaaggatgcctccacccccaacccccaccccacatgacctctaaacacactggggcctccagtctcttgaaggttaggtgtatcatccctgattgaacccagccctggcagtcatctgctgtatatgtgttgatggcctcatatcagctggtgtatgctgcctggttggtccagtgtttgagagatcttgggggtccagattaattgagactgctggttaatttttctttgacatggacactctgttctctactgtcatccacatattgaatttatttctgtaatgctacaataatgttttataattcaccagcatttttgaaaatagttcacattttgtattattgaatcattattatatatttatattttgaacatggaaatataggtacattagaattttttgtttcccatgccttaactttgttcccatgtaattactttacatgtaccatatgggaattttaaaatgatgatagagtttataagtgcagtgtgtatgcccccaacctttacactgcagtgcagtatgcaacctaaacatgttagcaaagagagaaattgcatgaataactcaacatggtagcttatctcagaaaccgtttaccatgaggcatttaatacaaccatgtctcagaggtcctaagaaggcagctaaacttttatgcttttcattataatttttcaataagttcaaaaggaaaaatatgctgaaagcctatatggtttaagttagaaagaatacgtgtctataatactcagaggatcaaatcaatagttattttttaaagagttaaaaaatctataggagtaatgtaatttacttttctttcaaaacataaatgtttcctctttggaatttcagccataacacaagaagaccacaatgtaattcactagcaatgtaggctatagcaatgaatctgccgctgtttctctgaaaagctgaaatgcaatcactggaataaacatgttattttttttttttttttttttgggaggagagtaaaagctgattccaaaattactcttcaatgaagaaaactctgatgtgtttaattcagtttataacttttactgaaaacttttatgccaatacaaggtattttattaaatttactttcataggtcactggggtacaaaatgagattcacaatgagctttgttttaggttcaaaggtcatttgctgttaatattaagcactgtggtgatgattctcaaagcacttagggatataggaatagagttcactctcttatgcatgttcataattttgccaaaactcaaaccatattttttccagaaaaaaaagacacatgaagcatacttttctttttaattctattttatttatgagaagaattgtcagagaaattcagacgatgaaggacttaaacttgagggaaactgcagggatactggaccactggctaatgaaagaactgtgaaatggctaaacctattacatacagggtagccacattgatttttatagaagctttaaagacaagataaagaatagtcatgctacaattaacatggaggtctatgcccttcatagttgaacacaggatcagaggaaaagaattaaagagaggaacaatatcctggaaccccacatatatgtgcatccctcttgtatcaaaacttaattttgcttatttttgtcttcataaactcttctgcctttgagaattgtttgatattccaaacaacttcaattgttcattatggggaaagaatattggaaagagtaaaaatagagtggcatgaatatgggcatatgttgggggttggggcaaaaggcatgaaaagcactacaaacagctagacttcaagattcacccaggcattatttgaataaggcatagttgtggctcactcacgtgtatctcagtgttatttatgacatgaatcctttacccttatattagtcagggttctctagagtcacagaacatatggaatgtctccatatattaatgaaaattgttggaatgacttacagcctgaaggtgaactaaccaacaatgagcagctgataatgggaagtccaagactctaacagttgctcagccccatgaggctaggtatttcatctggtcctctatataagttggaatactgaagaagtagatttcaacacatgtgctggcaactaagtacaagcagcctaagaagaatggactgttcatttttccactgtctttatgtaggcctccagtagaaggtatggcatgattaaaggtgtgtatcaccacacctagatttgaaacttactctgttccaggctggccctgaactcggagacctcttgcttctgtctcctgggattaatagctaccttgcttgggcctaagcttttcagggccactatacctcaaggtctggatcaaaagtatgtgtgtcatccgatgtcttgatctaggacaaaaacctgtgtcttccagcctcaggatctgaatcacagctgagccctcaatttctggattgtagtttattccagatgtagtcaagttgacaaccaaaagagccatcacaactccagactcacgattttggaaattattaaaattgttaactgctagaagagtgttacaataagtatattagcctataataaatatatgcatattgcatgaagaaaagaatatactttaagggaatcaatgaaaatgatctcagttatctcttgagatggagaaatgagtaattcccagatttgttctaattttctagatgctattgtaagttctatgtgagctctcatgatgtttatgattgtgtaggagggcagctcatactccttattttgggagcccacctaaaccccacatagtaggcagctgtttatgtcatagtgatattcaaatatccatctctagttaaaatgttcatgtaacaccacagtaatatctctgcctagccatctttttttcttttttttttattacgtgttttcctcaattacatttccaatgctatcccaaaagaaccccacaccctcccccccactcccctacctacccattcccatttttttggccctggcattcccctgtactggggtatataaagtttgcctgtctgataggcctctctttccagtgatggccgactaggccatcttttgatacatatgcagctagagtcaagagctccggggtactggttagttcataatgttgcatctacagggttgcagatgtctttagctccttggatactttctctagctcttccattgggggccctgtgatccatccaatagctgactgtgagcatccacttctgtgtttgctaggccccggcctagtatcacaagagacagctatatcacagtccttctgcctagccatcttaaggaagacttcgtttgcatttgttacccactagttaatcacccacacattccaaaggacacacactttatgtgacgagaaacatgtttagggctggagggatggctcagtgtttaagagcactgactgctcttcctgaggtcctgagttcaattcccagcaaccacatggtagttcatggccatatgcaatgagatctgacgtcctcttctggtgtgcctgaagacagctaaggtatactcacatacaataaataaaacttgggaaaataagctctgtagtacttataaagaaagaaaaagaaaggaaggaaggaaggaaggaagatcctcagctgcagatatgtcaaaactctctaaacatgtttctgtccagtgggcaattgtttccatttggtccactgacagtctcttgtgtactcattggtattttaaatttcaaatgttaggtgaagccatatgaatgagtgtcctgaactgtccaaattccctgtgccttatgaggtcttctaacccagggacacaatacctgtccagtctcttggaacaacaacaacataaaaagcagtagaccccttcagggaagatcttagtgcctccctgcttacatttttttaacatatacactgttcacactttgaaggaccacataggatgttagagtaaaacaatcctggaagatgaaacagttcattttacttctgtaccatgtgccctgtgttgcagccaaagcagtctttacacaacactaattagtgtattctaattctgtagacaacatctttcagtaccttctctgttttgttttgttttctcatagtcaaaatcacttactctcatttagaaaatctttcttgagctgcatgctacagacccctctgaataccacgttccattggcaccctgtaacagacaccattgttcactgatttacactactcaaggctttcctcctatcctcacttggttctctacttccataatatctttgatttctcagcctcacttcatcctgaatcttgtttgatttactcttcaaatatgatatccactataaatactagagaagatgacctcattgccactgaggaaacagatgatcttgggtgaacgcatacagcctccatgattaccatgagaatgatgctcatttttcatctcgttcattgttactgatccaactctgaatgatgccctgtctctgatggaattgatatctccaaactgatctctatatctgcttctggattgttctgtgcttatttgggggtctgcatactttattcagttggaagaaaagaaaaatatcagggtttaatgatacttgaataacattatagtccttgacctgtaagacatggataagagggagaataattcaaacataggaaagaatattaattatctaattcaaaaatatctctgtgttttgcataattattcaagcaagtaaacactatatgatcagagagattaaaattaacttgagtggccaccagtataacactttgtggttatactaagtatcatttaacttcttgtgcatagtatttaatgcaggctgctatgccctgtaatgttaaatattataagattgtgtacacagtgagcgacaaggttacacagcatatgaatgtgctcacaatacagcagtgagtgaagtattaattacttttctcagtttttaattaatttctttatttacatttcaaaagttatctcctttcctggtctcccctctgaaaaccccctatcccccccccccttcccctgctcaccaacccacccactcctgctttcctgccctggcattaccctacactggggcatagaaccttcacaggaccaagggcctctcctcccattgattacccactaggccatcctctgctacatatgctgctggagccatgagtcccaccatgggtaatctttggttgatggtttagtccctaggagctctcagggtactggatatttcatattgttgtcctcctatggggctagaaatcccttcagttctttgggtcctttctctagttccttcattggggaccctgtgctcactccaatagatggctgtgagcatccacttctgtatttgtcaggcactggcagagcttttcaggagacagttatatcaggctcctgtcagcaagcacttgcttgcatccacaatagtgtctgggtttggtgattgtatatgggatggatccccaggaggggcagtctctggatggtcattccttcagtctctgctccacacgttgtctctgtaactccttccatggttattttgttccccctaataccatgattagttcacaaagaagtttgtttgggcttatggttccagaggagtatgtgcccactatgacagtcagcaatggctatagacagtcataatttctgtagcagaaagatgagagctcacattctcatacatgagcataagtcaaagaaaatgcagtagaagtagcagtaggcattaaatagtaaaacctcactccagtgacatcttccctctacaatgacttcaccttcttactatccccaaattgcaccatcaactagggaccaaatgctctaacatctggaccctatggggcatattccctttaaaaccaccagaaaaatatatgtatatatgggcttgggttttagaaacatatagtctaggtgaatgtcagagtttagcccatgaatcagtcaggtacgtcttatttttaacttttagtatgcctttactaaaatcaaaaatctggttctggcataaagcctaaatgtttcacttagaaaataattaatttcttcatcagatattgtgagaccttcacatccttccaatctgatgacagcattctatataaagccacagaaaggctttgcctctgtacagagaggggaaaaaacatttgaaagattattttgagtaagaaagtctctacagttgcagccagtttactgaactgagagctctgtcttctgaatgacaatgtttcattaaggaaggtcacctttcttccatagagagatggccttatcacttctccctccttgatgaagtcatttctataaaatgcagtgagcaagtataaaacatacttcaatttttctctccaaaattggcatcaaagggaaacctaacatttttaatagactaaaaaaggacataattaaagaatcacagttgcagtttaaactgtaaagccaattcttcaggcagactgaaattaagcagttattctaacaacatctaaattttatttccttttactctattttttatgagtatgagtacttgcttttacggatttttatgtaccgtgtgcacacttgttgcccatagaggccagaagatggtaccagactccacagagtttaattaacaagtgcttgtgagtcaccacgtatcttttgggtgctaaaccataatccatgctcttccaaaagcacaagtgctctgaactactcagtaatcgtcctaaacccaaacctcgccttaaacatccagttccatacatgcttagtaaagactcactgtgtgctggttatcatattagctaagagggatggaactaactatcacttaactcaaagagctatggtgtttttaagagagaatgtcaataataataataataatagtaataataataaacaatcaggataaagattaattgcatgagtagccttctctgtatatttgcatggtaggagaaggagagaggagaaaaagagagagagagaaagagagagagagaatttttaaaaagccagttacttagagtcaaggcaaatcagcaatgtgtgtgttccaatcgtatctgtgatttttttctttgtttctttgttttccttttatttatttatttattttttttttttgctttttcttttcttctccattctctctccctctctctcccccttgtctagaaggaaaggtttatttagaattatacaatcccagaattctaaggtccaaaatggtggggcctaccaggcagcatttgacagacctagcagacagagttggaaatgaactgtggggccctcacatcgtaaaacagaagcagaaagcagagagaaagagcagcggtgatggattccaatcagttcactcgatgcttcttctgccgccaggcagcctccttaaatggagctaagaagccgtcagcctcaggagtgctgttccgacactgctgatgaatgctcgctatgcagtcctggatgtggctctggtacttgtgaattttgaataaatctcttaatcatgctcatttctgtcaaagacagctgaaaaatgattgaagaactgagctgttgggtgtctgattgggatgaagtagttttaagaagctgattacatacttcacaagtgcttagataaataaattataatcactattatcaacattaccctaaagatatgtgtattctttctagcatttatatctctaccaccagtaacagtacattctcacatagagcatattctgggacctggtgaggtatttcgcatacataagtgcaatttgtatgtgtcagaaaatgcacagagaatgccagggattctgacagttgtgtttctatattttaatcattaatcatttgaagaacattttcatgctattgtcctggtcattaaaaattatattttatggtaagtgtctgcctgagacattgtcatccatggtattttgacagtactttttgtcccactaatttagtagagacagctctggctgtgaagttactttgtagtgaggctcaatagcagggtatatgagttatgattcaaaagaaagtggaccaatacatttgtttagaaactcaagcaattaactcaaaagaggtaaaattggtggattagagcaggcctctttattttatgctatgttctccccagagcgtgtcagactgcggtggctcaagagaatgcccaggataactctgcctggagggaaaaaaaggtcacagcaattcctcctgacacaattagttcagacaagacatgggtgttcactctaccaggagtttttgagactgctgtaatcagtagtgtgattgttgagctctgtttgagataacagcaattgattgagtgtctcggcctagagtgtgactagatattgtgaaaaactagggagaagaaaatagaaacaaaatggaaagcttgcatcgttatagactgcatcttgtgatgattcttcttgattccctcgtgcttgcagactggagatatagcttgagaaatgctgggtactagtggtcggttactgtctgtctgtctgtatgtatgtatgtctgtctatctatgtatctatccatccatctatcagatatctatcatctacctaccatctatctatttattagacaaggtcttataaataactttggctggcctcaaatgtgtattcttcctgtctcattctttcaaattctggaattatgggcacacatcacctctgacataaaattttaaataaagtactttctataaattagaattaaccaaaactatgagaacattattttttcatacatgagcagataataaatatataattgaacctggtcatataactttcattgtagcaaaaaggagaatagtttaatgcactgaaaatggaggtaacgtttatagcctcactagaaagaagtttctattgcagttctgtttacattttcataccagtgtgatctgtgataattttcataagcaatagcatttttcattcatttatcttcctctgcattcagaatctggatattttcaactgtagaaacttgagtccttactagttcatcggcatagtatgaataatcagagtgaagattctaagatacttctgaagcatttaaaatatccacttaaattttgcaaaaaaaaaaaaaattctaaattacatttctcttgcattgaagataacatggactctgcggagaattgcacaaaaagatgatgcagtttcaagggaagtccctaagacaatattcttttcattataaatgcatggagagagtaaagaaaattaggtagtcctttatccaaatgcagcccatgcttgtcgttgaatgttattatgccaagtaattcatccagataaaaggctcttaatgttatcctacagtaagtgatattcttatttgattatacctgtgcatatatggacatatgcccataataggaaatcaaagaccgggccatatgcagaatagtcaagccctctactgttgtgagaaatattaaaaaaaaaaaaaaaaagaacccgccaactctcagcaggatcaggccatactcctgcacttctgctgcagccaacaactctcctgatctagcccctgtgccaggagatctcactcacttggtctctcagcacaccaactccccagccctgagaggccacgtggctcccaccaggccatctctctgacaggccccgagttcctcttgctttcacccaacgccctacgcacccctggtgagccgtctcaccacttaattaccaggtagagtcgagactcttaatgcttaattagccaatcagatttatgtatcaataataacacaatttacatgatgccaatacaataatttcagatccaaatgataatgataaagctttaacccaattactataaccttttgataataccaggtccgactccattnnnnnnnnnnnnnnnnnnnnatagcagggtatatgagttatgattcaaaagaaagtggaccaatacatttgtttagaaactcaagcaattaactcaaaagaggtaaaattggtggattagagcaggcctctttattttatgctatgttctccccagagcgtgtcagactgcggtggctcaagagaatgcccaggataactctgcctggagggaaaaaaaggtcacagcaattcctcctgacacaattagttcagacaagacatgggtgttcactctaccaggagtttttgagactgctgtaatcagtagtgtgattgttgagctctgtttgagataacagcaattgattgagtgtctcggcctagagtgtgactagatattgtgaaaaactagggagaagaaaatagaaacaaaatggaaagcttgcatcgttatagactgcatcttgtgatgattcttcttgattccctcgtgcttgcagactggagatatagcttgagaaatgctgggtactagtggtcggttactgtctgtctgtatgtatgtatgtctgtctatctatgtatctatccatccatctatcagatatctatcatctacctaccatctatctatttattagacaaggtcttataaataactttggctggcctcaaatgtgtattcttcctgtctcattctttcaaattctggaattatgggcacacatcacctctgacataaaattttaaataaagtactttctataaattagaattaaccaaaactatgagaacattattttttcatacatgagcagataataaatatataattgaacctggtcatataactttcattgtagcaaaaaggagaatagtttaatgcactgaaaatggaggtaacgtttatagcctcactagaaagaagtttctattgcagttctgtttacattttcataccagtgtgatctgtgataattttcataagcaatagcatttttcattcatttatcttcctctgcattcagaatctggatattttcaactgtagaaacttgagtccttactagttcatcggcatagtatgaataatcagagtgaagattctaagatacttctgaagcatttaaaatatccacttaaattttgcaaaaaaaaaaaaaattctaaattacatttctcttgcatnnnnnnnnnnnnnnnnnnnntgccctaatgtgattggacaggaaaaatcctgcgccactctactgcttagctaacctatgtattatcagcagccctgtatttattttcagtgagaatagggaagatttcacaggcatcattctcagtttaacttttaagaaaaggaaagaaacatctgaaaaatgaattcgttatagcttacatagtactatcagaccttattctaaaatgcttaacagtgtttcatctcaggttttataattatatcatggttcccagcagaagtgaaaattcatgaactataattctgtatattgcattaaagttagctgatagcatgcctggcacccgttggtaaagtcattgccattgacatcaacagagaagttcagtgatgttgtcttactttggtcagtacaactgtatcaatttttatgaggctacaagtaacattgtgtaactttataaagtacatgctcataatagggaaattagaaagcagacactaaaaaggcaaaaaaaaaaatacaatatataaaaacttttcatttgggacataagtactccatttttattactaaaatttgtttcaattgcacagttatttgaaattcgttttatatagtagggtgaatattttctgcaaagattttgtgtgtgtgtgtgtatgtatgtgtgatcgttaagtctattatattttacggttataaatgctaattgaaataaaaagaatatcatgtctttcccagtgatgatttgtaagtacacaaggtcatattgtaatactatgattgtgattcatgtttctaaaattttatgttaataatgttggcaacgtgtctgtcagtgtttgaacataatttacaatgaatttattcagtgggtagctgagccatttgtagtttacaagaaacagacaaaatgcctctgaccttaacaggtatacaaataaaaatagtcagtatattaaacaaagggacactgggtctactccgtttaagtcaggttcttttaacaaaaaagataggaaaagaaacccgcaccaatatgtaataaaaaaaaatcaacatagatttagtaatcagagtttctcttaagttgaataaaagattgccagagcagtgatcccatgaaaagcagtctctgcgtttcctgggattaatggtcacatcctctcttaatgtcctgagttccctggaccaaggcagaagtcatctacatagtacttcctagtcattagctagagcaatgatggactttcagaaagcaccattgccactgtgatgataattgggacccatgagcttgctttttctccttccttccttcctttctttctttctttctttctttctttctttctttctttctttctttctttctttctttcctttctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctccctctctctctctctctccctctttctttctttctctctttctaccttttttgattctttacttaatgcttctgaccaagaggacactgggaagacttttttgtttctggagtcatacttatgaaacattatctgtaaaaaacaaaacaaaacaaaaccaaaacaaaaaacatgcaagcatacatttaagttcttaaagaaaggaaagagaatatccatataatctgtattggttggatatgagatataataaatttctatctatgtggagttaagacacattttctgagatagtgttagatcctaatataaattcaggattctgtgtccagcatatgcatatgtgtgtaagctggttatgaaactactttcaaggatgcatgtgtgtgtgaggacggttttgtaagaagccagattgtaacatagcttaagaataacacaaatcctttaaatactttcctaagttttgttttgtaagattcaaacaaaaaaaaaagttttttttcttatctaagcacttctgatatccaagatctgctaaaaacattcattactatgatgacaaaccctttctgttgatagctttcttttttttaattaggtattttcttcatttacatttcaaatgctatccccaaagtccctcatacccttccccccccatccaccccctcccacttcttggccctggtgttcccctgtactgaggcatataaagttggcaagactaaggggtctctcttcccaatgatggccaactaggccatcttctgctacatatgcagctagagacacaagctctgggggtaatagttagttcatattgttgttccacctatagagttgcagaccctttagctccttgggtattttttctagctctttcattggggccctgtgttccatccaatagctgactgtgagcatccacttctgtgtttgttgctttaagaatagtcatctttagattttcaaggccagtctttaatgtgctccagctattcacaggtgttgtagattttggagtggcccaaatcaaagctctgctttggggcttggatggtacctgagctgattagcctaccagattgccagcacctagaccaccagggcaagctctccagctctcatgtatgggctttagtttttcaaaacctacatttagtcatagtgaagtgatttaacctcccttctagcataccatccaccaaaggtagtaggaaagaaagatacagaggaagtggacctgtttagaaatggttctttggagcaaatcccatttgcattgtcaggaaatgagcagttcagttcacaggttagctgcagctgctcgaaatactctcaaacacttcacaaatatcccagcaatccagtttaacctatcaggaacagccacacaggcctcagtcaaatcacccaaggtcagcaggagcaaccaggagaattagggaagccagaagttctcaactatgtctctttcaacaagatgagagaccaagaactgtcgcaaagctagctctataagcaaccccatctcacagtcctgttgagtcttatttgtattccctctaaatatcatgtgatctccacaggtcttctctcaccacatgtcttaccttagcacatgagcctgtcttagcaaaactccatgtgagtttatatcagtctatatcagctgacatcactctgccaatagtcctgagtcctcagaggctacaagaacctgacagcataccacttgaagttttttgtgtgtgcgtttctctttaaaggagtcctgacaaacatatctcaacaaagcatgtaaagtagaccaatacatgtgtgtcattattgaagatccttcatcatgcatcctttcccgtgcttgctttagtgagatatcctttcacctgtgcccatttcaggaaaacactcattaatgtgtttgccacagcaaaacaccacaactgactttccacagaactctttaagtttccacttcactcatgaccacatctggctcacccatgccttcctaccagacccagcttcactatgctacccaggcaaggtgtgaggcctggtatcccaagcctacagctagattttcagactgccacaggtggccatgacacatggcaacaactagatcttctagacaagtccctaggagattcagtattgatagtgtcgcagaagccccaggagttgaacctgaccaatgagtcattgcaatgaccatttgcaagtaaaaacctatggacaaaagggtctaatttgggacgtgctgtaacatactactgcttcatcaagatgaggttttgtagttgttctgttttatttcaatttttttgttgttgtttatcttttgtgggggagggtgcattgttagataggaaaggatggagaagatgagtgagattgtggtgcatgatgtgaaattcacaaaggaaagaaaaacacttaaaaagctgtttaatttataagaaagaaaagaaagaaagaaagaaagaaagaaagaaagaaagaaagagagaaagaaagaaagaaagaaagaaagaaagaaagaaagaaagaaagaaagaaagaaagaaagaaagaaagaaagaaaggaaggaaggaaggaaggaagaaagaaagaaagaaagaaagaaaaaaagaaagaaagaaaagaaagctgagcaaactatgggtaacaagctggggtggagtgttccagtgttcctctacagtctctgctttagttcctgcctagcttctcctgatgagggtctatactagaaaggagaaatgaacccttcctttcccggctgattttcgttcatggtgtttatagcagtgataaaagcttataggtattcatctatcatatgtcttttccttctataatctatcttcttatttttacttacttattatcatctatttctgtatcatctatatatccattgtctttatttagctacctactacccattagttatcttctttcccttttacttatcatggtctctatcaatcacctatcatctactccaatcatttatttcttatccatttttaatattgttcatgtgtttatcctttgttatcatggatctgtcatctctcatcatcttcctatgcatcatcttctgtctgaatattcccttgtcactgtctactttccctctgaatagtctgtcattactgccttctgattccatctcttcactgcctgtagagcatgtgttatttatgtatggtcatttggttcaactaattatccctaagatgcttaggtttttttttttccattttcttaaatttctgaaggacacagcaatggggcttcttcctgttttgcatctttgagaacatgtgtgcttattcagaagtattgaaggtgagggtgccaggtaaagaaggtgttccttaaaagcttagttttgaacgttaaagcaagtgtctgtctgtgtgtgtgtgtgtgtgtgtgtgtgtgtgtgtgtgtgtgtgtttgtgacagactctcactatagagctctgactgtccagggacacactgtgtagaccagctgacctcaaactcacagaaagccacaatagtgtcaactggccagacatacggaggtcccggggactgaatcaccaaccaaagagaacacatggaaggacccatggctctgggcacatatatggcagaggatggacttgttggacaacaatagtgttagtggcccttggtcctgtgggggctccatttcccagtgtaggggaatgcctggtcaggaaggctagaatggttgtgtaggtggaagagcaccctcatagaggcaggagggggggatgggataggggctttagggaggagagacctggaaagggaataacacttgaaatgtaagtaaagaaaatatacaataaaagaaaagataataataagcaaaaaaaagaaaagaaaagataataatgagcaaaaaaaagaaaagaaaagataataatgagcaaaaaaaagaaagaaaagaaaagaaaagaaaagaaaagaaaagaaaaaggtgtgaagtataatgcaggacttaaagcaaacatttttatagcactaaatgttgactggtaattttcatcaataagcagtgatatctttgtattatcaaaaaaaaaaatagttatctttcccctttttccatcgtggctccctcccatccttcctcccttccttcctttcattctttccttcatctttgtgtgtctctgtctgtccctccatctgtttatctctgtcactctctgtacggctgcacatttcacaagccttgcagatggatgtcagaggagaacctgtagggtttatttattccttcacatgggtcttctagatcaaattcaagtcgtcaggcttggcagttttacctaatttgccatgtccccagccttttcttccatattcgtaatttctcctttaaggtcaattagaatcaccaatattttgatttggggggaataaataaatatgctcaaaacaagaaacttaaaaacaaaacaaaaacacaaataattttttctcaaactattattttgaataaactttaagtcttaatataaattatgttttcaacattcaataaactattttcttagtgactatataagaggaaattgatttagctaagtagatatctttggtcaccacagaattgagaaaatgttcatgccaatttaccatatatgttaacttatcacaccagacattactttcaatgagttttaacttttttctaaaaccacaacaaaatttaatctaggatacagaaatcaatactttatttttgagatggagaaatcaaggtcaaaattgtttaattatttatttgaccagctccttactctgatgtttactcactggattagctagtaaattactttcctgagtttcaatttcttcttattcaagattcatacgtttctgtggagtccagattctgtgttctaacattgggggcatttttacttaaagtgcaggctggtatattacttctgcctttccaataaatttgtaaatcaaaacactgtaattgttccatttcttcagcttgctcctgtgaattccattctctcccagtgaatcctgtggatcacaaggtggccgtctaatgaacctgaagtttctgtctttgttcagtgatgagaatggagataatatgtttccaaactagttaaaagtccaataattgagtactgatatttaaaaaaaccaaacctcatcaatagccaggttgacataccacattaataaaattggagtgggcatgactttagcactggaggtgatactgggatggagagatatggaattgagttgattttaggggaattgagaatgtgataattgatttgagataatagagaggagataactagaccatgcctaaacccagaatcatagcctgaaaaataattcaatgtttgtgtcattcactctctattccaaaacgtttacagcagggatggcataaatgatgggaaagtgataggcttctacaatgaatattgttgacaacaactgtgccaatatataaggatgaaggaaagaatgaaatatatatatatatatatttcagcacaaacaattttaatgaattccactatattaacaaagaaataatttctactttgcctcaatcctattaattttatggtattttctaagtatcaatggcggcatatgtatcctctctttttaaagaagaaaatacaatagaatagaatgtaaacaaaacagtataacaacttcacagtcatttgtatttgagtgtattatagcatgcatttaaagattctgtttaatatttattttaagcataatatctatattatgctcagggtccaatttctcagtaactttggcctatgtatatttacaattattttcaataaaatgtacttggagtttacctgccaacaaacacctgtatcctcaccccaacctccttctccatttctaggattgcaggcttgctcatgctcacatgcatttctctttccaattgtgagctttgggattcacactgatccttgtgtttgcaaggaaagtgctttactgactgagctgcccacattactcaagtaagcatgtttttttgattttgctttgttttgttttgttttgttttgttttataaatcaaaaatactgtgcttgtccttttctcgcacactgtaaatcatagtctttcttcttcgtgaaaactttgaacccctgggcaaacttgcactgtacaacctggcaagacttactttcctgctcatgataaacaggtctcacaacacgggtgataaaaaaaaaattgtttgaacaaatatacacacggcttacagaagtgtgaacggaaagcagcactcagtcaacctacatcacattgtgcatcgtgctctaccaccactttaaggaaaatatacatttagttttgtatggagaaaagtggttagctaaatagatttgtaaggggaaacagaaattctcttgggcatgactctgattgcaagaagaggactgtgaagttattttttttcttgtttcaaatatacaaaatgttcaagaggaattgaaaatgggcagtggatttctcattctcattcatgaatgctctatgaacgttatcgtttacttctttaaacatgaaaataaccaaggccagaagtgaacctgtttcagaactgagaggaaaaggctcattgtccctaggaaaatcaattctgagctgttgtacaagcaagcaatgcatgaatcaatcttggttaatgttataactttatcttttaactatgctaagcattttatgtggaatgttaatcttttggagaattgttttcttttcatatttcttaaattagggaaaagactgaatttttttttaattaagctagaaaagaattagaagatttcatcttgggttgtaaagaatttagactgaaaataatagtacaaatggcagaaacaggggctatttatgaatatgtgttagcaagtagcatccttaatgctgatataatgcattttttattcccacaatgagaaagattaagtagcttttctgggactgacaggcagtctaatcccacttttatattagctttctctgactctaaagttaccttcctcaatgtataatgtagattgtgtctgcttttagctcttatttcacaaggagagcttaattccacctctgttgctgttgagtgtattcattccattctttagatcaattgattgtgttgtttctttgattacctacagagattcattaggaactgacttatcaatctctgtatatctttggtatatctatataacacacaaatattcattataacacatgtatattcgtgtgttaaagggattcaacttgcaatcatcaaaatcatagggcagcaaaaagcctcagaaactgtagatgcaccaagcagaaacatacatttagttttacaattccccacttacagttgcacagttctccaaatttgtatggagcataacaataggtaagtaggaagaacacatatattattcctgatttcaagtggtttaaacaaagacatgtcccccaagaactcatcaggggtacagattgttgatcctagctaatgctagtgcttgatttttatcaaagtaggctattatatctattaactaagagaaatttaatttagactaactaaccatgctgcattcaattgtaagcatgagtaaacagtaaagtttccattttcctttacaagtgtgccagtacaatgccccatgatgcacttgtgtgcaagtgggcaggtaaattctggactggctgctgaaatggcaaagggcagagaatgtgtgcattttaggacagatttctaatcatattggatctatgaacttagttcagttttccaatcacaattcattcaacatgaaattttcttcctacttgctaataggtaggtaaattatcttaaggactgtcaagaaaaaaatttctttctgagatgcttgcaaatacagattggaaagcaagttatcagtagcatcagataggaaagtctttggattacttagaattcctcatcaaattttgttaaatctttgtatttttatggacttccaaacagcaattgtgttctgaatttatatagaaatatcttcactgttttatttcacataacatagaagaatatatcagcagagtagcctggtttctgtctagtgtttggatcattttgtgctgctgggagatatgaggtgtagacatttcatatttcaggaggaatacatataatttagtagccaaaccattcattgttgaaaagagatttttatcgtttgcccaaaaacattatcactataataaacatctaacctagctatttttgagccctctggttcaaagacaaaacttaatggggaaaagaggtgggagagatgagcaataggtcaaagagggaagaaacaacaaggcaagattctaccagaatattaaaaccaaggagaaaagcaatgcaaaagggatgaacagggagacagacacaggagatggcagagcaaaagctttggaaccatctaacctgcatttaattgttaggtatgtcacccgtctataggattataaaccaattacctaatttaaaatcccataacaaaatgggaaaacatgagaaagaacattaaagttgcagcaacatgctgtgtgtgaatgcacatgtatgtttctgtgtgtctctgtcagcattgtctgtctgtctgtctgtctgtctgtctgtatctcgtgtgtgtttattggggcctgctgtcactgatatccctaatctataattcagaaccttctcaatggtgctgacctctaagcccagtcttcaatgttgagatactgcttttcaaatagcatacttagaagtgagacaggagagtggcccgacctcctggtcagcacccacatgcactcgagctgattctactgatctatttatctgagctcatgctgttttgtgacatttcattcttcatggacttccagcgagatgatttaaggtgcacacatcaatcagagcctaatcatgctcaaaagccagtggcctttcaggggatgagacaagcgaccattgagaccagttcaatcaaggaggctcttgggttcagagactcccacctgaaataaatctggagaaggcttttaaattcaataagcactgatgaagtaggaacccatgaggcaccctgactgtacaggataaatacatctgtcccagagcagccataaataacactctttggttttcatctataattaatactaagtagtagtaacagttgtttcattgaatataatggctaaggctactcctatctgtgttgaagtttaaagtaaaatggcttaaaattataaggcaatgtgttacaatatgcaaacatttttaggagggagagaggggcaaataaaacattttaatttttgctttatcttattatgaacaaggatattaaatttcactttatttttaagaaaaacaccgagagatgaaggttcaaaatccttggctctggttattttaattcaaagtctcagtaacttgagaataaagtgaactgactccaaggttgtagttcttgtcatgtaagacttggtgaaaatggaaaaaaaaaaaaaagcttagctgataaaaatgcttcttcgaatgaaaatagaagacgaggggctagggagttttctgagttagtaaagtgcttgctcgataaacaagaagacctgtgttcacattcccaggtccaggaaagaagcccagcatggcaatgcctggaattgtaacactgggcttagggaaaaggcatgtggctggaacatggtcagcagcaagtcttgttcaactaggtatcgttagagaccccatctcaaaattgatagacagtggcaaaagaagatgtttaatgctgccccgacctgcagaaataatcagcggggacctagcacaggggcgagagagtgggagggacaagaaacacaaagaacgagagcaagacaactggactgatcaagcacagaaaaactttattcaggagtggcaatataagtataagcaagaggagccttcaaggaaggcgggaagagcctaggggctctccaaaggtcaggtggcaatctcagctcctggaactaatggtcatagcgtcctctctactcataaacattattactgttatgaccatgaatgttctctcaggatggtttctgtaaggcagaacttttccacaaggccatggctcctggcataatgccaaaccccaacttgcacattcacttacacattcatatatagggacatatatgcacataattatataaaaactaaaaatgtaaaaatgcatttgagtcagctagcaatcttcggagtcagataggtccctgagttcaagacagcaaggtgtgggttctctcctgtatctttgcgagtcattttcattcaggctttactcatctatgtatagtttaaaaagaaacaagtatctatcattttttaatatttgcacgtatattctatctcttccaatgaaataacactggaaagtgctgtgatttcccaacatctggcatgaagggcacaagttgatttgtttagtggcacctttgaattaatgatacatccaggatttaattataattttccattaagaaaacttgattgatggatataataactgaaatgtaatatacatctttcttatgggtctccatgtaactcagagtgtatttatgacaattattttcacttaaggagataattgctactttcaaaaatcctttttaaaatgccatggttttaaagtgtctaaaataattttcacttctttttctcccgatagatattttaaatattgtattgttagaacagagcagtgcgaggtttttgaaagtatccaatttctgcccagacaggcaattaaaatataaattctaggagaatttggcctgccagtaaaagagataaatatcatgagaaggattgcctatagaggtaagtgtgcctctaaatgtaatattccctctcaaagccgaggtcaaaggccagtaaactaagcgatttctggtgctttaattgtagatagccatagttctttagaaaatttcagcgtaaggtttgtcaaaggcaagaacactaactgacatcacatgtctatcacctaacagctttgtagcctagaactacagtgttctttaatgtatatcttcttttatttttctacactgcagtgataactgaaagatcttctgtaagaaatactctgccagagcctgacaaataaagaagtggatgcccatagccatctgttggactgagcacaggtccccagtgaaggagctagagaaaggacgaaaggtagctgaaggggtgtgcagccccctaggaggaactacagtatgagctagccagtaccccagagctcccaaagtgttcatgtggtggaactcatggctccagctacatatatagcagaggatggcctagtctattcagtagaaggagaggcccttagtcttgtgaaggctctatgccccagtgtaggtaaatgccaaggccaggaagcgggagtgggtgggttgttgagcaggggtagggagagggaatagggggcttttggaggggaaacccggaaagggaataacatttgaaatttaaataaagaaaatatctaataataaaaagaataaaaaatgctttgaaaatgctgtttaaaattaccaacagaatcaactaacctgtacccttggcatctctcatagactgagctacgaacaaaagagcatacacacattggaccaaagccctctgcacatatgtaaatgtgtagcttagtcttcatgtaggtcccccaagaacttgagcagaggctatccctaaatctgttgcttctctgccaaatacattttcctaactggacagccttgtctgccttctgtgggagagggtgtacctagctctgcagagacttaatgtgccagggtaaggtgatacccagagggagcctccaatttctcagaggataataggagggagtagctaaggggctgtgtgggggactgggaggaaggcagtggggtcaaaaattatatggaagagtttggagggaggacaggaaagggagaaatttataattaaatagaaaataaaatcaaagacaaaacagcgctgctgcagcatggtgtgtatagaattgattacaaaaaatttaccttagaacaaatgttgttatttcttcaaatgtagaacaacaacaaaaaatagaaatagaagccacaaactttgaacatcagaagtcacaatgactctcactatggtttgtactgtgtggtgatgatagttgtcatgatggtaatgatagagatgatggtgatggagaggagatggtcatggtgatggtggtaatgaccaggtcagtatatggaataggacagaatttcaaacccatttatgaataatgggaacagagtgacctctcaatgttgctagagctttgtgtagagtcagagatctatttttttaagtcatgtagtattaggcttcattattcttgttcaatttaaggacaaaattattgataagcttctatataacaggcaaacagtgaacttttatctttctatagctggcaaactgtgatagagttatcctatcctactaaatgtaccagattaattacctaaattaatggatttcactgcagcatttcaactaatagatgttttgaggttttccagttcttctctttatctgctaaaacaataaattgccagtacctgaaagaggtcgtgtcataagaacacaagttaggaaaattcttatataaaaagctcagttcaagactttgtaaatcagtttatttcatgttaacgtaattaatatcctgactttcataggtgagataatcttttaacaaaaggcctttaaactaggagtggtgccacagacatgtaatcgcaggatttaggaggctgaagcaggagaaccacgagtttaaggccagtctggaatatatacaagtctctgtcagcataaaagtttatttatgggctagagagatggcttttattcattagaatgagttaatgaatcagaggctgttagaatcaagattcagccattgactaggtaagctaacagctttgagaagcagaattgatagtagggaagtgttatggcagcccaaacatgaacaatgaccatagctatagagattctaacatgtacaggaggaaagccaattagaactgaaatgaacacgaagaactacaggccactaagaaatgtagagagctagagaaatattctcccacacaacaccacaccaattgattatacaatactaaatagccctgaaaaaatatgtatatctacaagcaacattatagttcataattatgtatttaggagtgtgtgattttgtgtgtgtgagagagagagagagaattaataataaattatatcattagtttgaatgagagatatataagagggtttaagggaagatggaatgggtgaaattatgtgacattacattctcaaatagtaaaataattgttaaatggtttgaatgcttgcaagacagaatgcaaagtaagtggaggctgacattgtatataagtaactgtgaagatgtttactatgataaagatagtgactagaggtgagatattgacatttgattactttgcttgatgttttaatgtgttaatttatttaaaggtggatatactatgttaataatgctaattgatgttggttttcttgtagtaatactatccttttaagaacaaagtattttttcttcatgcacaataatatcttctagaattataatacacagtaaaacaaaaaaatatatttctgggtatattcattcctggcatgttccaccatgagatccagatatggtttatgacannnnnnnnnnnnnnnnnnnncctgtttgagttccagtcctgacttcccttggtgatgaacagcagtatggaagtgtaagccaaataaaccctttcctccccaacttgcttcttggtcatgatgtttgtgcaggaatagaaaccctgactaagacaaattggtaccagaagtggggtattcctatgacatcttgaccatgttttggggaggactgtggaagaactttggaactttgggcttgaagatccatccgttgttaagagctctgtcggatgttgtgtaggagcttggaagataatgttgagaacagtgcagaagatggaggcctggcttgtgaaatttcaaagggaaaaaattaaagactcttttcagggccattcctgttttgattgtgaagattatgtagttctggttagctggggctgaagaatcagctgtgattaacaagataccagaactactaaagcaaaaactttgcattactgggactattgatgctggttagctggagctaagaaattagcggtgattaaaaagagaccagcatcattgaggtgacatcttctgggaagtgttttctgaaagcacaaaaaggctgtcttccagagatagccaaggttgtattcctgctgcagcgggacttggtaatatgtaagggtcacccaggtggtactggttttgaaggcatgaaggggtcacgcagagcagctgaggctcagcactgtgagaggccatggaaggccattggtgaaggtgcagcctcagttgcaattgaaggcccaggactgaaggggtcatgcagtgttttggagatgccagtgccatgagatgaccaccaagagcagcagcagcagtggagtacaggcatctggagcctagaggaccatgcgtgtgctacaagaggcatggctggagaagtgacccaagcccttggaggagcccagaagatcgtgagttggatcccagacattggatggttggagattgatttttgctttgattgtgactgtgccctgatattttccctcttgaaggaagaaactgttttagtggagccctcagttaagagacttttaactgaggccccttgtgggtggtgccatctctgggctggtagtcttgggttctataagagagcaggctgagcaagccaggagaggcaagccagtaaagaacatccctccatggcctctgcatcagctcctgcttcctggcctgtttgagttccagtcctgacttccttggtgatgaacagcagtatggaagtgtaagccaaataaaccctttcctccccaacttgcttcttgcaaaacgactttggattttaaaagagatggatattttaaagagattgaaattttaagaatatgtaaagactgtgggacttttaaagttgtttagatcttggggatgaataagaatgtaagggttgagggttactagtgatgtgtttgtgtgtcaagttgacaaggggtcaattgtactggctagttttgtgtcaacttgatacagctggagttatcacagagaaaggagcttcaattgaggaaatgcctccatgagatccaactgtaaggcattttnnnnnnnnnnnnnnnnnnnntgtgtgtgtgtgtgtgtgtgtgtgtgtgagagagagagagagagagagagagagagagaattatgagagagagagagagaattattaataaattatatcattagtttgaatgagagatatataagagggtttaagggaagatggaatgggtgaaattatgtgacattacattctcaaatagtaaaataattgttaaatggtttgaatgcttgcaagacagaatgcaaagtaagtggaggctgacattgtatataagtaactgtgaagatgtttactatgataaagatagtgactagaggtgagatattgacatttgattactttgcttgatgttttaatgtgttaatttatttaaaggtggatatactatgttaataatgctaattgatgttggttttcttgtagtaatactatccttttaagaacaaagtattttttcttcatgcacaataatatcttctagaattataatacacagtaaaacaaaaaaatatatttctgggtatattcattcctggcatgttccaccatgagatccagatatggtttatgacagtgtgaaagaagagcttcagtagaatagatagatagatagatagatagatagatagatagatagatagatagatagatagatgatagaataaaaatgtatgagagacctaatagagacttatcgaagactgacataattgtgaagcatcttgcatactgtttaatttcattgtgtcaagtttactagggcatcaacactgtggtaaacttattacagtgatatttttatactgagaattgaagttgttgaaaatgtgtctgagacacctatgagagccattagcaattgtgactcccaccttcactgctggtattgattctctctaggaagaccctggggcaaagtgactcttgagcctaaacacccactgaaaactaggttctcagtgatcttattgaacacagatgctgttgggaggaaggaggaaactcaaactcagggacaatcgcacagctctcttctccaagaccaggtttggatttccaggaccattgaaacctatttcataaattggctcccattagatgtctttctgtttgttggtttaatttctagacaactgtacttgatacaagcttaacctgctgggtagtgaacttgaaaccctgctcctctataatgaaggtcactgcggagggacattcattgaggtggttgttaaattgctgagttttcaaggactttccatgaactccagctgtaattccaagctggtatttcagtaaggcagaaagacttaaaatggtctatttcccctattctctctggcaatttgctgtaagtgctgattattttgtcaagacttttgagctcagagcgctgactataatatcctcagcctttgatggactgtggctagaagaataagtgtttgaaatgaaatgcctggattacttcggggaaaagttagcaatgaagcagtgcttactcacctttggggaagactgagtaaatgctaataagcaacaattaggagtcttccatttattggaaaatatcatctgaatattcccccatattgttcaatcacaatagccagccatatgatttcattgtaagtgagaatcctgaaaaggaaaggcctttggtattctcttgaggacttttagtaacagtcgtatataaaacacaaaaatttcaacatatctcttttggagtttaggaatagtattatctcttactgaaggggatgtttactcagcaagttctgggttcccgatcatttagaattatttttaacatctatataagatattttgtgaagacacaaaaatgctgacaacttattatcattagctacttttatagatctatgaaacatttaactctattttaaagtcatttctcgcatctaggaaaattttagctattaaatttatatgagataccacatgtcttattacgcagtttaagcaaactatgttgtaacagtaaaaaaaaaattaattccatagaataagtattcttaagccctatattatgtagttaataacattttctttatatagttacaaaggtgaaaaataccagaattataaaattaatatgaaatagtaaattttttttactcatgatccaaatgatgaaaatttattggtgaattagtggagacctaaactgtattcttcaaaggactgtgaagcaatatgtttctatttataatttttatattacctggcccatgaaaattggtcttcaactttatttagacaattatgtatacaaatattaagtaatgggtccttgaatccatttgaatctctatttcaatatatttatttttatttcatttatatgagttttgcctacatgtgtatatggatacctcttccatgcctgatgctccctaaagtagatgactgtcttgaatcctctggagctgcagctccatgtggttgtaagctgctaccttgtgggtggccgcaaacctcgattgtttcaagatcattcacttaaacaacaaagtatatggtggaaaataaggttgggtacaatactcaaaatttacttaagtctgtgttcactgcagttaatgaaagcagccttagtcctaataaaattatggaattaaataacatctttgatttctgtagcaaactctccagtaagtatagaatgttatgttctgttgagaaggtggtggctgcttcatgggatagactaagacacatttgagaatgtggtgtttatgaagacacaacagaggtcttagtgagtccttcctggtcttacaaacaatcagattaagtggaaaaggagcaggaaacaatatcagatacttcaaaatcatgttgcatagctggatttatcatctgtcctaggaaatatgaggatgtcaaagaaaatcatgaaggtattctacttttattataccatttttatttcatattatcaaaaacacatgttatagtttatatttcaacaacttacattatacaagaaagagggtctatactaattcagagactatgtagtaggaaaagagaattatgaactatgcaagggcttaaataaaaagcagagattaatcttatatatcaagcactattgataatactcaattctacactaaagtccttaaactatggcattgtcattttacattattagaaattatttacaaaatgtggggtagttaccagagtgacctgaaaaagaaatacaagttattgttgggttgtgttagagagaactgaaaataatttcccccatagaaaaatgacttgaagagtaaaatcaaactcaacttgacatagatcagaggtgactttcttgttactatgtgatgttatacatcctcttggattgttctgcctcataactactcatgatcaacccattctaaggcctatcaattctcatttcctcagccttaccattagtccagtagagatgcagatcttttgctaccaatcatagaacatatcgcttctccatctgtcagctagagcacaacttcaaagtgacattctgatgaaggcttcctcctcacaaattcatcacatagtcattaaagaatgaaaaacaaacaagcaaacgcacacacacacacacacacacacacacaactgcaacaaaaataaaaatgaaccacactccttagcataacttttaaatttgatttttaaagtcattccttatatgaatctgtgacccaaatgaataggactcataaaatttactctccattgtcattgtgactatatttttgattgtttggttctcaaaactacgagccatttctacttactggaccacagaatctgagtactcatacctcgcttctcaaatggcactcccttttatcatccatcattctttctcagtagaattgactttgcattctgaggacagtacttgttccctaaaccatatcatgtgcccatcactctctctatctctggttttgtgtcttagcactgaccttatttattttctttgctatgatatctctacaatagagaacaattactagcaattaaaattcttcaatacataataaaggatagtgcttgatatgcaaaataagaaatattgaatgggttttagaacttctaagaggaattttatcatcatattgctattgtttacctaagatgaatttccattttctaatctacacataaatggtatgttgtatattaggttttaagggttatcttttatgctatcccaaaatcagacagcactgtagaacaggaatttcttgatatatcatttgagatgctgggattctaaaataaagacatcattaagagtatagtagtaattcttctgtgggctctggagaaagacactctcctcttcctagacactgttagttagacattctagggctttgtggttagtagtcatataattccagctcacatatctgttgcccttgtatgtttagattgattttctattatagagatggtgagtctaatatggtgttgttcgatttctttatgatcatcttaactaaacacagccacagaggtgatatttctaaacagtggcactctacagaattaggtgcatatgcacttttgaaaaacattcttcatggctgtagagtgtgtttcctaaaatactgtaatccctttgagccaggaccatgtatttctttctactcttccttgcatacctaatgtgaggtactggatctaactttaatttaattataattttatataagtttgatggtcaaaggtagaagaaaacatatatatctgtccaaatttattggatacaaattttcttattttacaacatcacaaaataatgccaaaacctgggtgaccaagtgcacaaatgctttatcatttaggcaacattccagatttacaccataataataaaaggctagtacaaatgaaacataattgtcacacttcaatttcatgaatgatctgagagagagaaattaaagttgatattgaataccactgttgataagaatggaaacaagctatataatttaatcttaatttctttctgagcattttaaaaattagttagaatatagctatttgatttacagctggtaagagtatacattgtataattctatttacagaatccattcagatctagtaaaccagtttctgtattcactcatgcctcaaaactcagaatgccctaaataaaagaacaaatataatataatataacatttattttaaacataaaatataatataggtatatgtgtatatgtatttccctgtgtgtggtggaatttatatatgtatatatcatatacatacacacacacatatacatatatacatagatattacataggaatgtaacacaatgaaaaaaagagggtatgaacttcaaatagaaaaggagaagtttgtgtaaggttttgagtgaaggaagagaaaagtcctaattataactttaaacataaagaaaaaattataagagaatctgtactgtagtgaagaagctgaagagggagttcagtagttaagacctttagatcaaactaacaattcgtagcaagatgcatctaaattggtatcctgcactaacatatttggtgagctttaaaaaaaataaaagtggaaaagaaatactcagaaaattttgcttgtaaataaatttattttcaagctagtccctaaagcatgtatattacaagcattaatgtgctattatctgatgctctcatgaactacatattataatgcatttaagtcagtttaaatatctccaatgtacactgttttcttcatggctaaaaccatttaaaattcttaattctagacttttctctatgtagttgcacagtgtagaatcatgatccattttcatcataacatgcaatagactataagaagtacatttttatttttaactccaactcagtagtcagtgatcagggttcattgatgatttaatggtagatgacttactgtgagtgaaacaatggactactcctttactttggctaaaatggaatagttttgtatttatatttatacttgtgttatattggagtcagcattcttgacgctatgctaatatcaaacttaggagaaacattttatttgagcaacccctactaacattactatagatttaatagatcgaacacctttgaattatatgcaaaggaatcagtcagaaataatatttagtgagaattttctaatgtgaatatggcacgcagtctaacaggaaacaactttactttgcctgtacaatttgtaagttgcctgatgactgctatcagctaaaattgactgttttctctgcagaaaaaatgacatattactcacctcagaagtatatgacatgttcctttcctttctattctaatcaaagtcgaaatggggggatgactaactgaggatgaatgatctgttgtgtgcacaggggtccaccatcaaaaaaaggatcagaaattgcataggacagatttggattgagacctatgattcaaaagtggattaggatcccacgtttgccatcactcgttttctctctgatgactgttctgatctgagctaatgaatagctctagctatgctaatggaggatgcagtgaacaaagcaaataacttgccatgacaattaagccctctaactgccttacatcgggattactaaagtgtctgctgtcaaggaagacaaatgaaaactcctgtgctaaatgcatttcagctaaaacatactaaatattcttctgagacatggaagattgcaaagcttttaatattttaaaggggaaatatattgtaaatggtaagtgcattaaaaatcatcttaataatggctaaaaatcactgtaacaaaaactcaacagaaatttcagttttgatactcaataccttctagtaaagaatttccttaaagatactttctgttgtgcatatggactgaaaatatgttatttaactgtttttctttctactgcaatgctaccaacaaacttagtagtttagacaatgtgcacttgttttctctcagatttttgattaaggattccaggttcagctgaggtgtgcttcagtgtctcattagaataggactcaagaggcagacatgaaaaagttgactttgtcgaaagaatcctcttacaaagacaggaaactatatacagaaccaaatcttttactacatataaggataggggcttatcttcttgctatcaacctcagctctttaccacatgggcctctccaatcttgcaaaccagcttcagttcaattaacacaggataatttctttgtgaagaaagggatattattcttttgtaatattatcatagaggtggtatctcatcacctatccacgctaatacgtcttagaaagaagtggtcaagagaaatgggccttggctaactggaaaccttcgtaacattttattatattaaagtgagaacagtggcctttgtcttgttcatggttctggtctgataaatccaagaaaaatattgcttaatgttttgaggcattgcttcaagtataagtgtgttttccagggctttccaaaacttgattgcatggatttattaaatcaaaatttcagaaaagtatatatatatatatatatatatatatatatatacttatacaaaaaaaataactgtaggcaactgaaaaattctgagaggagggaagctgatctcacaccacactacttggatctccagtgccaaatgatcagccctgaaagcatatatttatgtaactttatatggactgaacatgttatatttagaaatgcatatgtatttatctatgtaacatgtatgcagtaacaattagtgataagagaatcaatatatttgaagaaaaccagaagtggcatatgggagtgtttagagggaataaacagaagaggaaatgctataattataacctcaaaaagaaaaatttaaaggcaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtgaacatgaaagtgaacagggaccttgtaatgtaagcagatgcaacaggcaagaccgcatgctagagagcaatgaacaaaaatagggtccaccctacttttaatgtctttggccaccttgcagccttatgtagataatagaagatgatcgatttcaaaaacattatcatgactctttaagtgaaccctccccgactcataccagagttgaacttattcagaaactagcccatgactcctgttatagccatattatttcccaaattttgtgcattacatttccaagggaagatttaaaatatttgcatcttatttgaagagataattacatcacagcagccttttaggacttgacttcagttaaactatagattttaaatgtcacttttgtgccaggaataagtatgtacagaggaaattttcaaaatttttattttctggaaccttctgttaaagtatttgtaagtagtctgtctttgaaagtcgctatccggttcctttgcttcctatccttaatttctaggatactactcaaaatcatgtaaacattcctcaaatgtccaaatgggagcgtttccttgttttagtaaatgatgcagaagttctattatatctaaacatacatcttaaatctctacttcctggcttcactcccgaatggaccaacccatgggcacttctcacacttcatctgacctgatacaagtaacagcaccttctacttgacctatagcttacataggatgttgctcacttctgcatcattttgatacataaaacttgacaagagaaaagtttatcacgtctcacagtttcagagattgtaatccacagatgatcttcctcataccacactactaggatctccagtgccaaatgatcaaccctgaaaacatacatttacgtaactttatatggactgaacatgttatatttaggaatgcatatgtatttatctatgtaacatatgtgtagtaacaattagtgatttggggctggtgatgaggcagatattgtctgtggcacactgtggcagagcagtctgctttaccatggcaagtgggaaacagagagaaggaggaagagaagagggccgaaacagacatagccacaggagacatcttaacaaacactttctcttactaggtgaaatctcctgaagtgtccatatggccaataaaaatatgtcatcacctgcctacttagaattaaacacagggctttttgtgggaaacatttcatattttaaaattgtgcggagcaatacactgaagtggtagaattatcttcttacactgcttaaattaactctatgtatactatcactataatggattcctttgcttttgatgaataaatttatattcttcaaattaccaggtattgcgcaaccaatctagcatttgtctttagctcaaaacatattattaattagtctgcctaaaacaaagttatccagtcccttgtgtttctccttttgtaatccatcaatcattgcctctcccatttttatgcttcatatatgtttctttatcccagggacctctgcctctagcacaggctacagccactgggtgtcactgtagtacccattgtccttattacaatgtaaagtacagaggaggagctttagtgtttatccagtacaaacgagtcaaacttcatgattttaaattcatagtctgaatctccttctggggtataaaataccatgaggtattttagataatgcagtagcttagttaagatttctacggctataataaaattcatgacaaaaagcaacttatagaaaaaagtttatttcatcttataactctcacactgaagtccaatctgggaataattaagagaggaaatctggactatgaccatgaaggaaaattactttgtgacttgctcttcaggcttgctcaatctgctttttatatacccccaaagtacgtagggctatatacagcgaacacaaacaataggccaggccctcccacaccaataatcaatcaagaaaaatcaccatagcataggctctcccacataccaatataccaggggcatttttatagttgatatcctctcttcgcaaatggctttggcttgtgtccagctggtataaaactagactgctcatgcaacatgttcatagtttgcacaccaaatattgtacacagaatattatgaagacgtcaaaattactattcctgagtaaaaaaaaaatatataaataaaatgaattaaaattaaactgaaaatactacttcaaatattttcctttgcagatctcccaagacattttgctcatttactcaaattaaaattcattcactcgttcatttctttggcttgccaagagtaaatttgctttttgtaagtagatctttaaaagaaaaaaagatttttagattttgctgccaaagttttgatcatgaaattgtaaagttacatcagaacaaaattcactttagcacagagtttaaagtaaacttttctgtgagggacagaccatttagcacaatagtcaggataaaggaaagaaaaacaatggagaagacctggggcgttatctctacattttattttctgcaaaatgcaaaggaagatgaaatatatgtacacatatacacaagaagagaatgttaacaacagtgtgtgtgggaagtaaacctgttttcctggaatacaggacattttaatgagaacattgaaaagtataaatagataaggattcagcttactcagagtcattccagataaccattgaaaggacgtgaatcccaattttgaggacacacacacacacacacacacacacacacacacacaatcagaatttcttgaagaaggcatgaggttgtcaaaacattgctgaaaactgttaaattgatctattatttaactcattttatctgtttattatttttcacaaagatgtgatgcaattgaataaaatccacaagtctaagtatgcatttacaaggttttaattctcaggatttcatccaccaatcccccaaacaccacacattggctatgcagtcatttctctgcattgttctctactgtgagaatattgccttcctttgtgtctctatggatttcactgttatggaagtttcaagcaaatggaacatgaaagtcccagctggtttggtgtggtttcttctattttgtgtaagaatatctagaataacagatattcactacttttcatgacaatgcatgcccgatgatctgcaccatcacatgattccaggacattttgtttaatcgctaacgagtgtctccccaccacacacactttctagttgggatgaataaggaaacctatgagcatttgtatatgtgtgtatacatgtgtaaatattcatgtctgaacatctgctttctatgaactttttttttatgattttcttgacacatagtcaggtatgtgctataggaacacgtggagtctgagtaaagatgtagtttgcatttcaaagccaacaatgacagggttatttcatcatttgtctctctcataagcagtctaaatgacttcagaaagacagaaaaagaaacccacaggggattcttacagtgaacagtaggtggatacagggcagtgatctccacacattctttcaactgtaccaaattaggggatctttcccatcagtctctctagctattaggtaaatggtgagaggacaaagcataggattggaatgagaattaaaagtatcagtaaacatttattttttgttgtttttttgtttgtttgtttgcttgttttctttttttaaaatttattacgtattttcctcaatgacatttccaatgctatcccaaaagtcccccataccctccccccccccacttccctacccacccattctcattttttttttggccctggcgttcccctgtactggggcatataaagtttgtgtgtcccatgggcctctctttccagtgatggctgactaggccatcttttgatacatatgtagctagagtcaagagctctggagtactgggtagttcataatgttgttgtacctacagggtttcagatctctttagctccttggatattttctctagctcctccattgggggccctgtgatccatccaatagttgactgtgagcatccacttatgtgtttgctaggcccctgcctagtctcacaggagacagctatatctgggtcctttcagcaaaatcttgctagcgtgtgcaatggtgtcagcgtttggaagctgattatgggatggatccccagatatggcagtctctagatggtctatcctttcgtctcagctccaaactttgtctctgtaactccttccatgggtgttttgttcccaattctaagaaggggcacagtgtccacactttggtcttcattcttctagagtttcatgcatttggcaaattgtatcttatatcttgggtatactaagttttgggctagtatccacttatcagtgagtacatattgtatgagttcctttgtgattgggttaccttgctcaggatgatgccctctaggtccatccatttgcctaggaatttcataaattcattctttttaatagctgagtagtactccattgtgtaaatgtaccacattttctgtatccattcctctgttgagggggcatctgggttctttccagcttctggctattataaataaggctgctatgaacatagtggagcatgtgtccttcataccagttgggacatcttctggatatatgcccagaagaggcattgctggatcctccggtagtactatgtccaattttctaaggaaccgccagactgatttccagagtggttgtacaagcttgcaatcccaccaacagtggtggagtgttcctctttctccacatcctcgccagcatctgctgtcacctgaatttttgatcttaaccattctgactggtgtgaggtggaatctcagggttgttttcatttgcatttccctgataattaaggatgttgaacattttttcatgtgcttctctgccattcggtattcctcgggtgagaattctttgttcaattctgagccccattttttaatggggttatttgattttctggagtccaccctcttcagttctttatatatattggatattagtcccctatctgatttaggataggtaaagatactttcccaatctgttggtggcctttttgtcttattgacagtatcttttgccttgcagaagctttgcagtttcatgaggtcctatttgtctattcttgatcttacagcacaagccattgctgttctattcaggaatttttcccctatgcccatatcttcgaggcttttccccactttctcctctatacgtttcagtgtgtctggctttatgtgaagttccttgatccacttcttcaacgaattagaaagagcaatctgcaaattcatctggaataacaaaaaacctaggatagcaaaaacttttctcaaggataaaagaacctctggtggaatcaccacccctgacctaaagctttactacagagcaattgtgataaaagctgcgtggtactggtatagtgacagacaagtagaccaatggaatagaattgaagacccagaaattaacccacacacctatggccacttgatcttcgacaagggagctaaaaccatccagtggaagaaagacagcattttcaacaaatggtgctggcacaactggttgttttcatgtagaagaatgcgaatcgatccattcctatctcattgtactaacatttatttttaaatagagtcagcctcattactatgcattgaagttgttggtgggcgtggcaattccatgatcagctttttatggaaaatttcattttcaaagtgattgcaatgttttactttcttacgaatacttcctattgataattgattggttgatttatttatgttatcgtggatatgaagatgaattatatcaaagatcctatttattcactgggcaattcctatattctcagacaaactgatattcacattttttcagaagttttacttctgttattccttagttattgttgagctattaatgttctttgcatattctgaatataagaccaacattatctgatttgaggatgtttttttgtccattgtgcatattgcctcttcactttcttggtgattatttttttaaatgcttttaattttggttaagtgcttttcaattttttatatgcacacacacactagtgtgtgtgtgtgtgtgtgtgtgtgtgtgtgtgtgtgtgtgtgcgtgcgtgcaagtgcacgcgcatatttgtgtatgcatgtatatgcatgcatgcaccaagcccatgtgtttcaagaagctatagaataccctgatggggtcatttctttccttctgccacgtaagctctcagactcaagtcaggtcattagatttagcagcaaggactgtaacctgctgagccatctgagcagctctcaaatcttacttttaaatttgtttctctgcttgcttttgcttttagtattatacacaaagaaacactaactaattcacaatcactatgatttatactccctgtagtatcttccaaatgaaaactatttattaagatgttttattttgtttgcttttatagccagaaactgtcaccctgtaagactactacacttcttctagagttcattagtaaagataagtaaatgactttgtgtctagagccacttttcatgatgaaaatgtttcaagttcttcatttcataatcggtactgatcacagtggcttccaacacagggcagcagcacactggggtacaggtgtggattgcttggctagaatcactccaggggcagtgtccattcactaatataccaaggtacaccttggtatacacatacaatttaaatcttagttaaaacaaaataatatatggtaataaccctgggatatacagaattgctatgaaactgaatgctctaaaacataggtactctatttactctctttcatactgccattggggaaaaaaaacagcattttttttattgcatttgttttttatttctgtgtgtgggtatttttgtactccatgcacacttggtatccgtggaggtcagaaaacagtgtaagtttgtctgtagttgcagttatgggttgtgagctatgataaaggtgatgggcattgaatccagttcctctgaaggagaagacagtgggctcttacccatggaaccatctctctatcccttgaaatcacatcataacaatgacatctttaatcctctgttcaacccaagtcatatgccattatcagtagagctgttgacttggaacatggtctccacagagtattgtatttcactttcaccccaggtctcaagaattagagtcatgaaggataatgtatggtccttctacttattagctgtgatttttaagttacatagtcccaccaagtctcttttcctatgtaaaaatgcaggcaatgatacttacctgtttgtcagtgaagccaggaggtaaaccacaatgaagagcaggtatcccagcacatagaacataatgttaactagggtactggcataaagataatagagaattaataattttagaattataagcacaaatcaaccattgatatttttttccaaggaaagaggctaacacagcatggctagtttatgtatctttttttttttttaaagtagatatgatgtgtctgccctttattcatccaactgagtgcctttctggtctttcctctttagagtgaaaaccaaaagccaccagcagttccctaatcctgtgtctatttcttcctttatttcttcagtctaaggagcaatggctactacttgagatgagaactgtggattcagagtctacttgaaatgtaccatctggttggttacgtttctctctggggtaaaagacacccacagggtgctctttgagtcaccctttcaaaggcacactgcccactgagtgaggaaaatatttccagacggaagtcaccaccctcagcaggtggagtctctcttttagcgagagaaggctaatctaggctggatggaaagttttcaggcccttcactccactagaatgtctgattgttcccaccagaatcaggtgaacttcgcaccagccttctctcatctcctcaactctgagcgagcacacatctttacttgaagtcagcgggagcgcccggagaaagaggaacatttggaagtggcagatgaaaggctccagcatcaactcatccttctgtctccatggtctggatgactcttcctattcagtagcaaatgctgagaagtaattatctttccactagcttgctttaaaatgccaggaggttataaatattcccctaggagtgaaacagcttggagatataaaacaggaagtgaacggaaagggtgggtgaatgtcttgtgatgccaacctcgaattacaggacacaagctttttatttaaccagtgaaggtgtcttgattccctcttccaactgaatgaagttgaaaggaaaatttacaagatgtcttaaagtgctaaactatgtgagtaacataggggaccaacctttgtcacatgataagggtaatgagaataaataaagttggtgtacagtcctgaccaataaataagcaacaatggggaaaatatcaaatgagcaataattttcaagaattacttcttgaaatgtatgaaaggatgttttaagcaaaagctctagagaaataaatgttaatgagctacagaaaggctcagtatttggaagaagaagaaagacaggtctctagccttgtgaattacatagtgctggtcagaaaatactgtatcattttctgtctaaacagtgataatgatattgcaagaaacttgtgctgatgtgtcctcatccccatggtacataatgtaaaattacaggtgaataaataaatatttccttcttttctttcgggctattgtatcaatgcattctatgtaagtttttgttccagtaatacttatttgttaatctctttttcaaggttctatggccagtaccaggacctttagcagtattatgtatgtgttttacgtggcttatttttgagttctcgccgttttcatttgaagttctctgaccctgatgacagttaaaatattggtttccgctgtggcaacctcaggaagtcctagattggttctaaccgagaagacatgactattgcttacaaatatggagttaaggaagaagtcaaaacttacaacagacatttgagaaagaatctgctgattcagtgtcatagcatttacctccatgacgaatcatgcactaccaaccttaaggaaatctttgatgtatatattttatcaccaaagagtcctacactactaaagtcaattgacctcttgatgaaggttcatccatctagaggagatttaatatcttttccctggaatcctgatttcccagtgacaaacacacaaagtgacatggattcttcttaactcttaatgaactaactgatcttttcatttctttattaaaatgcatattgaatgcctgtgtgatttttgcttcatatcttagtcataaacaaatatttcaacactatattttactttgttcttgtaggcttgtaatcccagctatttgcaaggttgataaagaaggatcatgaattcaatggttgtcttgtgttacagtatgaattctaggctagccttaatgactttctcaggtcctatgtggtgaggtgggataggaagagggggcagagaaggatagaatatattcctaggtactgcatttgattaacaggcagggataccccatgtgatctcagtaatgcagaaacattaatgatgatattgtactgtcagaaagttgttgtggtttacagctacatgtctttattctcactccctccatctgcacaaaggacataagaataggagtgtttcctcaaagtttagtaaataatgcacaaagccacatagtctgacccacagcaagatggatataaaaggtactgtattatggtccatttttaaaactcggtggaaggaaaaaataattccagcttcctcacttagtaagtctgaagaatagcagaaatatttactatcttccaaaacagacaacactaactacagcattttttgagcagaggacaagaagttctcttcacaactcaatcgtctcttctttctatacacaatggtcttgtgtgaaggcaagaatgaactaagactcttttcacattccttcctatgatattcctaggtggaatgagctgcattatgctaatgcaatcccgagcaattatgtataatcagaatgaactgtgtaatcctaatgctcttccaggcacttatggactaggagaaagaaaggatccacctcattaggttaactattctgattcacatagtctttttattccaaaagagatcaattgtacacaattttataaagtttctataagcattttatagagccaagaagtgaaaatccgatggctgctgatcttgagcacagtaagggacaagctaggacctcttttcatctcctgtttcacaactactgtctgtgctgattagaaccaggtgatgtctttccatgtgttaagaactaaaggacagctgttcacttacttcttatcttcccatggcccatgatttctgatgaattgtgtatttctaaattcattccttcacacagggcagaaacatttatctaaagaaaaacaagcatctctgtgatagacacaaattaaaatgggaaatatgggtcagtaagatactccaactaagattctactgcccattagcaaactggatatttcattacagagctctctggagatttaagaggaaaaataatgtgggtgagccatagaaaaatattagagagaaaatggtataaaaaggagctttggggaggtggagagaccagagctgtggcaaggaaatgtgcattagacagtgaattatgtttcaattttaatcttcccacctacattccttatgctctctccatgtggctcatttttgctctgacttttaagtgaaaaaacttaaaattgtaaattagggaagatcttgttttgtgtcggagcatagttaactgaggaggcacagagcttaagactcactgattattctgatcatatgacaaatggacctttgagtaaatccaggggtgctgcacctgcgttttattcccataaaatgcctttgcaaccattcagaagcacatgataactacattctgggcatttcaggaacacagcagatgtgcttccgtcctggagcaaggaccccattctgtatcatagaggaaaattcaagacaaagcaaagagaaagcccaagaccttccagtagcgacacattaagtgaagagagtatagctacgtatcctctttcatttaggccgttgtgttaggcaatctaagtaaataactgtattgttcattttccttttatctttaatattattattctgttttggtgaggtgcccatgccacagcatgcatctagacgtgagatgacaacctgggaagattagtctcccccccctctcctatgagttcctggggtggaactcaggtcactgggtttttgcagcaaatacctcctaagccatctcatctgacacagttttttttatcatatttttattggttaaattattcatcaacatgatgtaaatgttaaagactgggaaatcaaatgcatataaaatctggaagcttacatatatgttaatatatggtgttctgggagttataactatgtggatatgtgtatttaaatgtagaggtagagaaaagtgtgtgagtctgagggtatgcttcttatcacacttggattctgagtgtaaatatgtaagtggggatatgagaatatttgaatgtataaataaatttggaattgtatgagtaggggagtgtacaagtttgcgtgcatgtgtatgtacgtgcatatgtatatatgatttgggattgctgtaatttctaaatggtataataaagtgataatgccttgtaaaatctaaagtggcatttaattctacttcatcatgatacactcttacagagaacacacaatttaaaagtttaaaaagtaaagcagtgctttaaggatatgaaaaggcagaccatgaatttgtaagaaagcaagaggggaatatgggaggtttggggggaataaacgaaaggagaaatgatgtaattaaattataattttaaaaaaagatataagacacattagctccttagaacttcagtgtacattcaagggcatgaaatatcaaagaagattcatacttacttagtcagatggaatgcctcctatagagttgagtcaatttcagaccttttgaatttctaaaatgacattttttttgcttaaattgggactgttttaaggaaaactatgtttggcattttagtttcagattgggaacttccgaatgaagctgattattttccttaatgtaaagcttttcttttgcccatatgaatgccccaaattctaatcagaggttacactgtccagacagttcccacaatataatgttcatttctgtcaacaattctcatgcagactgctcttcaaaggacaacaatgaattaagtcaataaaactttgactaatttatggctacaagtaaaatctttataaatttatatgtatgcatatttctataattagaacttgtgaaatccatacagattccagtaaagcttgcttattatgtgtctgtatttgttacatttctgttgttggggcaaaagcaaaaatagcaacaacagcaacaacaaacacttgaccaaaagcaacccagaagaagggtttctctcggtttcttgttccagatggataagagtccatcatgggggagaagcatggcagtgtgtatcaggcctagcagcaggaaggagaagctgagagccacatctcaaccatgagaacaaagcagagagagcaaacaaaaagtgacagggagcttttaatctcaaagcctgtcctccagtgatgtacttcctccaacaaggctacacctgcacctcccaaaacagggctaccaactagaaacagagtgttcaaatgaatgagactgaggtagcatctctctttcaagccatgatatcatcctgacttgtacaatacattattgatatttctttcaaaagcttgatagcaggcaaccataactactttgaggtcaagactcctccatgccagtgatagcatttcacagccttccctcctatctccttgttcttacttcttttcaaaccctcttgatgatgacctatgagccctagaagggatgacgtgagtatactgttgtgattcattatcacttactctcagcatgtagagcagacacgtctttacatttattgcaaacagacttcttccatgagttttaaaaaaacaaaaacaaaaacaaaggaacaaaaagacatgaatgtgggaaagaaactagtggggagatgttaaactagtattagaggtaggagagacattagagaagaagggcactattggagtcagattgtactttacacaaataagaaaatttccaagatgaaactcaataaaagttataaaaattgatagcctttgttttgagaaggaaacatatagaagcagacctaaaattttatatagaatacccaaggaataaacaatcttctcaaaacagctcaagtatgagtatacagaggtccaagacctctgaatattctctctagccatctttaaaactccttcacacaagcagaaactgaggccaaaatatcaatgaagtcatagatgccagaagagaaataatagagcatactgagctatgtagcaagttgaaagcccacaagccatctactttcattgagtcaattgaaaacagataagaaagaaagccagggcttttcatttcctgtcaaaaggaatttaaaatattcattgtctttaattttaaatagtgacaaaattatttaaattattaacaaaatgttggactagccagaaaaaacctaatagttgttcacttttgattatacattgagatttttgtctctctgtcaaacatatttcatatgttttctgatggtgtcataaataccacaaatattccttaagtgtggcccatccaaaacccttgcccaagctctctaaaatgcacacaggtgagagtaagaatgtttgacagctctgaattaaataagcactcttaaaataaaatacagatgaaaaatgtttctggagaaagcacttaatagtagggaaaaaaaagaagagcaaaacaataaaaacactgctttgagttctctgaaacttacttcaattctactatgttaactagcctggcctggcatgcagtgtgctcggcttcctgtggagtccatgactgttttctgtatagttgctctaaagtctgttattagtatttgaggagtgatgttagggatgcttatactgcactagggaacaccaggatactgtcaaaggagaggaagaagaaaagcaggtgtcatgtagaagctactgcaattgggaagacttccatatagaagtcaatccagatacagagatgactgacagctaaggaaaagaggaggggtacagtgggtgggaaaagcagaaaagagataagttaagagagtaaagagatatgcagagattgtctaaagtgatttgacaggatcattggtgagggcaatcaggggcaagctgatgatcacttgggagataggcagccaacaaattcaatcatgtattaacccaggaaaggtgaacataaaaacttaaagtttgaaatctaattaaaatgagaaccagaagtgcttgaacacagctttgtctaaaagagagtgaaatttgatggcaaggcagagaatttaatttggtgcctcttcaaatctcccattactatgatggctgtgccgttcaggggaggttgccttccagctagagtcttcacagtgttagtggtctgtccacacacagcttaccctatgtgtgaaagcatccagtgtgttcaaaaagaacagcatgtttaaatactattctattcgttcccttgacatagtttagggacattatttaaaatttctatagtcttctctcactagtaggtacctatcacaaaagacatgtaacagaatcactaacagaagaatgacatcctcaattatttaatataagttttcagcatagaggtgctcttatgaggaaatgaacacttaaatacttaagggagcttgtacatccttaggccagtctgcaaagagtggacagtgttaggcatagataaacagaaatgagcagggggccttgacaagttctatttgttctgagcttattgtttctgtgtgttcaagaaatgaggccacttctttgctcaagatacagggaagacacttagagaatgaaaactctggtacctgctctggggaaggtcgcctaggctttatattctcttccaaaggagacaagatgagggaaaggtgacagtgacctcaattctaatgtgttctcaaatgccatattctagggtcctgtatcccaatgtccactgacatttgcaattaaaataatcaccttcaattgtgccttctttatacccaatgtgtatatatgtgttcatgtacatgtagcttatgggaataaatggacacttattctggcatgtatgattggactttgcagcctaccattgtcagtgttgctagaccttgtcttacatatttcatatctctccctctctctctctctctctctctctctctctctctctgtgtgtgtgtgtgtgtgtgtgtgcgtctatttccttctccttagaaaatgaacaatcagagagaacataaagcagacaacacaaaataaaacactgatttctttgtagtatacacatggtgtcaaacatagaagtatacaatagtaaaaggtctccctaaaattaaatggattgtaggaggcacataaagtaagaacaaggcaaaggaaattcttcacccagggaatttagaacctagtgggaaattagtattggaaatgtaaatgaggttagggaaattaagaggattagctggcttacaggggtttaaataaaaataaagagaagatcacgaaaagcctttgagatttgctctctctcaacagaattaaagtagttttgttcgtgtgtgtgtgtgtgtgtgtgtgtgtgtgtgtgtgtgtgttctgttgtcgctttcaatttgaaagtatttgtctagaaattctgaaatgctctcagagttgttttattactaaagctctatttgccacctaaagccagaggctgacagttgaagaagttagcttgcatggttattcttttgtgacttgtatggctattgattgtgatgggctcgaatccaatttctactttttggatttttcagatagagatgacattttaagtaataatttttatgtatctctcaacctgttttggcaataccttgtaggggagtggcatggggaggttaaacaataattgagtgttgagagttgggtatattgaacaaaaattgcaagttattaatgagaaagaaacaaagtatgaacaaaaccctaggtgtatttcagtatattctttgagactgaatccatccaccattaagtgtctcacatagctgaagaactaaactgggtagagtagatgcagtacaaaagtaaatgccgtaggggctgaagtaatggtttacatggtaaagtatgtctgttccatacttttattctaaacaaaaatggggtatggatgctaagatttccagtcctgagagaaaccttagcctaccagtaaggtaccaggacactcagcactgtggtttcaaaataaaaatgtagggggaatcccagaatccccaaaacaatgcagtgtctttcacctacatttggttgccatctggaattagatgggaagacctgattgctgagatcccacatgctttgatcacagggtatgacaagtctagctggtactgagctggcagcatcctctctcctggctagtttacatggttctcagcaggttctttgaaggctgctggtagagaaaaatcaccaactgtattacccatatgagaaccttgccaaatacaatagtgactggtctggcataatatgtccaatggaacaagaatgcaatgaatatcaggggagtaagcaatagctttctaattgtacttaggtcctgttttgtaggggagaattcaagcctggtattgtgaacctgacaggtcataggcttccctaccattatttcattaaagtgacatagtatcaaactaccttcaaaatatttatcctttatatccatagatcatagagctctcatccctcaagagaaaattttatgtagttgatggcagttaattaatagacttaagctatcaaagaacagataatattgaactggagttggtagccctgactaggacatctatttcctatctcatctacctaaggttcaggaaacattgtgaacaagatggcagaaagatggtaagaactagaggtcagggaagatacttcaaaataatgtcttcaggacatggtaaggccaagggactcacaagggactcacaaaatctgaggcttccagtacaagacctatttaaaattaagccagccagcacttcagatgagaagctattggaagctgttagttgcttcaggaggaaattttcattttcttcaacagtgtagtccattgtagatttcacatgctccacctaaaggtaccttatacctttaggaatatgagcaatattagttaaagtaaatcagttgcaaaatgaaagaaagaaagaaagaaagaaagaaagaaagaaagaaagaaagaaagaaagaaagaaagaaagaaagaaagaaagagagaaagagagagagagagaaaggtgatctagagaagggaatgatggtaatagaattgtagggtgaatattatctaagttcattttcttcatgaatgaaataactgaagggaaaattattcaagaatgagatattttgtgcagcttcaaaagaatatcattggagattaccttctgtcttccatacatacttctttaaatgtgcacatacttacacaccaaacatgcacttgcacactcatgagtatgtatccccacatacatgtactccataaacacgaattcacacatctgcacagacatacaacattaggccttgtgaattcaagtgcaattaaatattaagatattcaattttttctattgactctgtcttttcttcttatatgttttctttctttacaatttcaaatgttatccccttttttagttttccctctgaaaatcctctatcacgcccccacccctgctccccaacccatccactgttgcttcctggccctggaattcccctacatgggtacatagaactttcacaggaccaagggctactcctctcatgagccatcctctgtcatatatgcagctaaagccatgggtcccaccatgtgttttctttgattggtggtttagtctttacaaaacaagcccatggaagcagaagtaaaatccagcaatgtaattgaattttatatctttatttatttatagcatcactcttttattaagctagatttttctttttcataaacatggacttaaaaattattaacaagtcactttttttcatgttcaaggaagctctcatgatgttagtcagcagattcacaaatattgtctgtccacaagacttcacaagaggttctaataccttctttcaaccttttacctctaatattagtaatttatctttaatgtggtctgttggtgattttgatgtgagcaatatgacacagatgacctaagagtatcacacacaggcttctcagagccttgccgaaattccaggtattgcctttaagtaaagttcctccaggtttgtttgggaccaacaaagctgaaatactggcctggttcttctgagactcagaggactttgaccatgtagaattcctagtgctaatatgaggccactcgtgtgctgagacaaagctgtcaccaaggtgcatgtctggaagcttaatggcagaggtaaatgctatgagacaaggagttatatcttcagctcttccactgtccttttcctttctgtaagcctatgctcctctgtattctaacaaatgcctaaataatatctcttctttactgatctttttctggcgccacattatgtctctgctccgtgctcagatttctctgagactctggttaatatagctagtcatctcatcttcaggcggtgccttctttcttctatctgcgtttgagtttttcagaaccaatttcactgtaactgacctctgaagtgaccccaagattcttttttttccattcaattttctctatgatgaacctaagtaagtatgacaagcaaggtaggtcttatgctgcaacaccctctatccctgggttgacgagatactcttaagactgaagctttgattaggggcagaggacagcaaatatatgaaaaataaatccatctgtgctgagcagtatgttaggggcacttcacattatcaaataaatatgttatttccagtgccaattgtaggcgatgggcttcataaaatgacagtatttctggaaaataatgttttacctgtgagtgatgactgaatgagtaaatgttaatagtttattttgaagagccaaatataattaatttgataaattctcagctaaaatggacaaaaactgcattaagcataactaatttatcttgaattgaagctgttaaataatagttctgtgcatttttatgtctactgttacccaaatattacatggttaatgacatctgtaatacctactgacagaaaagcactagatttcttttgcacttttatgtatgttctgtgaagaggaattgggctgtttagaccttaaggaactgtcttgggagaatatcagaaattgtctaacagattccatgataagtagccaatatggcaaatttagtgacaacttttattatattctgttagaacaattgtcaagaaaagtacccatacttaatttcaattaaatgcttctctcttagaacttatggggaactgtctatttgtagcaacatatttacgtcaattgtggatcatccgtacagccagatgggcgtgaattgcatggtgctgggtggacagccccgctgatattactgctttacagcatacttctgggtgcttcttcttcttcttgacagttcaggtgttaaggacctcgactaagcacacaattgatttgtgctcctccctgaaagggtctagaatcaatctgcagtagaaaacttcagcttcagtaggagaacttgcagattttgagaggtgcagacaactgcagatccccctaaagttatcactgtgaatttcaaatggcttttttttttattgcagagcctccttgaatcccttctcaataaagaatttgacaacccacctaaccattttgtacaaaaaggcatttccttttctgcaattagatttttctcttcaactgtttcttacaaggtagtgttctattagcagatattgttcacacaaagcaataggtttcattatgatatttttcgtatatgtacaaaccacactgatcatatttagtgcaatgaattttatcctctttgtcactgttactcctctggatgatttgcctactccttgtctcaaaaatgttaaacttctacttttgaatcatatttcaaacatctatattccttcatagaagaactagcccctctgagtttagcttactttatttaatatgacaatctctaccaccaccaattctcctaaccatagtataagagtgttctttatggctcactaatactgtatcattttatatatgctacggtttcttaacaaaaatgatgctgaatgtttcggcaaactccagtacttagaattaacagcaccacaatggacatgaatgtttagattgcctggctttgagtcctttaattatatgtcaggagttatcactggataatatggtagttcctctacctttgaagctttgataagctttatactggtttctactgtaactataatttattataggcaacactataatggcagtaaaagtgagtactgttacccgtgcctaaagatggtatgcagtacacttccatagccagagcagtgtgctctgactacaggagagcaaatgtgtactgctgttagtagatcctggcttcctggggagcttgctctccacattgaagtccatactataaaccaattgatatttgaatcctaacttgtcatgaaattaacttttcctcccatgcttactgtaactagtgaccacccagtagaccattcttgagttcacaaagattcccactgatttaatatttatttactcccttcaaagtgctgatgtggggtcaaccgaggtgtatatgcatgctaggcttaagttctgtttctgagctatatccccagtatgactcatgtacataaagatggctctctactactctcaatttgggcaagctgtgtggtatataaaacacatgttagatacacaatatgttaggtgaatacatttctgaagctatttatccgctggggcacttgcagtacagaaatgaagtgacacagtctcagtttgtgaggctgcagaccaaagggaggcatattggctgttttatcaaaccctctaggtgatagcttttgtagtaactgtgggcaattgctttcccatctttttaaccctgtgcaaacagctactaatcatctataataatcagtcctggtagagagtctttctgccttaaagaaactcagggagaataatgaaatgatttatctaaaaagatgcttggtatgagcaatatcttgggaaaagttctggtatagtaaattatatccatgcttcttaggttttctctagcaggcccaatttaagtgatgtaagaaaaagagaaaaggaacaaagaggcacaaggtgttcaaagctagaaaagattttagtaataaaaaagcactttatgctggtttgaacctagtaagtggtttcaaatttaaaaggaggtttacagtgtataaaaatatataactctgtgtgtgtgtgtgtgtgtgtgtgtgtgtgtgtcatgaacagctccataaaggtatataatgtggacaaatatacttcattctcttatactctgatacttaactttttatacatattcgcatgcctaatttatggaaggaatttatcttgtaattatatgtggccctagaaaacaaaggctgctgttttaagggcttcctcgagggacggatgattcagctattcaatccatgtcatctctgtgtttgtggtagtgtttgatggcaagaaaggagttatgattgtcactttaacatgttccatgacttttgctcaggagatttatacaatgtcagggaatcctcccctccctgtatttctgcctatgcctttgctatgctgaaagaaagctggtcccgcagggtatcattgattgttatgatacaggcctgagcatgatcaaacatcacagttcaggaggcttgtcgctttcttttgaagctgcttggagtgaatggctctcttattttctcccttagtttcaatattttaactgaggtctcctgagaaataacacatcatgcacaggtcaccatgtaaacatagtgaattgaaaaatatagagaaagtggaccccactgtttgcttcacaactctgccctttttactgatgctttttgtattttgaattgatactcaacattaatttaaaaaattaattatgcatatattacaatcattatattgcaactttaaagaattatggatatgtaactataaaatcttcataacaggttgcagtttgatggtgctgcttatattcaactttctttcccttgtagttccaactcgaatcagtctacaaactcccacctctcctcacagtcctgttaaacttagcccttcttggtacatattgcatccttctttctcagcttatctggggatatttgatcacccccatacatacaaatattgtttattcatttgcaattttcttctgcaaacatagcctgagtgcttacaaggtaccatgttattctgaattacaatgggacttccagtgattttctgattcattttttaatcatcttaaactcagagaccagttctgtcttgtcttctgagtcacaggtactgtcaatgtcctagaaacagtagatatcaaagtattagtttaccatgatttactagtggatgctatgggatagtcttcccatctgtttataggggtaaatgagacaatgctctttgtgtttctggaaggacatctggtttacatcattaacaaatacagtttcattcaaaattaccttctgttttgtttttcaattagaaacattgtcatcatggaaccatagaaagggagctaaaactataacctacataaattaaagccctaaagtcataggacttaactcagcagtggttgaacaagatgttgtgcttaattgttttattagttagcccaatgtttgaaaaggcatagaaactacaggagcatgaaaattgcttactatggctatggagattgtgagcttatgttcagctggaatgagggatgacccaactaactctctggttttcaaaaattgcaaattttgttggtttgtctactaaactgtggtttgactgattgccttggtaacatcggatttagatctactaaactatagatctaataaatgagctcttttattcattttcaaaagttatttcctagttataaacacacaaacacacacacaccaagaacataataatgataatcataaaaattgggagactgtggatttgagagtgaggagaacatgggaagagtcagaagaagaacatgcaggggaaagtgacataattctatttcaattaggaacaattttattttaaacatgagaaatgagaggataaaagttcatcatgaaaatatttattagctatgttctataagcatatatgcacacatatgtacaaatgtacacacatgtatattgtatatagttctatagtactgaatctaataatttaattcatatttgcatatgtagagactctttttcatgctataaaatacattaatttatacaaaaataatacctaggtaccattcaaatgtgtatggacatatggaaaaagaaaaatcaaagtagagagaattttacacctctgtgtatattttaaaaatgtctcccctagttaccaagccatatattggatgttgaaagagctggtccatcaaggcatatttaaattgactaaatgacagagtgatatttgaaattggtcttgttgtatggtaacctctgtttgtctctctctttgtctctctgtctctctctttgtgtctctctcactgtctgtctgtctctgtctgtctgtctctgtctgtctgtctctgtctctctgtctctctgtctctctctgtctctctctgtctctctctgtctctctctgtctctctctgtctctctctgtctctctctgtctctctctgtctctctctgtctctctctctctctctctctctctctttctctcttctgctccctcctggccctcaatgtggattctttttcttctttgacagttctatccaatgtgttttgatcatattcatcgtggccccattgaacactctttccagttcaaactccactactatcccatcaaatattgccccttttccactccgcataggccaatttatattgcctaaatatttttgtatatgtgtagaagaattttaatctagaaacatagctgttctggcaagggatcacacccaaagaccttctagagctatatgatccaaccagcatacagacatgcccttagcatctgacaaaatgagtcagcaaaaggatgctctcaactctcaggagaacagacaagagaaatattacttaagagtagtacagggagagaggtggagttgagttcatttgagttcaatgcagttctgttgaatgccgtctagttgagttcacacagttctgtttagatttagagttcagataagtagagcaattcagtcacaagctgaaagaagtcgcttgaatcaatcagcttggagaggagtttgaaccagaacagccaactttagccagccagccagcatttagagagagctaaaaagactgaggttatgtagcagtacgtctctgaggctgaaactttctaggcctaggttagcagacagaggctggaacctgaaaccttcaaggtcaaggcttatggactattggattgtatggctactaagagcttccaggtgtaggtctagggaaaattagatagagatgctctaggctcagctcaagccatgtatttgtaaaacttggatatggctcttatctcataagaaataaagagagacatttatagatatgtggtctaacattagagtgttaacaacttggttaagttaggggctacattctcagagaaattgttctctttttcatccagcagcagggcttgtgtgcacaacttctttctctatggttgatttggtctggcttgtgcgtgatggggctttgtacatattggctcaactactgtgatttcacatgtgtagctggcttgatgtgtccaggttacatatctatatgtcacttatagaattaatgctctttctaccccttcctgtacaatattccttgagcgtggagaaggtgtacagtgcatgtctactctttagggatgaatattctggagccttttatgctctatactttgtccagttgtaggtcacaaagttactcaccatgtattgcaaataaaagagtctcagatgaaagttaagaggtatatttgctatggtatagtgataaatcttaggaatcaagttaacactgtgttcatttaacaacttagtagcaataggttctcccttcaagtttatgacctctttagccttacattcttaccctaatagcgacaggatgaatttcatgtccgattagatatttattggttactcctttcatgtttatgccactacaaagattgcatagcatggaatcaggagcatggaatcgtccctctcatacatgcttgatattgctgtgatggatgactcaaggatgtgttgttttagggtctgaccaacaacatttgaagtgtaaacaggagttttggcaatagcctgttgtttgggaggatttggggacatcgctggtcaccaatttcaaaagaattagctcattcttgtcactgggctttttaagacttagcctctgatatcaagtagggaattatcacatgttatagtgctattcaactttaatcctttggatgtattatgcatgtatggaagcatacactgtagtaggttttcattctgtcctttacaggaagttttgtgcatttgtctcaaaagctaaatttttgtctttgaaagggaaagactaacactatggaggataacattaagaagaaagagatcacaagtaaaatagataaatgcagagaaagaagtgatgttgctagagggcaagtagaaactttggctgtagaaagagaacaaaaataattagagagcccttacttcactggtaagacaagactagacgtaaagttctttccagaagttctctctgaaagaaaacttttcagagcttgacacttgtcaatgtttgtaggagaaaaataatcagtttatacttgctggagttaattaccacattacttggaaaatatttaaatatttatatttgaatgacagaatataaactactaaaaatatgatcacaatcactttgttacaaatcttggtgattctaattaactatgactgatttatttttaaatatgaatttcaaaaaccaatagcactatttctattttttcctagatcttgatgcaagcttaacaccactgaacagggacatcccttctctcacaaagcttatcttccagacattggttcttatctttaatttaaatatttcaagactgctattttagtttgatagtgaatactttaacttctatccactgtgaacaaagaatatcatgccacgttattgcataacagggtaagaccagtgaaagttaatttgatactgttacaaccagcataattggacagatgatgtagagctcagtgggagggtattataagaacaaatatgaaaactgtatagtccatgacagtacgctggttaagttatcaacatttccattaaacacacttgtcttggaagactgaaatagtgtaaatattacttaaactcttcctataatttgtccaatatttttgaaaatatgtatcttaaaataaatttaaaataagaaatttatatttattcatgaagaattatggtcagtgacaccatgtattataaaatcttaacaataaatcattgtgataatttaattcttcttgctaaacaatctttgcttgctgaccttattagctgtcagtataataagacatacgagtgcattatttcataaccttctgactgctaagttttgaattgttttttaattagcattttaattgctcatcagtgtaattgaagacagagccagaaaaaggagtcttcactaatcccttcggaacctatcaatactatactttcccaaggtcaagtgcctcctgaagcattagcaggagcttattgttttcaggcctcccagcaaccacatggtggctcacaaccatctgtaacaagatctgactccctcttctggagtgtctgaagacagctacagtgtatttacatataataaataaataaatctttaaaaaaaaaaaaagatgctgcaatttaaaaaaaaaaaatgactaagtagcatgcctgggaagggggatattggccttcacttttattctttcaacctgttgtttattgttgataaacaaaaacaaaacaagcaaacaaacacagtagttgatgtttatacaatgaaaagtagggtggtcatgatgagttttccatttctagtaatcaatgcgaagttaaatctagcacctaatatgttagccatgcaatctactgggtggacattgaactacatttattaaaagaggcttagacatgaatcacaccatcatttacacagtttttactgagtggcatccatctcaccagcacaagagtgacagaagcaacatgaatgttttaattgtcaaaagaaaatcaataagcctgtttcaaagcttaaataagaagccatttctatctcattaaaaatagtgtataagcagtttgaggctgtaactaccaaatgaattttatgacaaagatcatacattgcaagggctacacatagctactggggtgtaaagcattctggttatcactcattcactttaggactgccagttttctcactgaaatactcagataaaaggttgtctctttaaatatcccaaacattaaatgaactaattcttttgacgttcttaaaactatccttttaatagtttttacagtttaacaaaatactttattttgtttctatattaagaaatagaaaattatttcagcttgaagtccacaatattagatcaaggttcatgacaaaaaattttttcttaaatgtaaacacatttttttttttacctctggagttccaagacacttcaaatagattctaaaatatatttcattagatcattagattagtaatgagaatcaaaacttaacatttacattttcaagtcacacagttgttttgcaaagtaacagtggcaaaattacagttatgaagtagccacagaaaataattgtatggttgggggtcatcacagcatgaagaaatgtattaaagggttgcatgaggaagactgagcaccactggtctagtgtcactaatgacaggttgcacacacaaactaaatcgttttgatctttgaccgaaagaaaatttgcacagttctatctgccactctttgcctaggtgtttattcatcactaatgacctggtgtaggttttcttcccacagtgcagcaggagctgcatcccagtaactgaatagagaaggagcgcgtggaaagtcacagcccaggggatatatttgtccagtcagctcaaagttctacagaagagatcattgctcacgctgcatctaacacaagtaatatgagcacaggggtaagtttcctcagaagagctcaatttctttaagaataaaaacttcatcaagactgtgacgaagcactatcacccaatctctctctcaatagctccttctacatacctttgcttagctacgtctgtgtatatctaaaaggttaatggttatcagcacaggcatgaatatgttataaaattctaagtttatgaaatttaaaataaagaactattactataaatactgaggaaagcatgcctgtagagagttaagataacaggaggtgactattgattcaagtcagcatggattatctagacatatgctgtgtacagagcattataccagcaccatggagacataaaaaatgaagtatttgattttatttcagaattttcaatagaaagtattggtacaataaaagcccttatgaaggagcacataaaacttttgattcaaagattctgtttgttatatggttatgactcataattcattatgtacacaggaaaaagaccttggtcaaagagaaaagtagagagtagacagttttgggaaagaatctttatgcctgacatgactcattcaaaacaatttttttcagaaagaaaggaattaaaagaattgaccctggcagatattgtgtgggaggtttttttctgccttttaaccacagtaataccattctatctcaaaggagttggtgtgggtggtgtgcatcatataataacaatatatggtagagtggctataggatgcatttgagaatgagggaatatatacacatatatatatgtggaaaacatgtttttaacatttgcatctgtcaatgactaaccatcctattctcatattctcttagaatttgatttagtcattctatttagcctcagcaatattgcagtagtttgagtaaattttttattttcttttccttttgtgtgtactcaggactacagatagaattctgacttctctagaacaagtcagaaaaacttgaagaagaaccttctttatttcttctagatattcttttcgtaaatagaagttagagaatccaaacaaaatgttcttaatcatataaacattctcacacacagtgaaacatacagacactgacaaacacccattagggtagaaaactaaatttacctagtcatcatagttttcttccctattgtgtctgagagcaacatgcattaaataaagaatacaacagggatttaattataaattgaaatgagtgctatgaaggcgaagatcagatagctctgcaaaccagactagtttgttaagtctcagaaaaaaaaaaacaaacaaataaacaaaaaaacctcattgaaacatggagatgtgcataggatttaatcattcaataaggaaagaatgctccttattggaacaggaagcaactccaatggagaatttgagacgttctttgaactttagttgtttccaaagacccaagtgattaggagcctgcaggaagaaaagagtgcactgaaatgacctttgacaaataggtgagtaaaccacattcctgtttctttgacaacatagcattttatgggttactcaaagcagaaatttgttccacatttctggaggttaaagatgaaattatgacattactaactgtgcttcatgaacaattcccagcctctgttcctctttcctccttctctcctgccagtggttattgatgaaatactgatacctggatttgcagatccaatacctcataatattctgctctcccccaaatataatatttgttttcaaatggtctttactgtctatctgtatctatgacttttctccagtaattacaaggatactaagtatagtagattaatcccttcgttgatcctacctcactttaattttcatcttaagtactttnnnnnnnnnnnnnnnnnnnnttatgacattactaactgtgcttctgaagacccacaatgtgagggctcccccacgttctgactcaggagaggtgacaccccaaaatcacccacaagaaaacgggtcttgctgcaaattgcaagaggatttttattcaagagcgctctcgggcccatggtcatacaccacgcaggggtagaggacccatggcgccccgagtagctgggtaagggggtatttaaaggaagaaactgaaactcaaggaagtggggagggcgttgttggaagataccaaagataccagttaagagtcacaaggaagtgtaaagttacaagagtcacaaggaatacctgataattgttaactctcaagacagcttctaagagcctctaacaatagcacatttgcattgcaggttctggtaatggtcagggtgactttctttgaatgagcactctttgaacccaggaagcgggtgcgtagaggaatatcgctatctcttttatgattagcatacctttacaaaggccacattcccaagcctgggcctaaaggcctagaattctgtttttacgttgttatactttcacttcatgaacaattcccagcctctgttcctctctcctccttctctcctgccagtggttattgatgaaatactgatacctggatttgcagatccaatacctcataatattctgctctcccccaaatataatatttgttttcaaatggtctttactgtctatctgtatctatgacttttctccagtaattacaaggatactaagtatagtagattaatcccttcgttgatcctacctcactttaattttcatcttaagtactttttgaaataacctatgtatagatatatgtgatatctatctctatccctctatcactatctctatcatatacatatacatatacatacacatatacatacacatacacatacacatatacatatacatatacatatacatatacatatacatacacacacacacataaatatatatatatatatatatatatatatatatatatatatatatatatataaaatgttcatctagggggactctgatctccttccctagaaaacataacaaattgaatatacaagaaagccaaaaaaaaaaaaaaaaccaagccaaagagaaagtgagagaaatagctttataactttggagtgtgaggggttctaaggctggagttccaccagtgagactcttgaaagaatatgttattaggatgctaagtccatttgttttacctatttgtcctgtttagttaaccacctgggactttccaccatttctccttggaatggtttctaggatcactgcctgccacctaagcaggtggcttccacatttccaaatacccaatttaccactaattcttccttaaagcaaccttccttatctcttctgactagttttagtttgaagtctatttttttttcaggtacgagaatgaataactttggtcatccttttacaccaaggtgatgtttgttgttgatactgagggtttgtttgtttgtttgtttgtttgttttctcccacttcttttattctgtggttttgtttctgtttttgtttgagacagaaaaaaaaaagggttttgttttctaagcctgtaaactagccagtgtgtctttgttatagaatggaggatatggatattagaagtcattatcaaacagtatgtattaattcctgtcatactgttttgtggttacaaatttagacttcttctggatctttttatggattcccagttctaccttggatgtatttatttttcttttcagatccaagtgttgcttccagtatcttttgcagagccagattaatgataatacgttcttttaactgttatcatgaaacaattttatttttacttttacttttaatagataggtatgtgcactataactctggaatgacagttgtggtttttcagtactgagagtccattctctcacatccccctggcttttaattttactgtcaaataacaaggtattattcaaattaggctgcttttataagtgacttgagtgtagtggcttgtattacaaatgctaattatgttcccaaaaacctgtttgcataagagtgtctgcaagtagcttctgggaacctaacccccattggttctgattggtaaataaagatgccaatagctaatagttgggatgtacaggcagacacaggattttaggattcttgggttcaggagccagaacaggaagaaggagatccaccatgctgggagggtgtgaacctgaggagagatgccttgcccatagttcaggacagaagcatagcctccaagtgagggagtcaggagagtgcagcccaactgagtcaagggcagccaagatagaacagaagtagtagataataactcaggattaaccatatgtaggttaggcagtggcccagctattgtgctgtttaaagtatattaaaatataaagtgtgtgtgtgtgtgtgtgtgtgtgtgtgtgtgtgtgtgtgtgtgtgtgtgtgtgtctttccttaggtaacataaaccattgaggttggtagcgaacctgccacaattattaataaagtaatttattcaacatttaagttttctctcttacagttttcattactttttctttattcttctttaatgttttaagtctaacacataatggatatgttttgtttttttcttttctcttttttccctcttctctttagtttcttgtcaacctcttgtacatgggtggccaactctttcttctaggtttgttttgttctatgtttttactgaaagtggtcttcatgacttctctatgatattctccttctgtgttcatattccaatggttatatttctctgagatctctcccacactctgttcatgtattttaaaaaaaacttattactgactgtcactgagtgatatgatttccttgccttgtctttcattcttgatactctattgtctttcattcttcatactctatgatgcattccttcgagttttgtgtttagtttaagggtgtcatttccaatatccttttgaattggcttttcctcagcaattttatctcttagttgcattcgattataatattatcttctttcatttttccctttgagtttgttttcctggagtatactcagctgttctctgagtgctttgaacatacttaaataattattttgaacatttttatctggactctcttccagatcatttgtattaaatgtcactattatgggattagtcatttgtgtaggaaacatcttatcttggttgttttatggttttgcttgtttctggtttctttcttgttttatgggttgcttgaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctccctccctcccttcctttcttccttccttccctgacccagcctgctcagtcagtcaacaggttctccagcacaggagtgaggattaaaaagaaaaaagacagacaacattgtagcgcgaccccagtcaattctgagactgaaggcaaatttttattttccaacccactttttataccattttaattacatgcaagtattttgggcaagcagtacaataagaactactaacaaagcagttgttaaaaagggcttgtcattatgaccgaaatactggagcccacttcctcatccaagcccaaaaatcttgactaagtcctagttccaccctaagaataaaattcctgccttaccctacttccctattacagcgtaaagttagattctcgcccttatcttgctctaatgtcagattcctgcctgagcttacttccttgtccttggccaatgtcagactcctgccaagcagtaccccaaaaggctttccacacttccttctttcttttcttttctttctttctttctttctttctttctttctttctttctttctttctttctttctttctcttgttttgttcctagttgctttccttctttcggtggagatgtttacaatgttcagaagaggaatgaatcttagtaaggttgaggcatttgttttctctaagtgctggtagaggacattcagaggttagcctaagcaagacagacagagggcttctacttgcttcagaagggcttgtggaacagattgctagagcagcattcctgggggtaggctagactggtgtagaggattgttctcagtttctggagtgtaatccctgtgcattataggtgggcttaagcaagagaagtagggtggaggaggtcttgttgtttggactactggaacaagaactctatgggcaacataggcaatcctaagccagggaaaccagggtctgctacttgttgcagaaggttacgtgtgctggaatccaggagaagaaagcccctgatctgtatatattcctggtggaggaggccatagacagtacctgcagcatttgttccttggtaatataggttaacctaggcattaaaactcatgtttccacacatgatatggaaaatgtctctgctgtttaattctctaggttaagtttctaaaaattttgtgatttattttatgctaaaatcttagtagaataaattatatatattataaattacatataaaattatatgtgtgtgtgtgtgtgtattcagtttacttttaaccattagtctatggataagactaagctttaataaattataataatgataaaaatggctcatttctattatgaaaaatattgaaactaatcttcaaatttagcataataaaaacccagagtgtaatctaattctgagaatgaatcattaagtaatattgaataagtcaggataactcactttgatcaaacatctaagcaatctatcatatgtaatatctccacatatattctattaatgatttgaatgctaaaattattctatgtagagctctttataatatctgacacttctttttacttgactgtcattcctcatttctgtttcctgttttaggcatatatagcaaatattatagcttacttgttacaaaatttgtagagtgtatggaaagagtatttgtgtttattgctgtatcttagtactgacagacattagtgcctgacaaaatcatttagtagtgatgtctcaattaataaacaatgatgtgtagtgataatatcatcctcttcatctgagcaacaacatgcaagttaaaaaaggagactttcccagcttcatggcttcttagctgttcttttgcattcaatcaaaggctttggcttaggtagaagtgaaaatcaaggcttcacagccttaaattggataaaaaccacatacactagcccaaggaggttaaaaaaaacccaaacaaacaaaaagacagaaaaccaggctgttagttacaggtaagtgggaatacaggctctaagagcatcctgacccagatgttctttagccaccttggacattacctgaccttcctggatacagagatatttatgaataatggaatgaattgtgagagtactatttttattcttcttaatcagaaaccagtgaatttgtgtaaggtgaagtgaaagcctctcttgactctgaattctgtgatcactttgcatgcaaatgaataactctctgtctcctttctttgaatatataacaatcccactccaaacattcttgattttttaattgaaaaaaagtcacatagcatattttgatcacacctgaacttctcctagatcctccccacctcctgacccacacaactgtatgtctttcttttttttttcttttctctcctttaatttctctctttcattcaaaaacaaacaacaaaaccaggaaacacaaaacacccataacatcacaaaaatgaaaaccaaaacaagcaagcaaacgtccaataggacaaagcattctgtaggctgccaatttgccagaattatgtaattccctgtcctacagaagtgtccaagcctcctgaggtcccatttactaattactggtctgtgcttgtgctattggtatcctgttcagaaaggctttctgtgccagagtttaagcttattctgtactttctcttctatcagattcatggtgtcaatttttatgttggagttgtgttttatgacaaattacagatgtggatatattttcattaaattatgtgtagtcgtccagtttactgttcactaacaccaaccaattttgaagttgctgaattccctccagtgatttttacttctttgtcaaaatcagattcttgcatggacttttgtctgggttttcagtttgatccaatgtttatgaacactgtttctgtttcatgcaaatatcatattatttttataatatataataatactgcaaaaaaatttaagtcttgtatggtgatacttccaggatttctttaacaattagtgactattttaggtactgtaggttttttgtgtgtttccagtgaagattgagttttcaatttctgtgaaaaattatgatgaaattttcataaatattgcactggtggaagtttcttttggtagggctattcctactgatccttgagcatgtgagacctttccatcttctggtgtctattttaatatttgtgtttagtgtcttaaggtttttctttaaaaactattttacttacttggttagtattttacatacttggttagagttgtccaaaactgcatttaggctattataaagagtgttgtttccctgatttctttcttattttgtttctcatatatttataggaggctatttatttttgagtgttatttttttatcctgctatttgctgaaagtgtttattaaatgtttaagtttcctggtgggggttttaaggattattttcatacagattgtatcatctgaaaccaaatgacttgccttctttcttttctctttgtatctacttgatcttcttcagcaatatccttcttgctctaagacttcaagttccatatggaatatgtatggaaaagtcctcttgtcatgttctaaatgttaattgacatgcttaaatctctttgttagtttgatgtttgttatgaattccattattatgtagaggtatttccctggtacctctattcgcttcagaagttttgaacataaagaaatgttgagtttaagatttgggggtttttgttctttgcttgcttgcttgtttttatttgtgtgtgtgtgtgtgtatgtgtgtgtgtgtgtgtgtgcgtgtgtgtgtgtgtgtgtgtgtgtgtgtgagagagagagagagagagagagagagagagagagagagagagagagagagagagcgagctttgtctgaattgtgtttgtatttgagtttgtttctgtggtggactgtgtttattagttttcatgtattgaaactttcctcctctaggatgaaggcaactcagtaatgagcaataaatttttgttattgttcttaaccttgagtttggtttgcatgtactttttgagaattatttcatcgacattgataggagaaattgatctatatattttgtttttggtctgtttttatgggttcagttatcagagtacttgtggtctcataacaataggcaacgtaccttgtgtctctgtttcacagaatagtttagagaatattggcaggaattattttttgaaattgtggtaaaattcaacattgattttatttggtcctctgtgttttgtgatgcagagggtgattttaattatttttaaatttatttttaggcttttaattgccacttctatttcaacaggacttgaagttttctttaaattgcttatctgattttgactttactatattagaagatagttatcaagatacgtgcgtgcacacacacacatacacatgcacatgnnnnnnnnnnnnnnnnnnnngagttggtgtgggtggtgtgcatcatataataccaatatatggtagagtggctataggatgcatttgagaatgagggaatatatacacatatatatatgtggaaaacatgtttttaacatttgcatctgtcaatgactaaccatcctattctcatattctcttagaatttgatttagtcattctatttagcctcagcaatattgcagtagtttgagtaaattttttattttcttttccttttgtgtgtactcaggactacagatagaattctgacttctctagaacaagtcagaaaaacttgaagaagaaacttctttatttcttctagatattcttttcgtaaatagaagttagagaatccaaacaaaatgttcttaatcatataaacattctcacacacagtgaaacatacagacactgacaaacacccattagggtagaaaactaaatttacctagtcatcatagttttcttccctattgtgtctgagagcaacatgcattaaataaagaatacaacagggatttaattataaattgaaatgagtgctatgaaggcgaagatcagatagctctgcaaaccagactagtttgttaagtctcagaaaaaaacaaacaaacaaataaacaaacaaacaaacaaaaaaacctcattgaaacatggagatgtgcataggatttaatcattcaataaggaaagaatgctccttattggaacaggaagcaactccaatggagaatttgagacgttctttgaactttagttgtttccaaagacccaagtgattaggagcctgcaggaagaaaagagtgcactgaaatgacctttgacaaataggtgagtaaaccacattcctgtttttttgacaacatagcattttatgggttactcaaagcagaaatttgttccacatttctggaggttaaagatgaaattatgacattactaactgtgcttctgaaagacccacaatgtgagggctcccccacgttctgactcaggagaggtgacaccccaaaatcacccacaagaaacgggtcttgctgcaaattgcaagaggatttttattcaagagcgctctcgggcccatggtcatacaccacgccaggggtagaggaccatggcgccccgagtagctgggtaaggggggtatttaaaggaagaaactgaaactcaaggaagtggggaggggcgttgttggaagataccaaagataccagttaagagtcacaagggaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccctctcccctctcccctctccctctccctctccttctccctctctctctccctctccctctctttagtttgcattctcttaagtgagttgaggtcattaatattgagaattataaatgtttgctgtttattgattcctgttcttcttttattatgtatggttttcttccttcactgattcatattctagtttcatttgtttcttctgccattttgagtgtagttaaacttttcagcctggagtgtttttatttagtaccttctagagggtaaaattgggaaatagaaatttctgaaggtttcttttattctgggatacttttctttatagattacgattgatatttttcttggtaacttcgtctgagctaacatattttctttcccatggtttgggaaagaaaggcccttttgggtttcagagtttcgaatcctaagtcaggtgttaccctaatggacttcctttgacctcctttgatactattttgtcttttacccttgcaactttgttgttgttgatgttttgttttgtttgtttgtttgtttgtttgagacaggatttctctgtatagccctggctgtcctggaactcactttgtagaccaggctgtagactcagatatggacctgtctctgcctcccaagtgctgggattaaaggtgtgcgccaccatcgcctggcttacacttgcaacttgaaatataatttttttcttctgtacctttaacattttgattatgtactgggagggatttttttctagcccttctatttggtgctctgtaacagctagaaagtagagattgtgtagaagaaaatgtttcttattctatgataatcaccaccttctttggcttaaataaattttcttctttgatgctattaaaaaatattctctgtgctttgacctggatttttcctctattcctcttacttgccttattttttcatattgttccagatttctaggatattttcaatgaattaatcaattaattaattaatatttaaatttattttatgtatgtgaatacactgtagctttcttaagacataccagacaagggtatcatatcccattacagtcagttgtgagccactgtgtggttgctgggattgaactcaggacctctggaagagcagtcacttttgagtgcttagttatctctccagcctgatttactgagtctcttatgactggctacatttctatttaacattttctttgactgagttatacatttttcctaaattttctttaatactctccaattctctattccatgacttgtagtttattggtgaggcttacatctgaggtttttgctagatcttctaagtttctcctttcctgttttatatcagttttttttccctttagctattcagtttctactttcatgtcctgaaatattttcattattttatccaaacatgtgtttatgttatcctggtcttcattacatttatttataacttctttcagttccatgaacacattcatactctctgtttaaaatccttatcttgggcttcagctaaactgtacttcgcagggactattgcaattgggttacatggaaggaagcatggtatcaaggatttcatgtttgtgcttttgtgcttgtatttagaaatctgaagtcatgatgtttgaggtgtatttggtttacatatttgatcttgtttttcttcttggtctgtgttctgtactgtgtttgcaggaagtttatatttttggaaagtgtgatggctgtagaaagcctggtacagaatgcttctgtaggttttttggtagcacaatggtatagagatgggtaagtacaaaaggctgactggaggacaggaaagaactagggaggcagggattgcacccaccaaagggcagggttccaggaagtggagatggggtacaagagggactccttcaagctagttgttacaggactaaaagtaattcttgagaggtataatggaggacaggatatatagataaaatcacctacccgtgtcccagacaaatatggccacatgtggactcaggtatctgactcaaaggaatggatatggactagaaaggaaggctgaaaaagtcatcacataagaactaaggggacctggtgaatcgaattcacatatcaagaggtgaattccctaggaatggaggtagagtgacaggataagatcccacatgcaagctaccagaggaagaagagtatggctaatgaaacaggaatgaaagtctataggtttattagaaaaaaaatctccattttgattgttcaaatgtcaagattgtttctggtgactgaataccatccatttttctgaagtcttttcttctcatctgacatctgagtacgtggattccacattttattactataactatgtactagttaatgtaagggaacttatgcctctttaagtcaattatttcattttcgcttgatatagaatgaggaaaactgaagaaagggtattataatttagtaaaataagtattaataagtgcaggggaatcagatctagtgaatagtatgatgaaaaatatgatataggcacttaaaatgtattaagagatcatgtttttaaatctgcttataccatccctattctacacacacacacacaaacacacagagaagcatagtatggccccatgactacattaatttgactatagggataatctctcaatgcatgtgtcaatggagctgtcatattatataacacaaatatgcaaatgttttctttgtcattggaaattttaaaatgtatatgcaattttaatgaaaatttatgcagttctattagaatcagtcactcataagccatgttgtttttcctctttatccctttaccctttagtagtatttagcatattcttagttgattatttatatggccagttcttgaattgtacttacttgtactctcagagttactttttaaaacatatatctgcatcttcttactggaagatgcataggaacccatatactatataaacatatcctttagtgacagttatggttataacatcacttttattgacaatgaataaaatttcttaatacttaatcttttaattttcaattttaagaaatatatttacttttattttgtgtgtagggatgtttttcctacatgtgtatcagagtaccatatgaatgctatgcctggggaagtcagaagaaggagtcaaatcctctggaactaggagttacagatcattaagagtcatcatgcaggtgctgagagtgaggtgggcctgcagtgctctaaactgctttccagccctcgttttacagtttagtagtaaagaaaatttactattttaagttccgagagaaataccaaacttaaatatttcttccatgtaagttatcattctaatggagaaattcaacttagaacacatttatctctggcttgttgttttggctttaaaagctagattacttttactgtctattggcttaaattacattatcagttaactcaaattcttgataatttcacaatttattgaaattgtttaataggacaattcagtctcagtctttgtttctgtcacactttgctacttgactctgccctaattttttccatccatcacataggaattatcttgtctaatgctttttaggataatcaactcatccttatttcttccagaaatttttcttgttactagctgtaaaattcttataaataggactggctacctccacttacaaaactatgatggctgttcaacttattctgtgcattccattacaggaaagcatggttaaatatatgagtacatttttgcttagaacagtcgctgtatatagaaaaagttgaagataccttttgttttatacttttatgaactttgtggctccccaactttatcctctagcatgatcaaccttggtgcctatggcatcataaactgtaagtaaaaagttcagttgctatctgaacaaacataacagtttgccattgaaaaattaatcttatctatttcagcaatattacatatattacatatgttacatatatcctgaaagcactatctggtattttaggcagacagtctaccttgtagaagatgagatttttgtatctgatagaactaaattggaatgtctgaacttttatttctctgctgtacaacagaaattttattaacccttataaaccccattaactataggttttggcttgaatctttgttcacattccatatatcactagattgtgatatggaaatgtgattttacatggtggctagaacacactatggctagatgacacagagagctgttttgtgatgtctgccacattaacagagtgagaatgtgccaaggaaggatcaaatatacttgatgtcagacttctcagcttccaggaatggaatacatggttgtagtgttagaactatcaacttgatgatattttactattgttgctactccagactaaattaagatagggtatttataaaattcatgattgcttttaaaacttttatactatgccaagtaggtatctaacaagtcctaatctcaaaagattagttttattaataatgtttacagtaataattgttactatttataccggagtaatatattgtgtgacattcaaagaatttaagcagtccaaattgcagtccccagaagtcaggtcacataactactaagattaatactgaaaataagtacacgttcaaaagcaagtagaaagtgacttgaaagtggacttcatacaatgtgtaactgcatgttaaaaatgagaccaggaattgagctgagttacacagctaagttgctagactctgaacagtttgtctactatctccattgaataccactgggcaatcttacaggagttttgactcccaaaggaactatatgaatctgcacttgcaaaatattttcacctgaattgagtatttgacctcaacacattcttgtaaattatgcaatactctcaagtgaaacatcaaactctcagagattaatgaccctccaaggtgatactctttgccagtggtagacctgatatggaaccctaggtactgtaacactgataatcacctcctaattgcttgtctctttgtattgagctcctcactgcacacttgttctttgatactgtagatataaccatactccatatggttcctatcattgcaagacaggttaagaacatgttcttaatacagcataatctatgtatttaactgctcattacagaacataaaaaaggaacaaaggaaagagaagtcacaaaaacaatttaatttaaatgactgaatgacaaaataagctatagaatagtaaaacattcatattaataggtgtctaaagttatggttaatattgctatgatgtaacaccatgactaaaagcaaattggaatggggttatttgccttacacatcttaaatcatacttctgagggaaaccaatgcaggaactcaccctgggcagggctttgaggcaatgaagtgctggatactggattgctattcatggcttgtttgcctgctttctaataaaaacctggaacagggtagtatgaaagttagggatatagctgttgttattcattctctgattcctccctctcagggtgttcagatgtctaggtgtgccaagctggaaggatgaagcagagtctggaagggatagggttctgtaggatccaggtcagtctgggagtgagttcctggtgtgtgcgggaggaagaggagataggagagaggccttcttccagtattttagtgttacagctcctttagattgagggattttattcagagtgttgggtgcatacacattatttgtaatgaacaaggagtatgtataaaccttggaaagtgggcaggaattttcagggtaaatgaaaatcattgaataaagttttaaagttctgtgaatacttaatttgcatggggaggcattctaggaatctcaggtacttcctggactatttcttaacaggtgtggggaggggagtggggtcagaggatgggcagtattggggcaagctgaacttgtaagtctcccaaagactattcaactgtttccagtagagtgtctggggtcaggatccccaggcaaggtgagagaaggagaagccctgctggaaagagagacttccatttggtcctgagctcagagaagatgtctagcaatacagtgtaagacttcgaccttaattagcagggtttccccacctgtgagtagtgatatatccctgcccacaaagtgttaagctttccccttaaatcactaaatgagacaattgcccataggcctgcttatggaggtattttctcaattgatattccttccttttagataacatttgcttgcatcaagatgacagtaaactacccagaacagctggtcattagaaaatctgtactttctacttaatcagttttttttttttccttagctgtctagaagaataaaatgcttaatttggaagcatctatccattagcattccagtgaataagcacattacacaataagaaatattgtagtagaacagcagcaataaccataatgacaagaattaggcaaactaataaaatatgcatacacaatgaaatctctctattttctacctttctgtatccatctttacaaatcagcttcaagtactccctctggttggagacctatgtaatacaaatctttgcatagcttaagtaggcaaaaatcagaagccctgacagatcaagtaatttattcaattcaggatcagctagagtttattcagacacaatgccctaaaccttttgtttcatgctatgtctatgaggataagacctgtttctcactttgatggttttcagccttgtgtataaagaagtgggaccatcttagacttgacagcctcaccattaatttccaagagtcaacctgatactgaatttaccattgattcactatctctctgcataaggttaggtagctgtcccaacctaagccatacactgacagcaataggaacaaaggacaaaggagtttattcttctagggaaagaataagtacttatgcatgcacctgacaaatacagaggtggatgctcacagccaactattggactgagcatggggtccccaatggaggagcaagagaaaggactgaaggagctgaaggggtttgcaaccccataggaagaacaacaataccaaccaaccagacccccaccccagagctcccagggactaaaccaccaaccaaagagtacacatggagggacccatggctccagccgcatatgtagcagagggtgtccttaactggcatcaatgagaggagaggcccttgattttgtgaaggcttgatgctccaaggtaggggaatttgaggtcaaggaggtgggagtgggtggatgggtaggggaacaccctcatagaagcagggggagggggaatgaatatggggtttgcaaggggggaaacctggaaagggaatagcatttggaatgtaaataaagaaaatatccgataaagaaagaataaaatactgggggatttcagaattaaaaagaagaagaagaaaaaaaaagaatacacacttaaggatcctgccacagcttctctgtcttctgatttctcctcaaaaaacacaacttcacatgtgtagatttcacaggtacaagaccaaaatggtaccttgcaagcgcaagagtcaggcctctgtgtggaacatcttgggcaaagcattgtgtgctaccaagttatccttctggtacaggcttcattgccaagccaacgccagctcctgctccagttgcacaaatgtattcagaggctgcccctttggaaaagcttctacttgagtatctagatgcctggtattttttattacttattttaaaatgctgttttaaaaatttcaaagtgatttttttctaacataaattccaggaaaaaaatatatattatgaaagcaaaacaaggccagacattttgtgtaatctaaaggtcaaagtatttaaaaggctgctggggctcacaaggcaacagcagtgcccaagcaaaacaaatcatgttaggggattgcatcagtctcccagtgttgccatagaagggcattaaacaggagaaggcttaaaatatgcaaatttgtcacaaaatgctggctagagtgtgggcaagtccagggtattttacacatattgagctaagttccttgtttgactattctaagatgtgtaagatgtgtctttatctatctatctatctatctatctatctatctatctatctatctatctatctatctatttatttattttacaaatttgatatcccttgactttattcatgtggctattttattttcacattgcctatctccgcttttctttcttttttttccattttttattaggtatttagctcatttacatttccaatnnnnnnnnnnnnnnnnnnnnccacccactcccccctttttggccctgtcattcccctgtactggggcatataaaatttgcgtgtccaatgggcctctctttccagtgatggccgactaggccatcttttgatacatatgcagctagagtcaagagctccggggtactggttagttcataatgttgttccacctatagggttgcagatccctttagctccttgggttctttctctagctcctccattgggagccctgtgatccatccattagctgactgtgagcatccacttctgtgtttgctaggccccagtatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaattctaaggagggacatagtgtccacacttcagtcttcattcttcttgagtttcatgtgtttagcaaattgtatcttatatcttgggaatcctaggtttggggctaatatccacttatcagtgagtacatattgtgtgagttcctttgtgaatgtgttacctcactcaggatgatgccctccaggtccatccatttggctaggaatttcataaattcattcgttttaatagctgagtagtactccattgtgtagccagaagatgccccaactggtaagaaggacacatgctccactatcttcatagcagccttatttataatagccagaagctggaaagaacccagatgcccctcaacagaggaatggatacagaaaatgttcttttctttttttaaagttttgtctgagtaacctcttcagtttttgcatataccagtgtatatggatcagagccaatctgtatgaccttgcttttatttattttatttttttaaatcctgtatccaataaatagtggcatctgagatcctaggaatcaaaactcaaacacatcctttggaggaacataattcactcgatgtcagagatgaattaaaaggcaagtatcttctcagaaagggtgtcagccattcacctctggtctatgatactattcctaagccttaggctaggtttccaggttttggaaacccaaaggttttttttttttttttttatgtgaaaatgtatgtattcatttagatttatgaaagctaaactaagaataattgattccccacttgtgccatctgcacatgctcactttctcccatcttctacatctgcctgcctctaagatctaggacatcagtgtgtgttttgatttacctgtgggtgcagagctcctgattagtttttctaaggtggaactgctttagtatctttctttcagcattcacaaaccatgttatcctacttttttggaaaaaaaaaatctttccttagtttcctttattgttccacattttgagcagctagtattctagcaatacttttaaattgcacatggttttcaaatacactaagtgttttcatatggagtagaaacatatatgtgtatgatgactaaatagtatttgtctgtatcaaaggaaaatatttttgtatttctttttgtgtcagttttgcgtgtcatttctctgttatatgttcatgttacaaaacttaaaaattgtccttttaatttaaatttcctgtttaaaacataagataaaaaaaaactaccttgtgattcatattatatattatagtattattaatatccagaatgcattgaaattctcagaagatttggtaatgatgagggaagccataaaaaagtttatgactacctctagttataaacatacaacagtgagtgagttattttcattcacacacacacaaaagagatgatagtgaaagtatgtcttgcattttgtttttaagaaaataacctatttggaaagctttttaacctccttaaaaatctccattgggctcatttgtgtaatgtcataatgccttggtattgtatgttactgatgaatatctaattatctgcagtgatactgttgcacacttaagtatttacctgtaagggatattcctagaagtgagattcatgcatccaagaacgtgtacatttaaattggctgcatattgccaagtactctcaacaacaatatataaaaatgtctgtttcctcacagccttgccaatttttacagtctttggcaaacttgataggtttttaaaaaacagatgcattttctgttatttaatttgcattttacagaataattggggtgagcagctatccatatggttttaggatacatcaatcttcctcttttatttgtgaatcaaactgcttacttatcttcttcatgttttcccattgagcctctgttctttctgtagcaccccccctccctgtgttttagaaacaatagaaacactctcctcatttttaggtagtgttggtattttttttttttttttttttgtgcattgtgatttgggcaacaggattttctttaaaacaagattgttgttgttgttgttgttgtttttatcagaaattggtgacttccacatgcctagttgtatattaagcattgtcagcactggcagcgaaagcaccaatgcaggcagattgatggcccactcctcccatcgtgaggccaagctcctgaggaacacgggcaaagtgatcaaagcagatgcttcatttgccttctttcagaaagaaaatcacagtctccaccttaccttccagaatacatttatgacttaataaaatatctctttgaggttaaaaaatataaaagtatgaatgctaggtagagtcaacaaaaacacaaacttctataatatctttactgtatcattgattactaaggccttcttattttaatccttctatttacctccttctctaatgacccctgttttcatgttcctctttcttgtcctatgacatgtgacaatagcttttcttgacattgcttttatggagcacataccagtttgagtatgtatgaagtatcatacagaaaagacaagcttggtgaccacagaaatcctgacgttctacatggtcgtggtatttgtattcctttataaactcatccaatgaataagatagaactggagagtcacctctagatatttaaaggggggaaatattcacaatcccatgaagtaaatagattatgaattacaccatcccaacaccctggcatctaaaagacagtgcatgtccttttattaactggctttattgtaggcttcatgttgcattctcttgtgaaataaaacttaagccatttacttattttaagaaaatcaaacaactagaagaataggcatctttcatctgttgaaaaagtgagttcaaaattaggtttgtgggtgacagacgtattgacagccttgccatccatggaaatagacaaggaaaaggcagtgggttctgtggaagccttgaagtacttttgtggaacacattgattataccctttacctacatgatctttccttcacttttgagctaaatgaacagcatgactatcttgctagaacaacagaagaaacagagaagcagaaggaaggaagaaattaggaagagagaaaataggtagagaaactggtttatatcctaggctctatcctcaatggaccatggaacactaattatttctcctttacatcacactaggtgatggattttgtgtgctcatataaaactctaaatcaggcatcacgacatggaatagagaaatcaaaatagtttctaaaattcaatttggatggtatcttattgttcggtttattcctcaatactgaattaaagaaaaaatgataataaaaaagttttaccaaaataatattaagacatacaaatttttgtatcacattttttatattctaaacacattttttagcatccatgattttaaggattgcatgattaaatatctcatggcttgacaatgtaaataacttctggtatcaatcttcaaaatcatatattggagtcactgaatggatttggcaggaagtccatgaagtaataatatgaaattttatattatttcattaattcattcactcacttatttaccattttcaattaaactatggaagtcatgtgtgaaagaacagagtatggtttattccctaaaactgcaacctgcttacaaaacttgcatatacacacccacacccacacatatgtgcgtgcgtgcgtgcatgtatgtatatatattatatatgtatatattgtatgtatgcataatataatatatatgtgtatattatataaaatatatgtatatattatataaaatatatgtatatattatataaaatatatgctatagtatatgtaatatatatttatacagtgtataaaaatataatattatatattatgtatatgtattgtatatatatatatttagttggattttagctggtcattctacttggttggctattaaaaacatctgtattttaagctattttagaaaactattttgtttaatagaaatttctatcgtgttatattatttgtattgtgatgtgaatgaacagtagatagtggacatgctgacaaaatgatcatgtaatccttatctaacaaacaaacaaacaaacaacagtacaactcagtatggagatgcatgtctttagtcccaatacttcagaggcagagacagaggcaggcagaaaggcctttatgggttctatgccaagttgatccacataggaagccagtgagatctcattacacacaaaagtgatgatcactttcccatgttcagacatatgctggataggctgcatgaaagctggaagagcatagaaggtaatccagaagacactactatttcatttgtttgatgttggattttgtaccctcaaggctgagagtagatcttgagtatgttgaagaaaagtcattactaactttgaagttttcctgacctgtgtgtctatttgtccagtgtgtcactgcctacatatattgtcttctttttgtcctctttatagttggactatctcagacctgctagctatatacccaatgacacaggggtttattaatattttaaagctccggcctttcagctatgtaagtctcctagctactctcattgggctaatcctggcaatctgtcctgtcacattgccggctctacctttgctggttcatccattcaccaccaagtctgcaggctgaatttccgacctctgatttcttctcctagggtttctggaaactctatcccctgcttcctttccagatcttcatcatatccaattagataaaactagatctagactactttaggcaggtgaggaagaacaaatatttacaaacaagaaaactcagtaacggggcataggaatggcaatatccagaatcctgccagcatttagctctttgctggttcagaattaagaactgaatatacagacacatcttcacccaatgtagctcagcacctcctgactcatgacctcattaacacacttctctgtgtaaaatgctttataacactgtctgtccaattatctcttttccaattccttggagtagatgtttctcttggcaccttcaaattaggaaacatgcacgaagtacctcaataaaaagtgtctctgacaacaaggcagatctgcttggttgtcaggaataaggtacattttgattgtgaagggcactgtaaattttcacaattaataacattgcaaaggattccaagagccataccagacaccatcatggttctctgtagctcctttgcagctagtcaggaaccttaaagtgtatcaaaaaattcatggtttgtttagtctccctttttatgtgtttaatggagcatatcagaagcactggatggaacaagaacagaatgtatctttatctagctagtcctttcctctgtctgttgacgtaatctcaaatagatctcaaacaaccttcttgttgtcccaatgtttgattccacaaggtgtctctgtatgtagcattttcaaaagagaaagaacttgaatgacttttctttctctttatacaattattcttgtcagcatttagcctgctacttgaagtataactgtatgtcttacaaggttctcctgaattattttgccttcctccaatgacaattttgttttaatttttagctagatttatgtgttttcatcatattgtttctgctctgtacatctgaaacatcagtctttaaaatcactggagatactatgcagtaaaaactggagaccacctttttaaactgctagaacagtatttttatgtatttaagtaaattacccatctcaaaaactggatcattccattgacaaaataatcatcttttgtagaatgttttgttttaaatttgtcacttctcaatttttagtatcaaaatattatatctacaaacatttataataagtaaattattcaactccataaacataatgtaatatatcaaataatatttcaatgtacttttaaatgtattcttctgcataatttaaaagtaaaaatcattaaatgcatattgtttttgctttatgcatatctagattatttcttcatactattatgtacttagcaaaagcattgagaagattccttactcatgtgtaaaatagtaaatgtttatgagatttactttctgcataaataacaatgtcctcttatttatatcctaagatacaaagatacattattactccaaactactttgtcttcagtttgaataaaataaaattccatcacttgtaattctggccttcttttgctggtttacaatttttcttagtgtctactgtgtaatgaaaagctcttgagtaagttggccacagaaaagaggcatgaatctgggacacatgatgctgtctagtgacttaccagcctcacaggctcaggtttggaacctggcttcccttgagatttgttctaattttaatatatgctatttagcaaaggctgtgtgatccaacagcaagatagatgatacacaatctgagaataacacttcaggacatctttggcagccttctcttaaaacagagtccttgcactagcgaggtagcatgaccactcagtcatacctatgtgtttggcaaggcaacacttatgcccatgttcctcattgcaccatggaacactgcctatcatggcctttacttgaattgaaatttttattagataatattactggatttattcatcagtaatattaattcaaaaatacacactggaaaagtagcttgaagaaggattaaaatgaattccttttgtcctttgataaatttgtaatattacttgcaagcttcctcagtatggaaaaaagtccccaacataatgaatatagaagaaatccaatacacttgggtactttcctcattctccttcatgtaaacatatgcttaataaaacacattttacttgaggatcataaatatcgatagtctatttataaattcccaatgttcaaaagaatgtcagagcatcagaaatgagcagagtctatcgatcagcatgaagacgtgatgttgggaaaggtcagaaaaagattcagatagggccttgcctaatacatgttgacggcagaaaggagccaagctaagctatgctaagtcatcgcatcgataaaatattctggaaatctcatttcatttgattaatatcttgggtcaaataagggttgcattaaaattcagcagatatttgcattgtggcttcattttgtaattatgtagagtctttgtagcttgtcagacaaaacattagaccagatttaaggagagctaggaaggatgccctgcattgggtgattttaaatgcagtcctaggaggctccagagagtctgaaactgcatcatggctttctgttaaactcactgtcaccaacacagttatttgcacgtctaaatagtgtaagatgtttgtctaagcgaagggaataaaacaggagcaagacagtgcacagaaggggttttggcagcatttgagttgacatatggcaatgggctcccttctctcaggcaagaaatgacacatatgtctgaggactcgcttcactgaaatggagaagctcatattaggcagtggagactcctacgttttaaagccaacatagtcattcaattctaattaaaacatttaagacctgtatgacctcggttggcacctcagagtatcaattttagtcattgcaacttatctgttatttagttacagacatctcctcactggacaccttctttgtccccaacataattccaactgctataaattagtcaatacagatccctgcttctcactgagtttatcttttgacacttttagtgctattaagtaactataaaaatacaattaaagccccagcataacctttgtagtacatgctcagagaaatgtttcttctatttatttaaactctcacttgctttttgtttgttttccaaattcacacattatttcataaaggaactcagtgagtggttccggggcatatatttacttaacctttctctgtcatagatagcagttaaaaaatataagcaagatttacgcctgtcttcccaagccaaataacatctaattcttggttacaaagtcacatctacaccctgggtagccagggaggtaagaactgattcaagctgaagcaaaagcaagcaaaaaaggaacaaacaaaaccaagtggcaggtaagtgttttctaggccagagaatgcaagcaagagaggcctgtagccttttgtcacaaagttaaactgggtccagtattaccatatgccctacatgttccaaggaactagagagccaatttagccgattaagtattcacattgtgaagtaatggcaactaattattgaacaagcctaagtacacaattcacagcatgcacatgtgcacgctcatgcgtgcacacacacacacacatacagaaagagagagacagagggagagacatagtttgggagaggagaggagaagagaggagaggagaggaggggaggggaggggaggggtgtctgagtctctggctactgttannnnnnnnnnnnnnnnnnnntgttattctcagattgtgtatcatctatcttgctgttggatcacacagcctttgctaaatagcatatattataattagagcaaatctcaagggaagccaggttccaaacctgagcctgtgaggatggtaagtcactagacagcatcatgtgtcccagattcatgcctcttttctgtggccaacttactcgaaaggtaggggaggggaggggagaaagaggtagggagggaaacagagacagacagactgataaactgattttgtacataatcagtaaagcaagtctatggctaagtgataaattattcctttatatccctacaaaattgaagattgttgagattacatgaacatagcaggtgtcttctgagcttttcagtgagtttttatttctttgttttggtttgttttgtgatcaaatttgataatcttgccgtgaaactttttattttaaaataatatcaatgggtcctactccttactttctatttagaatcattagatatatatcaaaggatctatattcttaagtttatcttccaggaattgtgatgataatggaggcatgggaacagttggcccagaaagccagggattattgtacaggaagtacacaagattctttacagatttcattttttctggttttcaacctcacttctgtcaaagctaatggctgaactgtctggaagtttacacattgttaagcttcactctcatgtagaaagtcttctttgttggtctctgtcttttctcacaacttttatttatctctcaagtcgctgctccagaatcccccttctcagtgacttatgtgttaggctatgaaaacgcagtggatatgtggcttgtggtttggaaacacgttgacttccctgcattagagatacttgaaatgacatgttctctgtgtattataatatgttcttttgataaatctcatagcacatttcaagacaatgttggatgaaaaactgcaaaccctcatcctaatacagactaagaagttttgcaaatttggtatgttttgtactaagttcttatcctatcagcccttgggggtcatgttatgtaaagcacaaagactaaaccagaagagaaccattaatttcttgcggggcactggttttaaatcacaattttacacattaatatttaaggcagaaacagattatttattttacaagcaatttttcaaaatgtttaaaatccatttaaagatacactttgctatatgtttcagcaagctcactggaatgttttagtcgactttttttttttaaattttgagttcttcacacttaaagattaataaactgcatcaaggaatgaggccctcgactaagtgtcatgaaggtgaaccaggtatcctgttctgaaagattaatgccaggagacatttatagtctgtaacagtagccagagactcagacactgttattgatgtgtcaggctgagaagagagggctccgcagcaggggtgacaaggacaagttctgtgtgttcatcgatctgcagtctcccatggaaaactccacatatttctgaatgtcttgagtggttttattgatgcagctcctgccagatgagagggaaatcggactcaccacatttatttttcaggccatattggcagtcccacttaagaatttaatacttatgtagatggtgtggaaaggggggagggtattgagaatctcatcaaataaagtggggaagctttttagggaaatttacaaaatcccagaaaccccaccggaatattagaaaaaccacccttggtgcctttttttcgcctgctctaacgatagccctgatcgcctttgttactgaaatcctgctgcaggtgatgaatcaagacctaggaaaccaggcagtggaacaaaactgtcaagcaagcaggtggtagcaaagctgatagaactgtaatatatgtctagttagagactcaatgcattcacagagaagtcaaactagggcatgccagtagattatggatcacaggcctaaggagaaccacagaagattatcaaatcagtttttcctgtctccaagtagggaaatcctcatattatattggaaaaaaatccataatagcattagaattctaaggtattcaggtatttactcatagtgtttattaataataaatcttcaccatagtgttcataatttacttctcatgaaaaccataattccagaaatcctcatttcctcaatcaagattctgacttctctgttctataatgtacattatgatcagtttattagcaagcatagaaagtaatattgtaaaaaaacaaaacaaaacaaaaaaactaacagtgtcatactagccatgatctgaaagtaagaaaatccttacttacaatatttgggagctgagaagagcccaggctgggaatggggttatagggaatctagatgctttggtgatgagttcttgaaagtgactataaggatatagtcttaccttaaaacaaataaggaagcttatacatacaggtatctttatatggaatgagttggttaaattttggagctagatttatgtacgcatatataattatagcatggttatatttaggaaatacacacacacacacatatatgcaaatatgtgtgtaatagcatttattgcaaaaaggagtatcaatattttaaaggagagtacggatgtttatatgggaacatttggaggaaagaaaggtagggagatgtgttatacttatatgataatctaaaaattttagaatatcaaggaataaatatcagtacataaataataataaggaaagaaagaaacaggagctgaatatgctcagtggataaagcaaacattgttcttgtaaaggtcctgagttcacttcctaatacacacagcagaaaacaaaaacaatatatatgtgagaaagaaagagagaaagagaggtctcctctagatataacctatgaaataaactttcattcttaagttttctaaaataaagtgctccttgttactccttaaccaattgaaatgtagctcttatctcaaaataactctgcaatagttaagataagaacactgtgtactataataatgaccttcctacaaggtatgcccattgctgcactagtgacatgaatattgcatattatgaaggtaccatgccattttttgattggatggacatctcacaccatgagatagaagtcatatcgcattatgttaattaggaaaatactccagactagattaggtcatggacacaggagaaacctattggtattgttgtgctaaatcaacagggtattaaaatgaatcctaatgacatattgctacactcagaaatcagttcatccctcataagtcagcagagaaccttcttgtaatagatggttatgaacatagaggcctgcaatgggacagatttccagaaagtgggaaactgtagagagttctcagacctaaattgaatgtctttagttcaccccttcattcaaggctcagggatctatacccatgggtttccatagtgttataaggaccagagctggcagataattttacagaaagtgcatttcacagacatcttgggttaagtgcacataggcagtgtggagactgtgacatcatgcacaagacctgtgcaagctcatgccggacaataatcccagcatgaatgacagaaagtgacagaaagtgggcacaaactgctactctgagtcacgatgaggaattagcttcatatgctgactataggtacatgaactgcattccaagacagccctcatcctcaggagtaaatgttcaacacaggttgcactctgatttttttttctttatagttaagaaagaagaagaatgtgaatctgaatgggttgggaagcaggagactctaggagctggggaatggaaaattatataataaaaatatatgaaaaatctcaacaataaataaaaaccaggaaaaaaaaccatgtcattcatatttttgatattcccattttacatcaattacatcttataataatatggttagaataagctgaaataaatataataagatttaaaaatggaaaactggactgtggggagtttttacttccttagtttagagagtactctgaaatgggaagtcatcccttcctttgttttttgaaattcttctcttcacggttttacccaactctactatctcttatggattcctctatctacatttatatgcatgtaaggcactctacatgattcttctttttaaagctagtccggagaatgttttcaagtccaggtccttgggcatccacagcaatgtttagttctaagctgtacagacatagagtgcatttgtagcatctactcatcttatgttttcctttttacagtttatttacttattcatcgatttaagacttgtgaatcttcaagtatcctcagcatgctggaaatctctatattactactttttccacaggcatctttacagaactaaaaccctgactctgatgtttattatgaaaaactttactggaccatctttgttctgtgtgtcctatgaattcagaaaatcacacaatcagttgtccattgtttcagcattttgtctcttttgggaagtacatcacattcctgtaatattttctgggtagtttcaatgccctctttgctcccaaataacttctgggcatttctacccaccccctaacccattttagttcccaaataatcaacatgctgattaagaagcatcaaggaggtgaaatctagaaagtgttttctgagaccacaaagaagctgtgttccagagttagccaaggttgtaccccaggctatagctcaacttggtaatatataagaatcacccaggtggttgtggttttgaatatatgaaggggtcatgagagcagctgaggcttggtgtgagcgcccgactcgccagcaagaacgatgccacgaaaggatccttctgtacacgtttattgggagagcttgattacttaggcgaaagaccctgagcccagaaatggcgctgcttatataggcctagtagtgacttgtccatacctgattggttatgctaccagtacctcattaatatgcatcgggccaggcagtgactcagcaaaaaactcttatgcacatgcgcactttggttgtttacccataatcatgggtggtggccagtggtagccagcaccatcttgtaatggcgtttgcggcttcccacagcttggcactcagagagaccagtgaaggccattggtgaaggtgctgcttcagttgcagttgttggcccaggtctgaaggggtcatgcagagaagttgagccttgtgaccacgaagagaccttatgagaggctattggcaaagcctagttggagcagaagaccccagaatattggacatatcagcaacataggatgaccaccaagaacagcagtggcagtggagtggaatcaaccagagcctagagtattacagagtgcagagctggagaagtgacctgagccctttggaggaacccaaaagatcatgtgtggatcccagattttggaactaaaagcagtgaagctgaagttgacttggagacgccaagatgttaaagatgacagagctgtgagttatctgctaaggacagctgctaacagggagtggaaccagcctagaaaaagaagtttgttgcagtaaacaaagatgacatcagacatggagatgcagagtttggagtttgctcaactggtttcctgccgtgctttgaagattatatttaagtaattggatgaatctcagaaaagaacttgaaatttggacttttaacattgtctagagtactatagactatggggactttgtaagttagaataagagtatgtttttattattatacaactaggtatggccctcatagactcttgtgtttgagcaagcctatgggggccagggagtggaatgtgatggtttgtatatgcttggcccaagtagtggcactattaagaggtgtgaccttgttggtgtgggtctgatcttgttggaataggtgtgtcactgagtgcatgagtttaaaatttttaattctaagctaggcagtggtggcacacacctttaatcccagctcttgggaagaagaggcacgtggatttctgagttcaaagccagcctggtctacagagtgagttccaggacagcaagggctacacagagaaaccctgtctcaaaaaacaaaacaaaacaaaagaaaaaattaattctagctgcctggaagccagtctttttcctgtctgccttcagaacaagaattggaactctttaactcctccaggcgcatactccttgctttatgataatggactgaacctctgaacctgtaagccagcccctttataagacttggcttggtcatgttgtatgttcacagcaataaaaccttaaccaagacacttatacaggtaggtgagtcatattatttatcagaaataagaaacagtggtaaagaagtgatatggaaagggattgtgagtcaacaggagtttacccatgtctgaaatctcactattagttaggtttatgctctaacttctttagaacttctacactccctctggactaagtagtactttaagatacaatgtccaaaacccaggatgccttccggagttacagctcagaatggtttttctaaacacatactgggaagtcagagctggcttccttttttctgactctacttgggcaatcaactgggagaaaaaaaaaatcccttcttgaggatttacactagggatatgttagtgcagtgttagtaaggaatcaataggtgctcagattacaggtgtgccctgcccctggccacttggtgctgcttttttccaatcctgttggtattcgaggaatctgagaggaagaaaggaaaggcagaagaacaagaagcttaaatgctaaaagccactggagaaagatgaatgactgaattgtgaacttagatgcatcagcactctcaaagaataaggaaagaaaataaggaaatattctcaagttggggtgaaaagttcaaggttttggactgttaatactctttcaaactattagccaaaaatattcaattgctgtggagtgtaatcattgtttgctgtgatgggagggtttggaaagctgcagatgtggggaaaactccttttggatgaacctttggcagcaagcaaggactatatagcatgtattgccaaggttctgaagtgtgggtaggaatagcatccaaatctaaattacagagctgcaagctacaaattcagaaaggatcaccctcaccctatggtaattgctaattaatgcacctctagcagagggaaacccctcttttctcaacatccttcctagagcatagctactgactcccttctctgcagaactctgccagctcagcatgtgcagtgtcttagttgctagagaaacaaccattcctcttggcacctcactgatgcttgatcaatctaccaagaggagaattctcttttgagggaagaagtaacactgtgtgttgcatttaagaatttgatagatgaccctcactcagacactgataaaacttcattattctgaagtgcaaaaactgtgccaaaacatgtgggaggcaaatcaggagtgttccaggaaaactgaaaaacactctactgtacactgaaattttaaaaattgcattccaatggtgctcagatctatgagaagcaaaattcgacagtaatgtgctctatctgaatcctgctgtctagagcagaggaacaataatagcttttataaatgctgaggggccagcgcttcctgctcttgggatcactttatgctttctttattttgtcttggtcacaggcttcctacccttgtcatcctcagattgtcatgttcatctgaggctatcaaattgtctttctaagttcctcctgccacattcttaatgtggtttcacagttaaatgaaccaaaatatcaagccattacttcctgccttttggtctccagtgacttgtacaacagtctgtttttctgtttgatatttgctacagtgatattagatgtcaagggaaaaggagagggagtagagcactgaaatacggcatgcgatattcatgcccaaacattgttactgtaacttttgtcaaaacgaagaggaaaaaacacaatagaatgtctaagaaatttcaactcagaagcctcttattattaattaatgattgaatgttatttttgacactagaagaataaaaaataattttaatgagtactttaaaaataagcaatgcttaactgtgtggagttcttagtaattaagttggtaatagattgaagtacaagactgatgaagactgtcctacagaaattgtttattttgttatccaacaaacttaaaaccatgtggaagtatccaaagtttccacagtgaaagaaaaggaagaataacttaccaatccagatccaatgtttcgcttgaccctatgatccaagatagacatgcaagacatgaatatatgtattagtacacaaaatacaacaggaatgtgcacatacttgataagttgaaacacttctcagttttcattcccataattctttcataagtctatcagatttcatttaaactgtggagttgatcatttgtgagctccaattacaacatccagtatgacagtcggaagagagacgactgccaccattactttctgttctcctttgcattctatattcttttcattaaagtttaggtcaaaggggctttgttatctcttaatttcagaaagatatttgacaaaaacatcttaatatccttatggaaaaagtacaatagtagtaaaataattgtggttcaatgtttaaaatattttattgagaagttcatacaacatatcttaatcatattcatgatttaattaacaactaatactgtcatcttatggttttccatatctggggaaaaaaggggatttatatttctatgcttggttcaatagaatctagctgatcattgctaaccactaaaattatatgatttgattgattttaaaattcatacagctttcttaagaaataatctctaatcacgagtcacatttatccaaattgattaaaaaacaaaaagcaacaaaaacaaaaacaaacaaacaaaactccttctgactgatgtttttaaaatatagcctggtcctgaaaatttgttctcaagactcttaccatatttaaaagaaatgaaatgactcaaacccaaaacaccgtgcaggggaagtcccatgtccagcagttgatgcccaacacaaaataattgtaataataataataataataataataataataataaatggtatttttagaggttatttttctcataatattgtgacatgtcttgcttgtttgtttgcttgctttatcaagacagggtttctctgtgtagacctgcttgtcctggaattcactttgtagaccaagttgacctttagttcagagatccacccaatgcctctgcctctgaagtgctatgattaaaagcctggctgttttgtttgtttgtttgtatagtttgttgttttgttttattgtattgaaattcctctgtgcctgaatatggatgtctctacagccatttgtttctttgggtgtcatatttggctcctcttctctttgttagttttgtcctattccaacttgtttgcttttgtttttatcttattttatcattactccttatattactgttttgttttgttttttccctaggacacataaagtgtgtgagtccagataggagaaaggaggtggagaggacctgagataattcaaggaaaaagaatcaggaatccaaacatattgttatggaaaaaagggattttcagtcatagaaaataaataaataaataaataaataaataaataaataaataatgcagctaagaaattacattatttaattttaaacgttaaaatctttcattttatactctatttttaaaattagtaacaaaaatgtagaagttttaactcatttaagttatcagcaataaatttgttataacatacattaaagagattcatgaaaatatctattcttaataaaatgtagtgatgagtatgcttttaaatgagaactattttttttttgttgttgttgttgtccttccttatccagtctattcaatacattgtagatatgtgaaaaccaacaagtaaacttttcttgaaagctaattttcaggtatagaatctgaaaatataccagtggtcatctcatcctttgttcctgtataactgtaatgatttcagacattagtgatttgtactatattagctaaatcagctgtacagacctccaaatgtcagcacacttcgttataaaatcctatcaatcattgactgtcaggttttgattttgttcaggtgacaaactcacttcaaaagtatttttctcttttagaaatgtttgcagagcagccatattgaaagtctgaggagtgtacccctttttgtgacataagggggtgctttgtgtgtaaagaaactagtgctccccagtttactgatgtgtgcattttgtcccttccttcaaccttacacttcatcaaaaaagcaccaaaaagatacgtattcaaaaaacaataaaataataatttgtagactttttccagggttgatttttcctgcgagtccttttcttttcttttcttttcttttcttttcttttcttttcttttcttgtcttgtcttgtcttgtcttgtcttttcttttcttttttttcttgggggggggatccatttcttatggtatcaacctgtgggtgccaagaaccagccttggcttggagaggggttcctgagagaagggatgattgagagcagaaaaagatctcaaagtcagttgaggaatacaagctgacagctttctctggagatgtccagacaactcatccagatagctcagttctcacagaacaaggcccaggattttatttacatatcaattcagtcaggactacattgatcaatatgtgaagacccattcatttgcagatgcagatgcttcatcagcaaggtcatggactgaatgaaaagagagaagacactgagtatagatgcaatgttactagattttgcaaggtcttgccactgtgacttctccatcctgacacattggaacaacactgagctagaacaatcccttccatccttcacttacttttcacagggtattttattacaacaagaaaaaatagctgagacaatgtgaataatgacgtttgttttttacaactctgaatgacaatataataactttcatgaatcacatgaaacacatataaagattcatgtttgcaatattactaaaacagggtttggcacagaacaaacatttaaaaccctcctagtttacctgtcagaaagtattcattaaaatttaacttgcatagtgagcaagacccgtattatatttcatgccttcataaagagaccctgaatttggaatttcaaatatatgttaaatagttctatgttgtttgagactctaaatgttgaataaaaagtaagaatggctttgaaactgttattcctgagtgtattacattacatagttacatagctacatatcagtttagagataatcagaagtgatataatacaactatccagttctcagaaagttgtggattctgatcaagacaacccataatggccagctatcaatattgagttttgtattagtattcaccatggatcacagaggttatattcaatatttattttgtgttcaatgtatctacaggtaggtttataggaatattaagtcagagaaattagttgatttttacagaccactggtggatttatttcatgccctctcaatattagaaagaaaacaactcctagactaaaattgagaagctcaggaaatagtacagcctttctattctttgcttcatggaaacttgataacctttacaactcacactcagagttcttgatttcactgtggagctggcaacgcgaggatgagtgggaaggggtgaaattgaaaataatgatgaaaaatatcactgtctcactcagcatatttgttacaggagaaccttgagtcgctgctgctaacattgagttttggttgtttaactgctttcctcctgtgagccagcatttcaggcaaccaagtatctgtggtgaagaagctggacttgatcttgtccttcactctttcaaaagattcacgggtcaattatcttagtaaaatctcctaagcattaatgctcacagaggaagaaagaaggactcagctggattttttttcaatcccaagggagtttgtggctttggcacttagcaaatgctcttttaatttgcttgctatggaaattcaattgaagcatcatgaagagaaaagagacccgtgtgaagtggtcagtcagctgtcgttgagctctcctccctttaaaggctagcttgggaaacaatgatacacaataagtacatatcattcagcacaggagttcatagtttttgttttagaaagaaatttttaaaaagatatgtgaaaagacactgtctacatacatactgctttgaagtggcagaagatgaacaactaacataacgtaataattctgaggacagactcaattaaaaacctctaggtgacattagaattctgaatgcagcataccatttgtaaaggcaagatttgtgaaaaactcaaaaagaaaaatttcagaagtggatgctcacagtcccccaatggaggaactaaagtgcccaagaagctaaaggggtctgcaaccctataagaggaacaacaatgtggactaaccagtacctccagagctcgcgtctctagttgcatatgtagcagaagattggcctagtcggccatcattgggaggagaggcccttggtcttacgtaggttatatgccccagtacaggggaatgccagggcctggaatcaggagtgggtgggttggtgaggagggtgggggaagggtataggggacttttgggatagcatttgaaatgtaaatgaagaaaatatctaataaaaatgttaaaaaataaataatgaaaatttataaaaagaatatcaaaaattttaataagcttccaaaccagacatataagaataaatagaaactcacaattttgtgttagctaagatatgacactctgttgcaagccactcatcaatattaaagtggtacgtcttcacaggtgttggatattcaattatttggtttcttgagtctcccaattttgagtttctccctgagagcgaactctttattctgcacatgcacgtggcaaagtggtggcgtttggcgccagctgtggagcagcttcctcttctgccatggattatatgtgtggcccgagggttgggctactgcatactttcctaaactactgattcagttacagtgtcaacatggtaaggtttcctaattgagaagaaccttgtgagatgtaaaaatattgtacaaaacattcttggcacagatccccagaaaacccgaagactatcaggctaatctaactcattctttttatatatatatatatatattagatatcttctttatttacatctcaaatgttattccctttcctgctttccctctgaaaaccccctaacccatctcccctcttcctgctcaccaatccaccctctcccactttcttgtcctggcagtcccctacactgaggcatcaagtcttcacaggacctagggcctcttccccaattgatgaccaactaggccatcttctgctacatatgcagctgtagtcatgggtctcttcatgtgtactctttggttggtggttgattccctggaagctctggtggtactggttggttcatattgttgttattcctatggggttgtgaaccccttcagctccttcagtcctttctctagctcctccaccggggaccctgtgctctcagtccaatagttggctgagagcatccaactctgtatttgtcaggcactggcaagcctctcaaggtgacatctttatcaggttcctgtcagcaagcactttttggcatctacaatagtatctgggtttggtgactgtatctgggatggatccccaggtggggcagtgtctggatggcctttccttcactctctgctccatactttgtctcctctagtgggtattttgttcccccttctaagaaggaccaaagtatcactcttaatcaactacttaccccaagtcagctattaatatttcttctttgcatcatgaatgttttgacagcttggcaactttctcacacttatcaattttgtatttattcattaggatgattcagattaaataacaaatccttcattaattttgtggagacattcatctacaaatatacacatgaactcagccatgtactgcagtatgatgtgttggtctggaacagactaaaaagatgatggatggcaattttataggactgtaaaagaactgaacaatttctattaagcagggattgtcttaacagaaaacatttactaagtatcatggtcatgctgttgtagagctataccactgcaaataacataaaatagatcacagataattatatgtagcatataatatttgagtaggatgatatttctgttatcattttctgcaatataattttatagttattttcatttgtacatttatattattaaaatttattacattaaaacagtgctgtttatacgtgtagcatcttgcctttataaaatcttctttttacattattttctcttgttttgacttagttaatgctcattgactataggctttgtgatatatacgatgtattgtctgcctatgtagttggtgatactctctatgtctctgtaagtatactctgaggtatttaccttatgacaaatttgtaagtataattttcaaccagggtttatttttcattctattctgtttaacaatacataccattgtaaatgtgtattattacatatatagatagatgaatttttttattacaaagtattcttgtcctactgagtaatgataaagagagaacctaaactgtatttctgtccttgtcttactgattccaggcccaaaatggaaaggtacattgcttaaatcaataaattataaagcacaacttcctattcaaaataattttatcacctctttccaatattaattccatttctcttatttgcaaatttgtcacttattgaaataatgggcaggcatttctttaccaattctttctttatgaacaccactaaactgtattttccattattttcatgccctactctgaaccaggtatctttttctgagcagtgtttttacattgggtgtatttttattttgaaataatgtctgacatatgagaaagtttcaaggtacttagaaacctcaagcaaattcatccgtttcacttatgtatgacaagtgttttattatctcactgtacaagtgtaatcacacaagcatatatagtcagaattggaacaagtacatatggcttactttgttctcattggagagaacatcattttcatagtatcctttcatttcttaacacctatccacagtgtagttatcaaggtgaggatacttaatattgtcatagtaatacctaatccacagctttaccagttactccaaacatcctttatagtttatctacattctaatattaggtcaagcatatttacttggcaggaagttgacaacatcttgtccttaatttccatagcttcctcaaattgagttttaactgctttttttttttttttttttttttggttttctctaagggactgaattatttcaagggaattacattatagttacattatagtctattgttactctctcatctaacatataaattacacttactgtgtctttatcatgagtgaaaaagtaaactaacaaactaaatgaagtcacaaagatataacaaaattttctgagcagatttcaaaattatcaaaacaactatattatagacagagtattatttttatgctacaaaataaaaatgttattgaatttatactacagaggacatttatggttctacaaaggtttatccaagcataattttgaataatcacaacttctctttatcatttctttactaaatgtatgtgggaagataacaaaataagtgaaccaatatatatatgaagaggatcaatttagagttgaataattactacctaaatactcatggttgacatataatggaaaaacagttgctattttctctgcttataatctttgaagtaaattatgaaatttatacttataaatacaaagatattttgtgttagaagcctatttgataaaagctaattagcttagtgataaatgcataaacaatttccaaagcatatttgtgaaagcaagtagaatgctaaataaaggacatttagggagtattaaaaaccagaaaattgtatttacgatagttaaaacaggagtggcataagaaggtaaagatggggaaagggacataaacgggaagagagggtaaatatcctgaggaaatactagggtggtaaggcgggagtggatgggagggtggcagagcaccttcatagaagcagggtgagggggggatgggatggggtttgccacagcagaaaacaggaaaggggataacatttgaaatgcaaataaataaaaaaaatgaaaatagatgctaaaccacaaaaccataactctctcctttagtccaataaagcctctttgctctcagatataacttgaacataattataacaattatgaatataataaggcatgatataccctataacctccaacccattatatttgaaaatttaggaaaagtattctatcgtctattctaatcagttacaattccgtccctaaaatatgtttgatttcaacttgcattaccatctgaaaactatccatttgaatctagaatattttctttaatggtaaacagcttaagctcaaatgtgagactttaactagtctgaaatggaaacttctagttcttaggaaaattacatcaaatcacggttcgctgtggttcaggtgaaggatgtcttggcaaagcaaacacatgaaagactctttttctgaagcagacacaggtgaaaggatgtttgaatctagcagacacatgaaagggcacttaatgaaggtgtagaaatatgacccagaagacaacgagagacaagcactgagctttgaattgatttgctccgcctcactattcttcactaaagacacacatgctatggttcaccttacatagcattattgagctcaatttctgataaagctgacattgagagaaactcacccaagagctgatcctcaggttcctgtggcagcttgccacttccagggccttatctcaggcctgttagcaagcctctcggttcctcatggttgagctacagctactggtttatgcctggtgtctgtctgcctaaaagactggtctgctcctgctgaatcatatttggggtttgctacagaaatgagctgctgctgctgtagattgaactcataaccaaagatctatggctgaagaggcccacttctgccttatcctaataatttttctcttctgctacctctgttgggtggtaggctagacgagaggttgaacccttattaaaagttgattgtgtctgtaaaaaaaaaaccaaaaacaacaacaacaacaaaagattctgagagaaataacacaagctctggtcaggtaaagacagaagtataagcaattgtagagaaggttttgatggtcaagagaactgagaattcataggagagttctaggttcttgcaagggaagagacgaggcattttgaatctgagttggtgagccacagaaagcttctgaatagtttctgtttgatgtgaagaaagattccgtggagaaaagtttagattctagagtgaatgcctcctgtatgtagttcatagaatatgtgagtgaactaaaatgttttattaatcaactatacatattactattatgtatttattttaaatgaccaaaagatctcatagatttttcattgttatgagattttaaggagatatttgagattttataagttggtcaagacctttgagagttttcattctacctctgtatgccggaaaactgcagaaaaaaagaaagttttcaaaaagtagaaaaaaaaggggggggggaatcatagcattgttcccatagttgcagttgttactttcttccaacatcagaacaaaattgcaaaaccaaaaagataaatttatctttttctagtcagcagtaagttagaggaaagaaaagcaatagacttgcaactgcatacattttaatgactgatttattctttctgaaatgtgtagaaggaaggaaaatgtagttcaaaagacaataaaaacaacttgagattttaatgttttcatgccaaactacgccattaggaaagaatcttgagacggatgaacaagccacatatcccacttacatcccatccttcttctcactttgtttccttgcctttcaaaacagggtgcagccagggttccattaataagcatcaaagcgattagttcttttcctgtgtataccctactaggttttactagagtttaatggggttcttgatgtcagattttgcactcaactatcatactattatttccaccttggagtaggaggatgcaatctctatgcccatgagcattcctggttcagttcaaactttgtcatagttcagtatttatggggattgtatgtaaaatttgcagcaatacaacaccctagacaaagtcctttgcattatttggaggagactgttgataatctaagccttgaaaataaaacaaaacaaaacaaaaacaagatcccacaaacaaacaaacaacaaaactcaaaatgatagccttctctccaataacccatttctttctctatgtgtatacatgtatatgtatatatgtatatgtatgcctgcctatcctattctgtttaagctcataaagagaatcacagaccagagtattcatgaaccacctgatactggatcatgctttcctaggatttttctcttttatacttccatgttaatttgttcattctagggatacaagcctaaatatatgatatatggcatcacagttgtactgttaaacagtcttttatcatgtggtaactttgttcatctttacggaaaagtattttctaatgtaagagccttgcctcacagcaatgggaaagtaggtcctgggtcttttggagttttgatgccccagcataggaggatgctggagcggtggggagggtgaaaagtgagtttggagggtggatgtgggatgggcattggtggaggagtaactgggaagtggtatatcatttcaaatgtaaacacatggactgattaataaaagaaataaatagatcagagtcacaggtcacatttaattacttaactttgacttttgttttttgagaaagagcccccccctccgggctagcttgaaacctgtaatgtaaccctggatggccttagacccctagtcctcctgttctacctcccaagtgcaggatttacacatgtcttaggctttctattcctatgaagagtcactatgaacacagaaattcttataaaggaaacatttaatggatgattggcttacagttccgaggattagtccattatcctcatgctgggaagcacagtggcattcaggcagacatggtgctagagaagtcgctgagagttctacatcgggatctataggcatcagaaatggagagtgagccactgggactaggttgagtttctgaaacttcaaagtttggtgaccaactttctgccaggggcacacatcttaatagtgctacgccctatgagcctatgtggacttgttgtcattcaattgtcataacaagcatggatgagcacgcaaagatttaaatcccagtattaaagtggaattattaaagtttaaaatattgaaatgctaaaacattaaaatttctctattcttctatatctgtagtgcacactattcaaataatgatatggctactgtgttagatggaactgataaggaacatttccattgttataaaaacttcacatgggtaactctgatctgtgtaaatggtgaccctcgatctgcagtttcttaacttcctagaaattcagaatcttaaggcacagatctaatcgccattttatggtataactggtgaattaaattcacagtaaaatgtataaagcactgctctaccatgtcatcttacagtgcaagcatttgctgagtggataaacaaatggatgaaatgatcttcatttggtttacatgtgagcaaaaaagtcttcagaatcaagtgtttccactttatattcatgacaaattctgctagggtcttacgtttgcaaaatggctatattttaggagaataaatgaaggattaggttatgtaaaatatgagcttgatatatggctgaatgaagtattttacattttccagccactgtttctgtcttccctattcatcaaactatgttagcatgtctccataatctgtatttgccattttgtagctgctggttctaagactgacagtcacaatgatgttcctagatgccttgagagaacacggcatgatttatctgtaaatattagtgcaaatttagtcatgagtaatttatgttttattggatgcatattggcaggatgtattattttctcctctatttagaccttgagggagaaaaagacaagctggggcaaattctctctttgtgcagaagctattatagatattaatctttaatgctttggtgtgtaagttgaagagattgtcttgaaatgagtatcgtcaggggaaaaatccttgatacttgtctgtgttgatattatcactctggctaatggaatgttgtagctactttgaaaaaaattgattgttttttaatttcctattacttgacctatctttttcatgggggcatgtactatctgtatgtggctcatcactgggggctgaaggtctcaaatcttttacatttactaaagttcctgcaattgtattcttttgagtgtgaatgcaaatgtatgtatatgtgtatgtgtacattcctgtgtgtgtttgtgtatccatgtacatgacttctatcccaccttaagaaaactttttttaggttttaattatgagctttatgcacctgtgtgggagaaagcaaacaaaagaacagatgcatgaggactaaagggcagtgtttcaagtcccttggggttgaaatcatgacccaccatggatgttgggaaatgaaagcaggtctcctggtggagcagcaaatttcttaaacaatcatccatttctgcagactcttaatgaaccttatatctgactattttacttgatgtagacagatagaaaaataagaaactacttgtggaggggatactgtgcatgggggcgggggcttgcaatcaataataatgctctgcagaaggcaggaagaatcaccagcacttgctaacaatggattttagtaaacacatgtatgtcagatctagatagctatgtttgcacaccatctctgggactatttggtctgtagcactctgttctcaggcataaaccaaaacttttgcaatctttcatagttctcttttaaaaagttaaataataaaatatatgttggaattaacagacacatgctttgccatttattagttcagtaatggtcactccatgtggaaaacatttattgtttacctaggtaagtatcattacaaaaggaaatctcattcttcatgtccttacatctctgtgttctctctcactttttttatctctgtctgtctctctctctgtctgtctgtttctctctaactctctgcctccctctttttgtctttcattagaaaacaagcagacatctaaataataaaataaaggaaaaacgaaaaataattcaaaatacaacagaagcagaatggaaagacaagtaaatagcacatggaccacttgaagacacagagacacacatttgcagcaccaaaatcctaatagaacacaaaacaggcgctgtaatatatacactaagacaaataaggtaaacaacaaaaacaacagtaacaactcaaacaacaagactaattaagtgagaaaaaaaagtatcctgaaaaaaacattatgagacaaagaaactccaaggataccatttagttagttttctattggatatctacagctgggcatggggcctgcccttaagtgtggtttgtgtcccaattgaaaccctgttggagaaaattaagtttcatttgagagtggttatcaatttgaaacagcttctgacctagggcagaggatttgtatttaagtctttcagttctaggaccccatctggcacagacctgtgcagcccctgtgaatgctgccacaatcccagttcacttgtacaccaggactaggatgcttagaaggccttagttctttgatgttctttatccactctggattccttccacctcctcttctgaagatttttctgagtccagggtgagggatttgatataggtatccaattcaggactgagtgttccaaggactcttgctctctgcacattttctagctgtgggtctctgtatttcttcccatctactgcatgaggaagcttgtagcataggaataaagagcaattattaaatgtgatttcaagaaacttagaagaaagttgctttatagtaaaggataccattattcagataaagtggcaggctacaaaatggagaaatatttttaccaattctgcacttaatagatgaataactagagaagtcaaaataaatccatgaactggacattaagaaaataattccctaattaaaaatgagatacaaatatcatcagagaattctcaaaaagcattcaaatgactatgaaacacataaagagttgttcaacatccatagacaccaggaaaatgcaaatcaaactaatttgagagattatcttatactactagaaacatccaaggtcattatcaaatgagatcttactcggagaaggatgtgtagtaatgtgaagattcatccacagctgccacttgtgcagccactgtggagataagtgtgccagttcttcaggaagctgacacttgttctacctcaagatctacttatatcatccagccatatacacaaaggatgctttgtcctgctacagagacatttgctcaaccatgtagattccagctttattcatcacagaaataattggaaacagagtagatgtctatcaacagatgaatggagaaaataggatacatctatacaatgaaatattcttcagccattaaaaatgaaatcacacacaatatgtactcactgataagtggatattagccccaaacctaggattcccaagatataagatacaatttgctaaacacatgaaactcaagaagaatgaagactgaagtatggacactatgcccctccttagaattgggaacaaaacacccatggaaggagttacagagacaaagtttggagctgagatgaaaggatggaccatgtagagaatgccatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagaacccaaggagctaaagggatctgcaaccctataggtggaacaacattatgaactaaccagtaccccgtagctcttgactctagctgcatatgtatcaaaagatggcctagtcggccatcactggaaagagaggcccattggacacgcaaattttatatgccccagtacaggggaacgccagggccaaaaagggggagtgagtgggtaggggagtaggggtgggtgggtatgggggacttttggtatagcattggaaatgtaaatgagctaaatacctaataaaaaatgggaaaaaaaagaaaatgaagcaaccctataggtggaacaacaatatgaactaaccagtaccccccagagctcatgtctctagctgcatatgtatcagaagatggcctagtcggccatcagtgtaaagagaggcccattggttgtgcaaactttatatgcctcaggacaggggaatgccagggccaagaagtgagagtgggtggataggggagtgggggggacggtatgggggacgtttggaatagcattggaaatgtaaatgaggaaaatacctaataaaattttttttaaaaataaaaaaaagtgaaatcataaaattcacagatgaaatgatggtgctagaaaataatcacccagaaagagataacccaggttgataatgacagatgtagtatatattcaaactgaaaaagacaaataaggcatatattcaattataggtggatagtatctgtacagtctttgataagaaagctattccatataaccacagatattaggtatagagtaagggactacaaggaaggagggatgtccctatgaagaaaaggtataatagctagtttaatataatataaaagtataataagaggtgtgggaatggaatgggaagatcaagtgggtatgaggagagcagacggggctgatggactgaatgaagggaggaacatctaaagctgagaggatttgaggtgccacatggaaacctaacacagtaaaacttcctaaaatatacacctgccattaggtcctacatgaaggcaacccaatggatttacaaatatcaaggatctattcaaaaagccttcttttgccaatgcattcaagtctacctactttctcttctatcagattgtgtatcttgcctaatacagaggtctttattaaattggagctatgggttttttgtttgtttgtttgtttgcttgcttgcttgcttgtttgtttgttttggattttgttcaagacaggctttctctgtatacctctggttgtcctagaactcactctgtagaccaggctggcctcaaatgcagaaatccacctgcctctgcctcccaagtgctgggattcaaggcatgcaccaccactgtctgtctggtgctaagttttgaaaaatatgtatctgtttgaattattctgtatgcagccatccaatttgactagcaccattcgttgatgttatctttttcccagtgagtatttttgaaaatcagttttctgaaggtgtgtagacttagtctaggtctttatttcagttcttctactcaacatgtcttttttgggtcaacatcatgatgattttaatacagatttatagtatagctggatatcagctataatgatgcccccccagcagttgtttcttccttcctttcttttttttttgatttctttttttattagatattttttatatacatttaaaatttcaaatgttatcccaaaagttctctataccctccccctgccctgctcctctacccactcactcccacttcttggccgtggcgttcccctgttctgggacatataaagtttgctagaccaagaccaaggggcctctcttcccaatgatggtcgactaagcaatcttctgctacatatgcagctagagacatgagctctaggggtactggttacttcatattgttgttccaactatagggttacagatcccttcagctccttgggtgttttcactagcttctccaatggggaccctgtgttccatcttatagatgactgtgagcatccatttttgtatttgccatgcactggcatagcctcatacgagacagctataccagagtcccttcatcaaaatcttgctggcacatgcgattagtgtctgggtttgatggctgattatgggatggatccctgggtgaggtagtctctggatagtccgtcttttcgttttagctccaatcctatatctgatagaggacttatatccaatatatacaaagagctcaagaagctggactccagaaattcaaataaccccattaaaaatggggtacagagctaaataaagaattctcaactgaggaataccaaatggctgagaatcacatgaaaaaatgttcaacatccttaatcatcagggaaatgcaaatcaaaacaaccttgagattccacctcacacgagtcagaataattaagataaaaaattcaggtgacagcagatgctggtgaggatgaagagaaagaggaacactcctccattgctggtgggattgcaagctggtgcaaccactctggaagtcagtctggaggttgctcagaaaattggacataatattactggaagatccagatatactactcctgggcatatactcagaagaagttccaactggtaataagaacacatactccactatgttcatagtagccttatttataatatccagaagctggaaagaacccaggtgtccctcaacagaagaatggatactgaaaatgtggtacatttacacagtggagtactactcagctattaaaaacaatgaatttatgaaattcttggacaaatggatgtatctggaggctatcatccttagtgaggtaacccaatcacaaaagaagtcattagatatgtattcactgataagtggatagtagcccagaaacatagaacacctgagatacaatttgcaaaacacaagaaaatcaagaagaaggaagaccaatgggtggatactttgttcctccttagaatagggaaataaatgctctttatttttttttaagatttaatttattttatgtatatgagtacactgtcttcagacacacagaaaagggtatcggatctattacatatgattgtgagacaccatgtggttgctgggaattgagcccaggacctctggaagaacagtcagtgatcttcactcttcagccattttccaggctaccacccagcaaacaagtttcagggccagttctaccatgttcatggtgtatgcccttggggccagttcccctgtaacccacacaaatagggccagctgtattgtgctgcccagatgagggacagagccaaccctcctgctctcatgaaccagaggccagctctcctgtctatcacaggtggtgaggggagaggtgggataggccatgtcttcatcatccttgcaatcataccacatagcaaactaatgacagagccagctcctctaccctcaaacccttggtcagctcacccacaactcacaaactaaggccagctctactgtgtttcctgggagaggaatgggcccattcttgagtttcacagctaatgataggctgggcctgctttcctgttctcatagctttggagtcagctcgtctatgatgaccatgtgagagatggggcctgttctacacagcccctagacatcaacatgtccccacatggcagccagagcaggaacatccacctgacctttggtggtatctgaaacagatccctactgctgcagggccacaaaccaagagaagaccctgggtgacagaatataccaagacctcatcatgaccttgggggtataccaggtatccacttcaggctctgcttcactatcctggactctccacttcctcctttactcattgtgcatgcatccttctgtttctctttctcttacatctctccacttgctcacttagtggcaccaaggaaatctgggtgtttgtgggttatctcagtagttctatgacaattttgtgcaatatggcatcatattggggggcatctcaggcttgccttgcctgcccaggccatgtggccctggtcagtggtgatcttgtgggagctttgcatgatgctaggctaagagtcatccctcctgaggcatgtagcaccaggtcaactccaattcttaaaattatgtatttatttacttatttttagaagattcattttatgtatatgagtacactgtcactttcttcagactcacaagaagaggacatcagatcccattacagatggttgtaagccaccatgggaattgaactttgaatctctagaaaagcagtcagtgctcttagcttctgaaagatctctccagtcttctctctctctctctctctctctctctctctctctctctctctctctctctctctctctctctctctctctctccctccctccctccctctctccattatttagtgttactgtagactgaagcccacatcactcattcactgtaaatcagcacgctgctgtgagaatctcgatttgcacattttaaatgatgaggttaaggagctatcctaactcatcttcagttagaaagggggattgagattgatcttgtactgaaacatgttaaaattacagacgcattgcattgagttctgagatagaacagcggtctactttctgactgactaaagactaaaatttaagaatttgggaaattaccccaaagaaagattcttctgaatgacaatagcccatgttagttttagccacattaaagatttatggaaatgaagttctttgagtaaaagatatcctaaattaccttgccttttttcttgcatcaggtgggaaggaaaaaaagagcacattgtagaatttgtatgtataaaaattcacttaattcacataggactgcttatctgtacttcccaaaacttttcactacaattcaagccacagccttctaactatggctgctttgcaattggcttcatggaaccacagatattctatagcagtgatgcagagacatgaagggaactgaggaaaggatcccaagactcctagtgcactgtgcattcgacaggggctcttttactgttagagaagagaattctctacagttgatttcttcaagaaagcaagatatttttgtaaatgtaggtaaatccctttccaatttctctccaaaattaagcagttccagttctagcgttgttgtttgtttgcttgtttgtttgtttgcttccattctggttccattagctgaatgtctactgcaaatattagccatatcttaacttctggttgagtattctaattagaatttatatatatatatatatatatatatatatatatatatatatatatgtacttaatcctataaattactatgatggtggtaattctttagtcacctagttcacaaataacttttaatatttcaaagcttaggccttgtctgggcagactctgaactagctcatctaagttaatgcaaacacttagccctgcccagccactgtggctagctataccttccagttgtgcagtcacatcagtctactctcatatctcctagtgaatggcacttattccttcttcgcagagttattttctcccttccagaaaggcctgctttctactttctgctcagctaatttgccatcgtatttttattaaaactaattgaagagtgccttaggaaggtgaggaaggacagagatataaggtcacatagtgtacttcaacatttatactttcaaagtgataaatacaccagatttctttttactccttcattagactgacttgagtaattatccttatttgctgattctacaatctcctataactatttctgagcccccataattctaaggaattcttcaaggaaaattttcataatcctagaggagtaactgctgccttctctgtcaattgtctttgctctggttagcctttttggtttttgtttgttgcaattatgttcctgaacatatgcaagactgtcttctcattaattaggttctcaactaaagaaaccttatatcaatatttcttggtcaatatacatgcacaaatacccaatataaacctacaacaattatcatctatagatgtgagaacaattggaagactctgttgattttaatgatattacttagatgtttggagtccaatgactgtcagatgatatagacttgctttggacggagaaactaaaacactccagcatataacccctggccctatcatcctccaacatacaaagaatagtctcacaacatcagaagacaagggttatactgaatcataagcttaaacctggaagactttcttttttgtctcatttttggtcaaaccaaaatacatatctatgcttagtcagagtatgcacaaaggagccctcacaaagtttgatatccttgacagaaagtgaggaggagacaaagacctaggattcctacttctgtgtactctaaggtcatgcagaagaacctcaagagatattctagatttgcttaaggatagcagaaatatgtgagtgtgtttatctgtgagatgcttctgagaacatgaaaaatcctatttctctcaatacgttttgatgttagagtggaattcatgctgttcttctgcttcaattcatctttgcatttacaatatacttaccagatattgatgtggtcatgaataacttgacttctcacctttatacatataataactgaaaaatcattgagcaattagtgagtcgctaatgccttaggactttgcagagctcacactactaattacaaactcatgctcaattaagcccctgaatcccctcaaccccagtatcacacaaaagtattcttcagagagctatcaagccctgttttcctcatgcttagggaacatagcgtaaccacattatttttttggactttctgactctaaagtggctaaaatgcttaaaatttggaaaatttcactctgtactataaggaagagatacaacatatcacatttacatgcatagtaacatgcaaatgtatatacacatacacacacatgtagtcatttgtgatataaactatgtaaaaagatacatataacatttataaaacatgaataaaactgtaattcataatgatagaaattaattcatagtagagcatccaaaattactgacaattatttttgtacctaaatatttaaattcattcacagttttataaatctggttttagaaacttgatttttttgattaaaaaatccattagttttatatgttgcatcatttatcttcataataaataaaaataattggacattagctatactaacacatgggaagtactttttacattgtcagatgctgaacaagttcgtgtctacaaatgatgtggaccaagagacatactggccacagacatgacatcaaaatctgaacaacaacaacaaaaaatcatgagggtgttatcatttctctaagataaccacagacaatgtctgaaggacaaattcgaagggcacatagagtccatggctatacatacacaaaagtcagtctgtgtaagccaaaccagaaaatcatgaaatgcaaagacaggtggggtgacagcaaggaaaagttgcaaacaacccttcctaagcaacacatgatgaagactagaatactaaaacaaacaaacaaacaaaaaaaccacagacatctagagagaacatgaataacaaggatagcaaatatgtcacagatgattggtgtaggtgctgccatcctgaataaagaaaataaagagtcttagagttataccatgtctccaaagtagtagcactagacatcgtgggagagcctgctttaattcattcattcaaaaaacgagaaagaaaccaattaattaaatgtcctttttactatacagaaccccaaactgtaatttaccattttttccccactacaacagactctagaactgctaagtgtaaaaacacaacaaaccattattaaatcacattgtcccaaataccaaatttagcacattctcttctatcatatatcatccttttacaaataggactgaagctgaagaagtacgtttactgtagtatgatcatacgacttgattagcagcaaacaaggtcccttaataattcccaattgatgggatgataagaagaaaaaagtctatgatttgtgatattgttctacttagatgactggaggaccatgggaaatcacaatacagaaaaaaaaaaagtgaagtattgttgtggccggccagcagctcacaagtctgggttctagcctgggaggcagcctggaatctggaagagaagagggagctaggcgagaaagatgaaaccaagacaaaggtctgatcaaggttcaattttactattccgtgcacgggttaagaagaagggggaggggccaattcccaccaaatcatccctggagtccagtttcaggtgaccacttgatagctccggaacacctaggtggcaggcagtagcagtgggagtggcagaacgatagggtggcaggctccacccccaagctctcttcttgataacagtgaaaccagatcagacaggtttcaggctgagggggggaggttacaaagtatgtttagaatgagtgaagggttgagctagtgagcacaatttatctaccttcatgcacctacaatttaagtactcattaagcttccataatgcttggatcaaaaagtttagacatagtttgcagaatctactacagcctaggtccaaagccacagatctcctataggtttctgtaactgtgccaatcagagggacagcttctcaagccaaaattgcagatttaataagagccaggaaacaaaaatgaatggtgccaggaaacaaaaatgaatggtgcaagtatatttatgcttttgacgaagagccagcatgagtacagtagccttatattcttgtacttttggcaattttcattttaattattgttggttacattctagaggagtttttttttaattttattttttactctttcactttacattctgctcattgccaccctcccagttgctccctcctacaatcctcctcctatcccccaaccccttctcctctgagcaggtgaggcatccaagtattccccaaccctggcatgtcatatctctgcaaggctaggcacttctctcccactgaggccagacaagccagcctagctagaagaaaatatcccacatacagacaacagcttttgggataaactgtgtttcaggtgttcaagtcccacatgatgaccaagctacacatctgatacatatttgtggagaggtctaggtccagcccatgcatgttctttggttggtggtttagactctgagagcctcaaggctctaggttagttgaatttgctggtatatcttcagagttactattcccttcaggtccagaatgcttcctcatatttttcctgtagatgtccggaagttccagctactgtttgctctaggttagtaatttgctggtatatcttcagagttactatccccttcaggtccagaatgtttccttatatttttcctgtaggtgtccagaagttccatctactgtttttctgtgtgtgtctgtatctctctgagtcagctgctgggtggagcctctcagaggacaacttgctcctgtctgcaagcataacagagtatcattcacagtggtgttagggattggtgcttacccatgtgatgcatctcaagttgggtcagttattggttggatattccataaatctctgcaccatccttcctccaaaccagtattttttgtaaacaggatacattttgagttgaaagtttagtggaagggttggtgtttgtactgatcaactgaggttcctgtctggctataggaggtggcctcttcagaatccatatccctaatgcagtgagtcacaggtaaggttatctttattgattcttgggtatctgccttatccgaggtctctgtctagacctggagatgccccctacctcctcacccccatcagttgcagatttccactcattttcatggccatctagccatcttgaaaagaaaaatctttaaagcaataatgttcttgtgcttatactcttatagaaaaattagtcatgcttctgaaacctggaacaagtttgcaacaaatttggagtaactctctaggcaatgtatcacacaaacagcatttgtatgtattgttcatacttatgtttgttccatgatccatttaataaaactttataagaattatagcatttgtcaataccttgtgtaataatgactgaccatatgaaagtcaagtgactacctggtaactattggaacatgcaaaattattatattatcatttttaatgtgctaaataatacttgatgtataaacagtgtaactctaagtcatgagtcaaaactcattctttgtccaatcctctatgaaaacttaatcccaatgatcttggcccaccttaattctcattcctttctttaatgccaatctaattatttaaaaatataaatcatttcaatcttagtaaacctgtatataatgtaattttttctgattccttttccactcattcctctaactcctctcaggttcactcctcaattatccaaactcttcttctttgaaagaaaacagaatccactgagtctaatttgtgctattctatctacactggcatatggcatccactagagcatagtcaacgtataagtagccatattcataaagaaaataaattctccctttccccatagctatcaactctcaatcgctcctcagctagaaattaagctcagcagctcctccactgtttttcatgtttaaatattgaccagcttgatcttgtacagatttaataaaataaacacgtttggtttgagtatattaatgcattagtcctgtatgagctcacaggacactgttttccttctttcttcctggcttctggctcttaaaaacctttctgtccctcttttgcaatgtcttctgagcattagagacaagggctgtgatatagacatcatttttatggccgagcatgctgcagatacttattctctaaacttcaactagtcatgaacttctgtactatatatcatcaactgtactaagaaccttctttgttgaatattgagagctgtcctaatctgtaactatttagatacaaatttagagggtggcttgatactttatctatgttagcaaaactgcttgaaaggcttcatccctgaggcacatgagttttgctcccataggtctttacagaacacatattacttcctactttggtatgagaagtaaatcgacatagaaaacggttgttaacacttattgccataacatgtgctttgctgctgctcttatgggcatatcttgttatgctgatcattactgtgtctcaaggagttcacacacagataagactattgatgactccctcaccccaagaagctgcataacacctccctagagtataaaagctagaattcagggagaaaactttcatgttagtgaaagattaatttctttatgtcccatttctagagagtgggctttcttcagaaatagggtctcactattgagttttgttgagcaacaaagaccaatagtaaggtattgtaatatttgggagaactccaggacacccgtggtcaacaactcaatgaagggcatctttactttaaaataaaacatctttcagagactgaaagagatggcagtgtatacaaagatctgttagaagatcaaacgcttaaggagttattcacgtgtgtgttcgtatttggtttactttcaaaggtttaataatattcttttctaatatttgtttaaaagatgaaaggccttttttctttgaggaccggctcttataacatcagaagacactatacaaattgccaggagagaagagtagtcagtaatcctaaacaattatgaagcctatgagctacaacaatgactggacttgcaaaatatgcacagtggacgctttttatcttgtgattaagcaacagctgtctaattgtacttaaagcctactcaataggagagtctctttcatgcattatcaaggaagctgctttttgcaacagattgagactatttacagagatctacaattggttaaaactacagagaataattgactttggggtacccaatacaccttaaaataaaatcccaatagctaactaaggcttggtgaaaatcaaagaagagaaaaaatttaaagtaaattttactggccagaggtagttgattttcaggctttctgcagagtaatctcaccccttcttgtttgtttgtttttgttgttgttgttgttgatttgatattttatttatttgcatttcaaatgttatcccctttcctggtttcccctctgctaatcgattatcccattgccctttactctgcttctatgagggtgctgccccaccaaactacccactcctgtctcacagccctagcatacactagggcatcaagccttcacaggaccaagggtctctccttccattgattccagataaggctgctacagctccttcagtctttcccctaactcctccattgaggtccctatgctcaatttgatggttggctgtgagcatctgcatctgtattggtcaagatctggcagagcatctcaggagacagctgtatcaggctcttgtcatcatgtacttcttggcatccacaatagtgtctgggtttggtgttggtatatggaatgggtccctaggtctctggatagctcttccttctgtcactgctccaatctttgtccctgtatttcctttagacaggagcaattctgggttaaaattttggagatgggtgggtgatcctatccctcaaccgtggtggtggggggcatgcctaacctctggcatatggtcttgacagattcaccctcccctttgcttagttctttccaatctctggctggatagttcaactcaggtgctctggccaactcctcttcaagctgactgattcaatctggtttctctcagtttctgattgaattgctctgtttggcttcagactaactctggcaatttgtcctgatcatctggcttcttcttattccctgatttcaaatgcctctgcagaccttcactgaactgcatgaactcactaaggaatgaagtcaactgcactgcactgcactcactgcactgactcccaactgactcaactccatcctcattgatgaactgctttctctctccatcaatgttcttaaatagcctttccactgaaagtttgtatcatttttcttacttattctgtcaaataattctctgatttatcactttggctacctctcaattagacatgattgtttgggattaaaggtatttactaaaggtttctagccagcggaattaaagatgtgctctaagagtgtgtttgcattccagacagatcacacagacttagttctttggatatgatcatagcatccatgttgttggattaaaatccctttacaaaagtgggaagattataaaagccagaggctgaggatgcctgcggctagaatgtgtcccctagacataacaggaaaataatatacccattaagtcttagcaaaatggttgcctgaacaagactggcatactgacaataccagttgatatgacgatggtgaaaattccttgttttctctttttaggtaaaaaccaaaaaaccacgaagcaaaactcaaacaaaaactgcaggtttgctaacacagtaagaaccagtttttcccagtgatgagatcccacatgggttcttcattcccaagggatcagctttatacacatataagcatttctaaatggactcagtatgtctgatatatacagatatatgcccctcaaacacaacctcatagacataaaaataacaattaatgaaaagatcatgaacttagcaatatattattttcaaaaattaaggtaaacctaaatgtgctaacatggaaagtaatttaatgtttttgtaattaattttttgtaataaaaatactagttgtgtccttgaaaggttaactttttattaatactaaagaacatagctctggctttccaatgactgaaataaaacagtatctttcatttctgctaattttctaggtatttagtatttatcacatgagtatgaatatttacatccttgtgtaagtctacatagttctcactctcagaactgccttagtgacctgaatttgctgctatattttctagtgtgggactcttcctgcttcctagctctttaccttaaatatgttttcaaaaaactgtaaagttattcctggattctgtgacagaaatgatgacttaattaatctcagaaaagatgaatttgccattttgattataagtacttttaaaaacttagcaatgcgagtttttttttttttttttttttttttggaccagataagatcataggcacaacattctaacttttataataataataacaccttatgagtttccatatataataatttcaccaacattaaaggttctttacctgtccagtctggtttatgtcattttagtgctttatgaaaaatatttactcatgaatttcatatcgtcaagactttctgcacagtaattaatcacttttctgtgcttggatttaacaaccttggtaaagttgtttatgatgttatattactattctgaatatactaaatcctagtctagggaggcaaaactttttcagcaaagtatattagttccttagtgctgtgataactcacaagcttagagcgttaaaacaccactagttcattacattctctgagtttggagtctgaaatctgtttcacttaagtcaaaatgtaaatgaaccttcttttatttcatttctttaggctttagggggaaatccattttctagactatagtggcattctccatttcatagcaaatggacccattctccatttccagagttgagttctgtttccatttttacattattgtctgaatctaataataaagggaatacagatcacttttatatcctaaaggacatgcagaacgggcagtcttttcttgaactgtgcatagatattgattttcaggtcccaggagatggggaccggaggtccatgaggattcaagatctgtcttctaaagaccagagggtgaaccattttaggacttgcacgtcagagtgtttctgtgaacattctttaacttggcaataaacagtttataagtattggatatgggtgtactacaataaaaatacattttaaaattgttgaaaattgtttttaatattcagcctataggttatatactaacaaccttttgcccctactaaatatatgacagctgttggggaattcaaacaatagtgtttagaatgaattagtgcttgtgagaattaatgaagttagagcaagggtctagagaaagtccctgcagatttttcgattcatttgtttgtttgtttgttcgtttgtttgttttgatattctagtgagaaacttctgagatacaacaattttctttattttagtcttttgtcctgacattggactttaatataggattaaccattatgctgaaatgtttcataattcttcagaacttatataggcatattcatgcatatgacaccttaaacgaccacaagcttcttctagtcagttgctgtaaggcgagttatacaagataacaataggaagaaattatggaattataattgacaaatttgctatcccttcacctccaaactttaaaagttaaagagcatcaacaccatgtcagaagtgtttgtagccatctttgtctcctcaaaagaaaacagaagcccagtgtttcaggggaagccgagtgagtgtcatcagcactcatcattctttgatccttgtcatgtgaatagattcatgatctgacatttgctattctagtcacaatggctcttgtctcagcaattcaatttcagtgtctcatgaatttaatacctgctctattatctgaagatttgtactaacttttacagctgaacattttccaaatttcctgttcatcctaacctttccacccctccatctgggtgggggtggggtgggggggctttgtgaaaaggcaagcctattcaacaaacttccaactagtaccatgcgtgtaagagcaaaaaatgtgactagacaccagatctgatatgtgtcagacattgacagcttcagttattcaatagagatggggaaataggcatcaataaaaaaagccatgggtacaatctcagcctcctcagaaactacctcagtgagaaaggttattatatgccctttcctccaatcatggatgacagaagtgtcctctaagggctaaaagcaaatttatcatttctttcaaaatctgagcttccttgggttaagattaactgcaagtcttagagtgtaacttgagaagcatttaatctttcaaaaaagtgtaggcaactaagacttaccttttctcactgatacacattctctcacatggatggtcaacatttttagcatcactccatgttaagtatatcttaattgggcagatttgaagactatgaagcttaatttccagaaaagcttaggcagagtgaatcttttcatgtatttggagtttgaattgtgttatcgatcacatagattcccccaagaattacaccttaagtactaaagaatatccatggaaacttaaactagacttcgcttacttcactgttgctatagctggagaatactttcaaaaaatttaagaaactaggatatttctataaaagcaggacttataagataaacatattaaacaatttcttaaagaaaataaagccatcattgtcatatttcatttttttagtttgattctggatcagtatttaaataacttagttggggtttagaatattttaaaaaaaattctccatagcaaggttaggtgatttctatctataatcacaacacttaagaggttaaggcaggaggattggtaggaattcacagctaccctgagctaaacaatgagacaatgtctcaaaatataaataccccacactttctaacacaatttaaaatcactttcaccaaatactataacccagaaactcacaagtcccacagaaagtagaaaaattattctcttcttgcctcttgcctttcttctaatataccttttccttccatcttccctcccttcctccctctccttaaaatttctcatcatatattttttttgagcctttagatgtgttctttctataatttcacttaacatgcattcaaatgtggtaatttctgctagctgccaactacatggaatcattcaaagtggcaactgtatagaatgataatgatttaaatgttttcttctcctctctactgtgttaagtaaagcatcttctcttacatttcatttatgttttcagaatggcagaaagtataattattcttgaaatctgagttttgttatctgtccacataggaacttagtcctgtgtaagaaacaattgatattatttactgttttctcttcttctcctccaattatgtttcatgtgacaattctgaaaactctactttttacttgtaaaataaagtgtctttccttgcctattatctccttggaacaatttggaatcatgttgtgctctcttgtacatatcatatttcacacacacacacacacacacacacacacacacacacacacacaccaaacacaaaataaaatgaaaaacatctataatatattatacatctgccattggctgctctgggctaacttgttcttgcttaattgtctaccatgccactaacttaggtgatactgatatacagttagtccttctctgtatttgattgaatagttctcccttttactaaggtattactctcccttgagtcctgtcatgtgaagagactcattcaggaaggaggttaaaaacaagaaaaagtacaaggcaaataaaatatgggaaatcaaaactccttccagtgcttaaaaatacacaatactgtagaaataattttattgtcaattctggcatgcatgctcaaacataagaaaagttaaaaccagtatattgttttatccattgcattaacatttaagatattaaatgcacttaatgaaggccattgtatttgaagtgcagtttatagtaaacattaaggcaaaatttgttttcctcttttattctagactggacaactggcttaggtagactggcacctaggggaaactatctccaagctacagacacatggaacgtttggaaatacattaaattctctgggaagttttgtacaaattgcctctctatttatacctctaaattgtgtattcccatgaactaaaaatgaaaacactatgcagagttgtgtacgtttaccaaggctgcactaatagcaacaggtcactttgtgtgcaattgagactttgaattgctgacagagacaacttaagagtgaaatgataaatgttgactgtttcaaatatttcagtgtatagcagtctggatccattgttattgattctgagagacaacagagcttgtgaaatagcaaaacatattacctcaggaatcacagagaataaaacaatccacaggggatgagcgtaagatatagaccctagactatgttcccaggggcttacttccttgagccaattctttctaatagtgacaaataattacaacttcacagatgaaattaatctactaatgaagaagaactcacacaactcattcgctcctttacttcagcactaggttttcatcacttgtacccttaaggggatattgcatatccaaattataacgtgcgttcagggagattctaattttgattatataatttactcaaaaaggttgtgaaaatattggtgcttactcaccacatacatcagtgtaagttcaccttaaatgcttctacttaaaatgtaaatgtgtattttaagcatttttttccttgaaataatatatatttctttcctcatataatatatcctgattacagtttcctctacttaactcttctcaatttcaccctatctccacttccatctggattccctcatttcctgtctgtagaggaaaaaagaaaaggcttgtaagggataatgataataataaataacaaaataaggtatactatggtaaaacaaaaactatcatactagatttggacaataaaaagagggtacccagggagtgttgggtatgagttcaatctcatggagtgggccttaatgcaaatcaaatattttttggttactcccacaaactctgtatcatccttgtcatagcatatcttgcaggcctggcactctcatagttagggttttactgctgtgaacagacaccatgaccaaggcaacacttataaggacaacattttgttgggcctggtctactgtttcagtccattatcatcaaggtgggagcatgacagagtccgggcaggcatggtacaggaggagctgagagttctacatctgttatgaaggcaaacagaagactggcttccaggaagcaaggatacggtcttaaattacacaatggcatacttccttcaactaggtcacaccaactccaacaaggccacacctattagtaatgccacttactggaacaagcatattcaaaccgttccagatatcactgttgatcaaagggtttatggctgacttgtttttatgtttctcctttggcagtgtgtagagttgatttcttttttttttttgttttgttttgttttttttttttttaattttttttccattttattaggcatttagctcatttacatttccaatgctataccaaaagtcccccatacaccccccactcccctacccacccactcccccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtgggtaggggagtgggtatgggggacttttgggatagcattagaaatgtaaatgaagaaaatacctaacaaacaaacaaacaaacaaagaaaaagaatgtaggggtaaagtgtctatgtagacactaactcattttctctatgtttaaggaataatttaagtgtactcttcatcaattgggctctgttgtcagtttttagagagaatcccatgtgtcttggcaacagcctgagttgtttgtggtttcccatgagaccccatttgtcagcaattcaattagacctaatacagtcctggtactgcaagctgtattggtggtaagggatggccagtttggactctgcctaccccatcatttgatgatttcatttagatcaccttcatatatgtatatattttaggaaggatctactgtattagctttccatactacccctcaaatggtccttaattatacctgtgtctccccatactctctcctttgctctccctcttcttccccatttgatccttccattccagtggcccctattcacccataaggacctattctaaattcattccctaatgaaatgcatctgtgctttctaatctcttactctgtgtctatcctcttgtgactatatgaattgtagcttgcttatcattaaattaatagcttacaccccaaattatgttaatgcataccacatttttctttctgggtctggtatgggatgatttctttttttttttttcttttttttttttttgtaattccattatttacctgcaagtttcattatgccattttctaaatggatacatgctcctctattgtgtaaatatgccacattgtcttcatctattcttctgttaaaggacatctaggtttctgccaactgctggatattatgaatagagcagtaatgaatatggttgagtgagtgtacctctataagcatcccttgggagtatgcccaagagtagtatagttggatcttgagataaaacaattctcaacttccgggagaaccaccacactaactttgatgtgcatcaaagctgagaactgctgctcttggactctcctgaatagtagacctaatcagtctcaaccgagctcatattagcagtcagtaaggaggtaacacctcaccacaaatggtgctacctgattatctttgccatgagtatgaactagcccaacagacaaaggtcaactgggtgaagtcattggctctctttgtaaacaatgtgactttcattctctttatgtgttttgcatggcatactcttctgtctccaactaatgcatgaattcttcaaattaatctaaaaactaagattttagcacatcaaattttaagaatttggctaaatgcttttaaaagagcagaggttacattttgtttaattccttagtttctgttgtcatgcatacattcgaactattttttgagtgatataatatgtccatttaactatttcttttactacagtgataaaaatcctcaggcaaatgggttattaatttaataaatgggaagtacacattaattatcatttgttatttttcacttagttcatttgatgcacatatttgtagggtaatattaaaaatataagaatatgacttcaaagtagtagtttctctaataaatcagtgggcatcttttacattactaacttttatgtagactaaatgatgtagcaaatactcttctggactgttatacaaactcatttactatttctcacacacttgtgtaagataagttttatttcatataacaattagggaaattggagacaataaagaagctggttaaattggcaaggccttggtttgacattgaccttagtttacttggcagctataataaaaatgccactaattgaactttgtaataatagtacacacatttatttcacacaattctggagactgaagtacttggcaacatctgtatttagagaagatttttgtcactatttttgccagatgtttgttccctataacctccatgtgttttatgtaatagtagtggttttgagatgcagtttttttttttttttatcagcacaaaacctgttctggtggctctatcctctggacttcatcattcttaaatatcccaggttcttttaccataactatgtggttagaatttcaacagaaaatttgtagaatatatatttgtaagattaaagaggctgcttaatggttaaaatgggtcaggcattgtagttacaccagaaagtctaatacttaagaagtggaataagaaagtcaggaggtcatcgtcattcagggttcatgttcaagtccagtctggactatatcagaccttgtttcaaaccatgaacaaatgaaagagaaaataagccctgaccccttgaaatagggcagtgagtataaaatctgacttagtaacctacagtacatattttacaacattctttttcattaaacatatttggaaattaatttagtgattgtagaaggactcttgtacatggtatcatcccagtttgctactttttcagatgagaagacaggatttaaagtaagatcagaaattgatcagagaacaaagataatcattgtgaaacataaaaatatagagtgaaaggaaaagcagaaggggaagaggattgatacagagataggctacaatagaggtgacctgaggtctcccgataacatgaatttggatgagtttggatgctaccacagatgtccataaaaatgtagaggatgatccagggctatttccggtgagaaaatagcctgctgcctccttcagctgacatgcaaatagcactttctgtttctaaagacttcttccagcactcagaaaataattctatctccactaattgcttcaagaacattaacaacaacaacaaaaagcaaatgtatatggcagggtttaatcaacaatacttggcaaaaatgtcctgtgtctaagtagtatagggaaatgtggaatctctacagttcctcctgggatggagacagttttgtgtgtggccagaatttttatattgctactcagaattgttttttgtaaagctccctgtctatttctaggattaaatataatacatacacacacacatatatgtgtgtatatatatatatacatatgcacatatattatatacacatgcatatattacctatgtgtatgtgtgtatacacacacacacacacacacacacacacacacacacatatatatattagataataccaagttgtttggcaaatagccatatctaatgaaattcttttcctacctcagtcataaaacaagatgtatatgtgtatgtgtatgtgtgtgtgtgtgtgtgtgtgtgtatatatatatatatatatatatatatatattaattttcagttttaattaccttacaaagtggcagatttcctaatgggattttcacacatatttatatatttggttgactctcatcacacttattccccttccctacatcttcctctctccacttccaggtaaacagaacacaattttccatgagtgtgaagggattgtttttaaaagtataacattcagataatggacaaactggtacactagtgaatggagagtataatcctggaagaaacagattaaaacctaaggtggcttatgattagagcatagatgttgtaatctagaaaaaaatataagttgaggattgtaatgatttatttttggtaaatacatatggatttttataaaaggatctgtgacataatattatatttttctcatttctatttattccaatttccttgtttttcctcactaaaactccacaagactggtgcagaaaggcaatgttccctcttatacacatttagaatttgtgtcaatttgtagactatctcatctaaggatccgtgataagtacacagccaattttgttattaaataatgtccagaatactacacacagatttccaggagttactttatttatttgtttatttattcattcatttattcattcattcattcattcattcattcattcattcatttatttatttgcagtaaatgttctccagtaaattgcaatgctcattcctaatacagagacacctaggcagaatgttgactgatagtttctaagaattctatcttaaaagactctggacaaaatgttagtcagcaaataactacaggaaccaattttagtgtccagaaatgaaaagaatttagagggctgtggccagtgctgaattttcatacagcgtcagctctagtcatttgttcttgacacccacattaacaggtcatgctcacatagctcactctccacctttttgttcaagattccgagaggcctgactttcccatctgaaagctggctctctgtaagaggaatgtatgaaattataatagaatcccaaaaagcctgttgtcttcataagacctttgacaatataacttcaaaccgtaatttggagaagacagaatctttcaagccatggatgagagatctgtacaatcctctcaggaatgctgatttaactacaccaagcccattgtcatctgcatgtggaatgtgttcatcaaggtctcataagtggagtcacaataaaatagtatgtcttgagattctgtcccgagattctgagccctccactgaactaggaatggatgtgtggaatgtacaaattaaaactgaatctttgttaaattacaatgatattgttttttatttaataagtcacttaatgaagtatgattgccaaagtgctaatgagtctgagaatgtccttgaacttctgaccttcctgcctctgagtgctaggcttagaaggatgtgtttctacaccaagaatttttattactagtaatattattcaggattcttacatacttatgaagccctctaccaacgaagttacagttatattcagtgtcaagttttaagtattttgtttaatttttcattctagtttttcacaattatttataatatgcaaatctccatgtgtgagtttctccattttcaaaaattcaatctcagttctattttttgtctactgagtaattttgaaatccataaattcatattaatgtttaacaatgatgtaacataaattaatacttcatggtgacacagcttctgatatgattttactattatttggttttcataaatttcatgtagcctttattatagataacagatcagttaaacttctcagtttttagtgttgagagcaccatggaattgaaataacaataaagatggagcaataagacgttataaataggcctgtggccccagtgcaccccaagtccaatctccagggtcaagctatgatttgttttccaaaaagacaaagaagaccatagtgatacttaaaacagagttggcaatggtgaggcatctcaaatggatcccagtaggggaattctagagctcttctgactgcattctaggaccctatttattctatttactattgagtaacaaggctttgaatttagagtggttgaattatttaagctattttgattaggttaagggaatgtttttcatactttttatgttcttaatttaatctgaaatttaaaaactaatgtcatagtagttacatgtttgcaatacatagaaacttagtcctggacctgctgaaatgaaacccttccccaccccacccccagttcttatggataaaagaggcagatgttgacttctgtggccagactccatgtttgatcctcaaacacagggattctaaaatacaatagtaatgcaacacaatcaaactgtctaaggcctttgtctatattcatttcctgaaatggtgtaacaaaattaattgtaatgagtgacatctaggtcatacctggtatcataacattattttatttcataatacatgaagcagcctgacagaggaaaggaaatgaaagaaaaccttgttttctacatgttcaagatgaaaactttacctttatttccatattgtatagttggtggccaatggatagtatgaagaatatactttttttgtaaagctgttaaaagtaaacataaataaataaataaataaataaataaataaatagactgctgtggtaaatctcctcccaaatatgccccagcaatgaaaacatgacataattaatatgaatacatgctatgtgcctagatagggcagatctactgctacactaccatcttccacctctatgagaccccttagatcttgtggtttctccaggccatgtgctttggctctgctttacttcttcctccttctctccactctatctctctaacctccttcttttcttgacttttcactccaccttctctccctctgcccaatcatcagctctcctttattttacaaagatgggaagaaggtttacaagaaatcacctgagtgctgagttgttccttgttcacaacccctcacaggagaatggaattggcatcaaatataattagcccaagggctatccacagcactttctcctttctgtccaattaaaaaactattttatctcagacattattgaacataactattactattttgtaacttataaagtacaagaggcctaacacccagtccatcatctttgttaattaaacagaacatctgtcatctctccttacttaaaagacttacaattctacatctgggtatgtcttagctttagatagaatgctcttagaaaacaattctctcaaaattgttcctctcaaagcaaaaagcctgggtcacctaggagacgatctagtttttgaaccctatcagaaatctaagaatgactgatattaacttaatatatataggaaacctaacacagcttccaaaacttagccaatttatagagacgggtgatcacttggacagtcccttacttcaacatgttggaacatcggtcttcagcctactgaagtctgtcagggtcatctgacagacttagagaaacaggaatattaagtactagtctactctgtcttggcagaatcaagctgttctaaactgcaattgtgtccccttggacagtcttatgtctgtagatgaaatgaggcaattcttgcctagtgactgttttgccacaactggagtaactcacagatgctcaggttcttctttgaatccaagacagggaaagctgtcaggagcagactagtctcaacaagtgaataaatagcattaaaagtcacatactgtggacttctgacatttttgaaaaccaactatctatctaaagtaatctagactggtctctgttacctactcttggccatttctgaataaaataactgaaaacactctaacaataaactttaagtcatgaatttcctatttgacccttaactcacgggcttaaacatctcagatctgtttataataacagcaatagaaggactgggtctaagccttgtacttcaaaatttttagtatcaaagacaatctataaaaccactcccagcgccaaagcctagggaactaggatgaagacgcttcataacttcttcaagctgaatatgggcattgagatatttctgaagacaggggaaaggtagggaatatggggaaatccattggccttaagaagactacaccaacagagaaacctacatggtgcatttctctgatattatatgtatagagacaattttttctcatataacaaatgctacctgtatttgcatagatctctgagttctcgctaatgctctcaatcattttggtcatagacatgtattacttagcatgttttctgttgtatgactgactgagaagttgaaggacatgctgctggcataaagccatagatatctccttgttcccttacttcaaagaatatataaggaaagacaaagcaaacatgatatctggaaccattgtcttacaaagtgagtagtgctatgatagtggcccgagacttgtgattttatcaatattaattacaactggagactcacctctgaatgctattaaaatataatgtacaggtatacattttcgatccacaaacttttaggagacatatgtagactgaaaaaattagcacagagttttcccgtggagaaataaaataagatagaaaacaaaagtatatttacattattaaaattgctattgtagagttagcttcaactctacctttaaaacataaatgaatggtatagtactgaaaataagaaggatgcttagagcacgcaactctgcagctacatctatagctgcaaccctggtaagatttcttgtcattcttcttctttgcttgttatgacatttcaagatgtagtaggaagataaagtccttgtggcttagtggatgctttattcctgtctaatggataactgcgaagtatgcacatatgcacagtactcacaggtttgaatatagcaatcctggacatagatgaagcatttcttaggatgatataatgaggagaacaggcctaccaaatcacatgcaaattttcattctaaatagatggaaaaaaatcatcagattgggaatactctgaagttcagagaaagcaggaatttctgtccatttagaggggtcataatagcctatgttgacaagatgggttctttctctttctctctttctctttcctccttccaccaactgcttcttccatcacctctcaactcctcctgttgctgcttgctgttactaatattactaccactactactactactactactaacactaccaccaccactactactactatttagaggctttttttgttgttgttgttgttgctgttcatctattttctttattttcctttttcttcctctctctcttttttcgtccatctattttctaaatgtctgtcaaagcttttagaaaatcctcatctaatgatagattataacagtacaactgcaaagttggtggcctctgggatatgtagaccaagcaattttttttctagccccctatccacatgccttcttactttactttctggaaagtttatggtttggacaagattcctctcaggggagcttttaattgagctgtatcatgaaaattatgtttcaaatctcaatgtaaaacaaaaataatcagatttttatagaaagggacatttcaaagcaattttattttataaagatctttaattactacctttgtaaatggcttagcactggcatatgccgagatttgttgacctttcagtaaagaggccgatttttgctccatcagatggtagaatggtttaatggaaaaacctacacaggatacatcttgttttttttttttttctctcggtttctgtctctttgtgtttttgtgtatgtctctgttatgtgtggatgtatgtgtcatgtgtgtatggcatgtatgtgtgtctgtgtgttatgtgtgtgtttgaacatgcatatggatacatatattttgaaggtagaaactccctctgaaaatattttccctggaaagagtcgcatgacctgtgaacattggtctttgatagcttaaaattttgttccacagatgctcttctgatgacctagctgtctatttaaactacttagacactcagatagttttcaactatttcttaaagatatatttattctgttgtatgtgtattaatcttctgcctgcatatatgcttgtataaaaatcttgtgttcgatgcccacagaggtcagaataggaattcaaacacactagaactagagatatggatagttggatgccacagtgtcggttctgggaattaaaccaaagtcctctgcaagagcagtaagtaatttaatccaccaaatcatctcttttgtcctgatatcaataattcttaaaaataaaaataacaatgttcatcatataagctatcttgaactatatgtggatttggcataaaaatgaaaccaacaataatacaaatgaaaatataataaaagtgatattttatagatatgaattatttaaagatgtacactgattttgaactaattattattatatagattttatagttcagaatattctgttctgaaagggtaatttctcctgccttattgaatcactattctaaggtcatctttctagagaaagaaagagctcaaacaccttgctctaacaatcactaaatatattacaagtgagacttcttattattccatcatattagatagcaactaatccttttataaaaccaaattttaaatcagggaccaataacatgctcagtgcataaaagcatcagtctcacatggtatgtgcctctctaccctcacaagataaatacaataaaatcacttttttaaaaaaaatcaaattagcacttttttgtttacctctcagtatgatgtgtttctatgaattcccttgtgacacgacttgtaaacatcaatggcttaggtcataattctctggagatttatgatttaatttcaagtatttatattacaacatagtatgttttctgtacccatagacaaggagaaggatgtgcatacagtttatatagataatatcatctgtagaaacacatacaggtatcctgatttttctcaagccctacttttaaagtttgcattatgaggttgcatctaaaagtataggttagttatttcccttttctatggactgccccttccttccatactaatttagtaagtatatcatgaagttcataacacatacgatttcaacattgaactatttgccttattccagacaatatgacaatgttgtatctgtttcttcatctgggaaacattttggaaaaacagctctttgtgtgtttgtgtgtagctttttatttgagagcttagccaaaataacacaaaacaattcaccatcaaagtttctggaaaaaaaatcaatgaacagtttacctccctgtctttgctctctgaattttattgtatatcaaaattgccttatttctatgaaaaatggggatgcattatttccattactttcactatcttgcaggtaatatttcaagttgcatggaggatattggatactcagagcttacctggcctcatcctttactgatttatgcatttattcatctttaattttatatagtcttcaagaagaatggggcatatctatatgtactgacatgagggaatgttcaggaatcatattaacttggaaaagaagattgctagtgtttttctttcacaaaacacaaaataaaacaattccacttacatttgtgtatgtgtagattaattagaaggatctgtactaagctattggcagtgattacctggggtaagaaaaattacatcactatatgagcagagaggacaatatgagtaaatctgttgtgtatgatattttttgtgttcagtttttccctaaaatgaaatcactggttattagaaataagcacgctgtagcatctttctaattacaaaatacaggcctgtatagagaccctctcacacttccctacgtgaacccagctaactctctattgagcctctcatctttgatacatattgtagccctatgcatcactcttaactctgagctcaaagtgctatgtgagatttcacagcattagctcatgactgccatgagcttgcctaacttgcctactttatgactgtcaatcgtcggtcaaagctgcagacctttggaaacactgggcccacctgtaaaacttaccattcccatggtggcatgcaagaaagtgagccatctgtactagagaacataactgacagacagtcccactcactgtttttcctatctattgtagaatttgctgtttgaatgttttccagaggctgcttacagccaaggccttgtatcagctcagatccgttcctatgactctcagaatggctctatgtggaacctcacacatgaactccccaccagctctctgaatcattcttggaattacagataaaggcatgcttttccgtcatgaatttttccaccctagcattggcctttagttttttcaagtatctcatcctttcagtagcttctgaagcctcttctttccttgacctgctcactagaagtttgtctttataatttttttccagcacaatccttatatatcttttgagattgttatttggttcctaattcagctataaagatgcctttatgccatacatacaaatatatccatatatgaaaagttgtcacatccaatattttcttatatcaatcttctagtttaaaacatagacttagaaaaatattatgttaatgcttttgtgtttagcatttggttcagtttggtacttagtgggttttataatgaattttgaatacatgaaaactaaaagtataatcttatctagtatgaatacattcaggtcaaaatgagacaatctgcccacttttcaggaagtgctaccagtctatttgaagacatctatgtgtcagcttaataccacaagcgagctccaagctatgttctaagacactgttgttgagcttccccatgcccaaaatattttactgagttcaagtgagttttcacgctcatgatcttaatttatccaaactttaaaagcctaaaatatcactgaatctctctcattactaaaagaaacagccttgattaatcactttaagcatttcaaaataatctaccagttaacctatatttaacataagcatgtgtaaaatttatatgtgactattcattgggagaatagtatattcttggagagcactaaaatcaagttgcatttcttaatccttcaaagaagtaataagatttagaatgttcctttttattactatgcagttgtaaactgtttttcagatagatatagatggatagagatatcgagataaattattataattactattgtgttattcaattctaatcttatattgtaatgaaggaaataaatataagaatgctttctctgttaccattaaagctagtacaccatagactgttttttttaaaaacaaatattctactcacctctctacatttactttgttagatgcacgttaatctggaaggtagttgctcacaattcagttgtcttgagcttggaaccatctgggaatgctgaaaaagtctgttttctcagcaaagcttagaacgtttttctaataatccttgtagttttgctttgaatgcaagttcgagtcactcaaattttaaggcagcagaaagaggtacatgagtttgaaaaatcatgtcagaagttggcactatggaaaatgtacatggtgataggtaagactatcaaagagaaacatctaggagacatgttctgaaggctctgtaggatatgactacagcctggagttgtaggcaaggcaagggcaagaagtctcaagtggaattttaagttcaacatttcataagtgtgggcctttgataaaggacacagcctcacatataaatttcttcctgtgtaaaggaaaaatctgcttcaaggagtgggagttttaattaataatacactctagtaggcactatgtttttttttatcagctttttgcagaatcatttgacttgtatccaataacagactcaatacttacatatgatcacactcagttttacgactagaaaaattaaggcaccatgaagtgaagtaaaaaacaaaacgtggttctgtgctatctgaaaattattgacagtccaggacgaaatatacacttgatataaagtagggaatttctaaatgactataaacaacctcaaaaataatgttcttgagagatggtaccaactctctcatttttgtgccaggatattctgatgaaattttgtactatgaatgataccaactgattggatgctcacagacctggcacaggtgtatttcttggagatggccattcagtggtaaagtaagaagcctctagctccatgataatttccctctgctaaaatagatagcgcactgacaagatgcatgaatggaatgaactgaattggcagtgtttgtaagtcatgcttggtaaatttatttttagaattatttactcagaaatatcacacaggaacagagatctgtagtctttccttgcttccttgtcttttcagagagaactaaaaaagcaacctggctttattgaactctaaagtatcaggtgcagctaacgacagactgtctttttttctctctctatttttggtcattttttctctactactaatttagagtcctaattatagtgatgcattaatatgtgaaaatggatgagtctgtgaataattaaaaacatccacttgtttttatgctattcatccataaatgtaaattcatttctgaaggaaaaaaagtgaatattgaagagtgaatttcaaacagacatatgtgccagggttttagttgcatgaaaaggaagtaatgatttgaaagtgattcttggtagttatttataacaattgggaatagatatttttattggtgcttacttacctaagcaccaatactaaagaaaagttttgaatttcagaagtgttattttaacaactatttataaaattgaacctcatttatgattcatatcattttttaaagagcattaatgttcaatgcaatatcatcattcagtttataacataacattatgtatcatgaaacctcttttcttatgctcatagctaaactttttacataggcacacaaagcatatatacaatcatcaaatatgctgtctttgaactttgctttttagaatttttctataactcttcacgaataagcaaatgtcattttcacacttgatgataatttgttgaattgccccagtcctgtatggccacctaacctttccatttcaatagagttatatgtaattttgctagttccttgttgttaagtcagagcatgcatttgcaaaatagcctcattacactggagtattttataatctgagaagtcgaaatgcatacatttaaataattctgcctgttaagttacaaagatgtaggaactagggaagtcatgagaatcagagatacttagtgagaataatggtgtatttcaggtagacactttagagctgtgattgcagtcttgtcatctgagaacaagtacataattcccttttgtctttgtatcaatctgtctcatctctacatgtttagctgttctatgtttatttacctaaaaaagaaaacatctttgttttccaaactaaccactgacatttccaaactaatctagacaacacagaagcatgatgaatcatacagtatgctttccaataattaatccctggacatgtctgtatcaggcacatgctatccactactgtgatcataaaagtaagggaggtggtatataatcaaatctctataatgacagcactctaaaacacttctcagtttgttgtcaggcaaagtgaaatacctgaggattctatcattctgcattcagacctcttccgtgtgacagtttagaattgttatggggcctgcactcaagtggagaaaggtcaggggaagattaggttttcttcctgccaacctggttgtatatcatgaggaaacaaactgtcacaattggaggaagacacaatcctattcatttttctttatcggatttttccaatgtactatggcaactaagagaacattctcaagtgatccttttaaagtgacaacagacaaagaatgctcagattgcatcgatccttgtcattagtattttattatagtgaattactgcagtcactctccaacattccaaggtctcagttcacaaaagtgattacaaacaagatgagttactggggagagtcagggctctagaactattatttataataaagaagccaacattgcaaagatcttaccagggttttagagaatttgtttggatgccattgttaggcttctaaatattctggtaattttctatgagatatgacatgtttggttttgttttttttttgaatgcttattgatggcaaatgatatatatctgttgaattaatatttgcttttgtaatacagagctatttagcatagtatatgttaatcccactgatgaaagcagaaagactactgacccaaatcatggccaaattaattatagcaagcttttttaaaaattttttattaggtattttcctcatttacatttccaatgctatcccaaaagtcccccataccctaccccccactcccctacacacccactgtgacttcttggccctggcgttcccctgtactgaggcaaataaagtgtgcatgaccaatgggcttctctttccactgatggccgactaggctgtcttctgctacatatgtagctagagacacaagctccaggggacactggttagttcatattgttgttccacctatagggttgcagatccctttagctccttggatactttctctagctcctccgttggggccctgtgatccatccaatagctgactgtgagcatccacttctgtgtttgctaggccccagcatagtctcacaagagacagctatatcagggtcctttcagcaaaatcttgctagtgtatgcaatggtgtgtgcatttgggggctaattatgggatggatccctggatatggtagtctctagatggtccatccttttgtctcagcacctcatggtaccttctccaaaattgaccatataattggtcacaaaacaggcctcaacagatacaaaattattgaaattgtcccatgcatcctatcagatcaccatggactaaggctaatcttcaataacaacataaataatagaaagccaacattcacgtggaaactgagcaacactcttctcaatgataccttggtcaaggaaggaataaagaaagaaattaaagactttttagagtttaatgaaaatgaagccacaacatacccaaacttatgggacacaatgaaaacatttctaagacggaaactcatagctctgagtgcctccaaaaagaaactagagagagcacacactagcagcttgacaacacccctaaaagctctagaacaaaaggaagcaaattcacccaagaggagtagatagcagcaaataatcaaactcaggggcgaaatcaaccaagtggaaacaagaagaactattcaaagaatcaaccaaatgaggaactggttctttgagaaaatcaacaagatagataaacacttagccagacttaccagagggcacagggacagcatcctaattaacaaaatcagaaatgaaaagggagatataacaacagatcctgaagaaattcaaaacaccatcagatccttctacaaaaggctacagtcaacaaaactggaaaacctggatgaaatggacaaatttctagacagataccaggtaccaaagttaaaccaggattaagttaatgatctaaacagtcccatgtgccctaaagaaatagaagcagtcattaatagtcttccaaccaaaaaaagcccaggagtagatgagttccgagttttatcaaaccttcaaagaagatctaattccagttctgcacaaaatattccacaaaacagaagcaggaggtactctacccaatttattctatgaagccacaattactctgatacctaaaccacagaaagatccaacaaagatagagaacttcagaccaatttcccttatgaatatcaattcaaaaatactcaataaaattctcgctaaccgaatagcaagcttttttattcttctataggaatttctctcccaaagtcagggtgtaagagatcatcactggacataggggaaataaaggcttttatagatcaggagtagggcaaacaggtgatttggcaggcaaataagcagaacataagcatagcaagttggtcataataacctctggggaaaatgcagagttacaaggtggttatagaaaggtagctattgcaaggtggacataacagcttttgaaacaaaggcatggtatctcctgaaaaaaggcagtacagaaacacttatagttaaagttactggtaggcaaatggatggacctggagggcatcatccttagggaggtaacccaatcacaaaggaattcgcacaatatatactcactgataagtggatattagcccagaaacttaggatacccaagatataagatacaatttgctaaacacatgaaattcaagaagaacgaagaccaaagtgtggacactttgccccttcttagaaatggaacaaaacacccatggaaggagttacagagacaaaatttggagctgtgacgaaaggatggaccatctagtgattgccatatgcagggatccatcccataatcagcttccaaatgctgacaccattgcatacactagcaagaatttgctgaaaggacccagatatagctgtctcttgtgagactatgccagggcctagcaaacacagaagtggatgatcacagtcagctactggatggatcacacggcccccaatggaggagctagagaaattacccaaggagctaaagggaactgcaaccctataggtggaacaacaatatgaactagccagtaccccggagctcttgtctctagctgcatatgtatcaaaagatggcctagtcggccatcactgcaaagaaaggcccattggacttgcaagctttatatgccccagtacaggggaaccccagggccaaaaagggggagtgggtgggtaggggattgggggggtgggtatgggggaattttgggatagcattgaaaatgtaaacgaggaaaatacctaataaaaaataaattaaaaaaataaaattaaaaaaaaagaatgaaaatattgccagaattaaatcatgtcaattcaacctcatttatgttattatattaacaagattatagcacattttctagcctccaccagtggtaaaaatgcttaggtatcatagtgcatagtctttttgtattaactggtcctcaaaggtataaataaaatcagtctaaaagtttaataaaaatgttccttaaaatcaaaaaaaaaagttactggtaggatatagctaaatctttctgaaacattttaaattcataaatagatgtgaatccaaataggaatgaatatagtttgtttttactataatatgggtttgaagcccaagatagagaaagggtggtttatcacatactcattccactgttcactttttgtggacatgttaattattctctcagttccttgtcttccaggtttagatggagataatgattcctaattccattggaatatttaagaactaggtattgatacatggaatgagctaagagttcaatctaatcaataactatttaaattattacataatatgtcatcttgttaattttattaatagactacatcctgtgattttatatatggcaatatatgtcatctattttacatgttaatgttgcttatcatattgaaaagtagatacttaatcatagtctgaaagccaatatttaatattacatgccccactaatgttacaagtttatgtgagatgtctaaaaatgttttaaagctaagctttcatccttctgtgtacagggtatacttttatcaagaatgaggtttttcatatctgagctatatattcaatttgttctgtttcatttagaggatttttagtattcaagtcctattttatagtgtgactccactttattggctcaggtcccataaaaatgacagataatatgtcactgtaatcattacagttctgtggctaaggatctataatataactcagaaggatgtctgtatgtaaaacatggcaggtctgtgccctgaaatctattctcttggaaaaagaacgtattattcagtgatttggagatacaattctcacaatgacattttcccccctccagttggtcagtctttctctgtctcaggcatatggggctagggatagtctattatgtgacaacagaaacagatattaataaaggagaaggaccttacacagttgacatcaaaggagctgtaatacctggtgcactatcacttatcagttacttagtattctaatgactttcttcatcaaattagtttagttaattctcaaccacatgagagggataattcaagtcactggagactggagacatggaaggtaaaaacaaaaacaaaaaattaacagaattttatcccccttccagtgtaccctctgactattccccatcccataatcctccctgcctccctgtttccatgaggatgtccccactccccaccccctacccctcaacccactggacctttaatctccctggggccccagtatcttgagggttaggtgtatcttctctgactgaacctagacccagatgtcctctgctatatgtatgagaaatcttggaggtccagattaattgagactgttggtcttcctactgagtcgccttccttctcagcttttttcagccgtccataattcaatcacaggggtcagcagcttctgtccattggtggagtgcaaatatctgcatctgcatctgcctctttcagttgcttgggtctttcagatggcagtcacattagatctctgtttgtgagtgctcttcagcctctgggttcacaatgtgattcactgtccaattccatataacaagaaaggaaagagaaaccttggaagtgactgaaaatagaacctgcctggagaagaaaagttgagagaacagagtcctagatacaagtgaaaactgtttagttaggaactgtttacaattcctgctatgcaaatctatcactattaactaaatggctgatttgctgtatttagttcctacaattttaagagttgtattattaccatgatggtttacaatataaataatgaaataattcttttcctactctatcttaacactcaaacagcacaacactacttacctaatttccacctattgcccacatattttcatgagcaatatctgtctaaataaaaaagatatttgtggaaatgtagatgagattgatattaatttttatagacagcttcaggaacggaagaaggaagggaggaatggtgggaaggagacagagtttgatttattgtaattgggaatatgaaaaagaatgggatttcagaccaaagagcagaacaagcagcatgaggaatgacaagtgagccttgtttaagactgatgaatggcagacaggtgctagttgtcttttgagacacttcacccagcaggtgactcagacagatgcagacacccccagccaaacagtggatggactcttatggaagaaccagaggaaagatcgagggcctgaaggaggttggaactacagaggaagaccaacagttaactaatttggactcttgaggactctgagacctcaaccacaaaccaaagatcatatactcagggctccctatgcagatgtagcagatgtgaagcttggtcttcatgtcactcctaaagaactggaatgggggttattccaaaagttgttgcctacacatggtatatgttcctctatctgggcagtcttgtctatcttcagtgggaggggaagtgcctaacctagccttgcatagacttgaattgccagggttgggggttactcagggtccccacctactcaaaggacaagagaaggggaacatgggcaaatgactatggtaggggatgactgggagggacagtgagcgggatgtaaagtgaataagtaaaaaaataaaataaaataaaataaattaaataagaaaagaagccaggcgaggtggcacacgcctttaatcccagaacttgggaggcagaggcaggcaaatatctgagttcaaggacagcctggtctacagagtgagttccaagacagccagggttacacagagaaaccctgtctccaaaaaaagcaaaaccaaaccaaaccaaccaaccaaccaaaacaaaagaaagaaaaaaaaaaacagaaaaagaaagaagagaaagaaacatagacagacagacagacagacacactcactacacacacacacacacacacacacacacacacacacacacacacacagagtcagtcactggagagacgtaagaaaggaaaattaaggatgagggatgagttcctttgactaaaatagtgttcacaagaagagagaagtaacaatggtgtgacttgttttctccttaggaaaatagtgctcagcaatatatttaaaagtcttgataaaggaagatattttacagaagcaagtattatgtttgtgtacataactatcctcttgtaatcttgaaaaagcctcaagtatgaagcagcacacacagacacacacacatacacacacaggttttattttcaaatagttttgctgaagtttcttactaacttccttaagattaatgtcatatttaaatattctctttttcctagaaatgattcacttgatggcatgcctgtttgtttacccagagagagtggagctgaggaagttggagcttccattgacactctaaactcatgtgagtataacttgaacagcatatttaagaaataaagagaatcatctcatgtgatttgcaaagagtcttgggaatgaaaatatttgagaattagcatggttatttgctgagtactggaccttggccatcctgttgctagggagttgggtgagattgtaaacccctatgaggagaactttgaagcagtctctctcacagctttccaggataataacctgtagtctcaggtctcagcaaacaaagcaaccttctttcacttcaatatcctcttcagtctctcctctctctctctctctctccatattatgtatctatctatctatccatcaatctatcatatatatatatatatatatatatatatatatatatatatatatatatatatacacacacacacacacacacacacacatatacacacacattagtgtcttgtgaatttgcatttatctaaagagctgacagtaatttgtcaatacacagtgaaatccaagggaatgaatgactttgttttgctttgtgtgtatttccagttcttcaaacagtgtctaaactgtgacagatcatcctggctgttggcacatatctgtaatcccagtacagagaaaggtgggacaaaaggattgcagcaagaccaagggcatcctgggctatattctgagttctgacatagcctaggctgcagtgtgaaaccatttcgcactttaatatccagataaataaatagagaaataattaaacaaagaagtagtggcatctcaaatattattttgacaattttaggctttcatcccatttctattctatttgactgttaaaatttaccttgaaacactgcttaaattctactcagaagtgtaacaatttataaaaattttcccctgtgttcaacttagagcaatgtttcaagtttgcttgtttgtcttttatcataatttattcacatcacttctacatttcagccctttctaatcagggaaattaatttagctattttgctagtctcactaactgttggataagagtttaacttatcaataattattagtcactttaattgctatctttaggtaataaaagggtctctggcatatttccaaccatatcagtattatctttgataaaatattcggctcctgaaatgaaaatttggctatttcatagggcagcgtactgtaagcagtcttatatatatatatatataagcagtcttgaaattactttaaaaaattaagttctatattgaagaaattatactattctgtatattattatataaccatttgtggtctattatcaaataattaaatgtatttgttaattcaaatgatgtatatacatatacacaaatccatacttttaatcttggttagttcaatgtgctattagatttttacaatacttaccaatttgatttctgaatatacatgtcttgtgtgtgtatatgcatgcaactttaataaaatcccatgtaaataaataagtgaactgtaactcctgtgagtcaacacaatcagagaagaaacaaacatagggtttaaggtgaatctaatgattttgctgaagacagatatgtaggaaaatatctgggagcagaaatctaacaaattagttgtagccacttaaaactgagtggccattgattaagtcattgtgaaggaaataaaatcctcttgcagtctctttatgtttctaataaaggcaactaatactacataaaataagacacttacaaagtgtttcaagattctggataatcagtcctgcctttatgtaatccttccctgctttccagatttgctggtcaaatttacttgttctttccagttcttccacctcctcttcctcctcctcttcctcttatttttaggtgtttggttatgactgcttagcaccagacagactttgtggggggctttttcctcgataaaatcaattcttctttcttatgctctcatcacccccttgattgcctgttgttcttcaggtggggctttgtaaaattttcctcatccacattggcatacagtctgatgctgttgttatacagacattgtttaataaactgaatgctgaggttttataaacacagctaccgagcatctctcctctcctctcctctactcccctnnnnnnnnnnnnnnnnnnnnnnnnnnnnnnggattctctgtgtgtaacatctttggctgttcttgaactcactttgtaggtcagggtgactttgaacagatcttttcttgggtctgcctcctggagaaagttgggattaaagagattaagagcatgctccatcacagccctcatatcttagtgtcatgtgttcacagcagttgtcttggtcctcttgattttattaaatttttgtccccacctaaggctaaagaaggattagtttttgttttttgatgtatcttcttacctgtattgagttaatttgccctgggttttatattttgaaatgtatctggcaccttgtgcctatcctggggttgtatacactgaaacattctcatgaattaaagtttttccatgacatacttctgccaggcctttccctagaaacaataaagcaagtcaataatgattctttggtggcttgagggctaaattatttttttaattaactattcagatttttttcattagtggtagctttatagacacagaaacaatttgtttaggaaaactgtgttggaattaatttttatttttctgctacaaaattttagaatgttaactgtccttatacttcatatttagctaaggtgacttgaatgatgtccatgcacataggccactcattcccagactgaaatttgcaaagatgatttattcacaaagcacagtcaaaaacttttagcagcaaagacaggatcctataaatacctggcaagcaccatggaccatggttatacaacctcagaagagattgcctagccctgcaacataaaataatatgtagagtatctttattttaattttgactttctttaaaaatctttttaataaatttaaaaattaatgcagcgacaacaacaatagtgaagattttctcaaggtcaggatcagccatatttctaggcatccctctttcccattcaaggtcactagggcatattcttctcaaagttgccatcacttacgaaatcaacatctttcccagatctccaaaggacctgctgaaaacgattttttagtcaatttaaatatatatggaataaatatgctctacagtacaaatataaagagtaaagttaatctacatatgaggcattcgtggacatttttattagcacaactgtgtgaaggctacatagtaatacaaggcagcagagtggcataaatagcttggctgaaaacacttcttcacatgatcttactgttctgcttatcctcatgaataagatattctgcctttcttcacagttctttagctggcattgtattgattggaactctgtaaaattataattatgattagtgattattatcaaattaattgtaacagttgaagttaaaaagcaactgtttttctcttaaaacagcagatatttaaacagatatttattgagaaaaaaaaactgtagtgcatttgaaaggttcccattttcctctactcatttaaattggtctctaaacaagccggaggagttgaattctgtgaaggtctgtagcaggtgaatttttctcttgtcttcctataaatgaacaacacagtataactctgaatcttctaggagaatcaactccaatttccatccacttggttcatctttttaaaaggtatttgaatctagaagattaatatggctacaagttaactccgttcaaatcttgattttcctataagggaattagtgtgctgtgtatgcacatctcccaaaagaggtctttttttgattgttgttgtttttttttttttcaaaaaagaggccttttgtggtggtcttcataggggtgctggttttcaatgagtcagaacattattttgccaatttgctgatgttttccatttttaaagaagagacgtgtaaaaccaatcacattagatgtctttcatctgcagagaaaccaaatgagaaacgtgcttggttattaaattacagaattagcctttgaacactttttattgtttgtgttcgaagaggcaattcttgatattaaacttaacactggaggagattactcaaccacccactgacagcattttagacttttcaatttagctgttcctatggaattgtgggaggaattataagcctactgtggaaaactgaataattgtagcagggatttatttatttatttttataatcctagcctaaaacaagattaacatagtgtatcatcttgaggttctgatttttttcacagagtgcaaaaataatatttgcaattattttataatttctcttagatatctctataaaggctaagttccagagaagcccttgttttatctgttatgcaggaaagtagatgttcaaaacaggtttaaaactataaattgattccatcacagtgatatcctaagatgaacctatttccagatagtgaattaagcaagtctcattaattctaagatgcacattttgtcgaaaaattttcaatcataaaattgagtcacatcgtatatagcattgctaaaaaatttagttttcattaagcatttcttttgcataatatataaaataccatggtctcttatttggtaatattttatttgtgtttatatttgtttctatgtatctgtttgtatgtatgtacatatttatatgcatgcatatatgtgcatgtttgttcctatgtatatatacatgtatatatgaaatgtgaatatatatgaaatatatatacatgtatgtatgtatgtatatatgaaaatacatatatgtgtagttgtgtttgtgtgtgtctgttttacatgagatatatgtttatgtctatatatgtgtatatgtatgtacacagcagtgatctctgaaagaaaaattaaactttacctctctcatgacatctagaaattatttttgttttacctattaaaattacaacaaaacaccataaaatttaaatagtaaaacacaagagacagaaattaattccatccttacttacttccatactgaggttaacgtgtgtatatatatatacacacacacatatatataccacatatatatacacatatatgtatatatatatatatatatatatatatatatatatatatgacccatttctcttttaaccttttatgtttattgagtacgggaatgtatattacttaataaaggaaaatatacctcgattccttaggaaacagtattaagagtaaatgaatttttcctcctccacttacatttttaaaaaaaaatgattctgctgcatctcatagtaacagaaaacaaataaacacacacactcatacacactcatacacactcatacatgcacacacagacacacatgtgcatacacaaatgcataactacacagtcattaacacacaggtgaaaatacatttggaaacacactaacacattcttgtcccagtaattccaataaaaccattatgtgtgtaaccctgaagtcaagtataataagtcaatcgcatgtcactgagtactcagcacttgcaggaaaaaacaccatttattgcaataatagaaattacatttaatcaatatgctctttgctttgaatccatttgtgactgcagaaaagcctttaataacatgtttcgagaaaaaaaattatccaattgaagaatatgcctaagagaaaaaactggctctgcttcattccaatttagcagctacaaaattgacacagattttatattttgtggcatcacagcacctatttattttgtgattgagtttttggcattttaaattttattggtcctatacattttaccaacaatctataactacatttatttctttttatatttcatgcatgtaaatgtatatgtgtgggcatgtgtgtcacccaacatgcatgtagatgaagtaagacaattttctggattcagttcttgccccaatatatgggccccaaggattgaactcagatcttcaggctttttggcaagtggttttacctactgtgcctctccttagatctactttcagtaagtatattgattttacttttatctaaattaggctatggcttagttaaactttcattgcgatgaagggacaacattaccagggcagttcttataaaggaaaacatttacttggggctggcttaccgttttagagtgtccgtccagtataatcatggtgggaagcatggcagcatccatgtagacatggtgctagaggagacacgttttacatcttgatcagcaggcagcaaaagaggactgtgtgtcacactggccagacataggcatatatgtgagccctcaaagtcctgccaccacagcaacacacttcccacacctcccacccacctttgaatagtgccactcactatggacaagcattgggacatggatctatggggaccaaacctatttaaaacatcacattccactccctggcctccagaagcttgtagatataacagaagtcaaaatgcaattagttcaacttaaaagttcccataccacttcacaatctaaacaatgtttaaaagttaaaaatctcttctgaaattcatacaatctctttactctaatcccttataaaatcaaaataaatgataaaaagtaccagatcagatgcttccaacgttaccattccaaagtatgggagcatagtgaggaaatactagaccaaagtaagagcagaaattatctgggcagactccatattcttcatcttcatgattaatgtcaaaatgttcttcagatctccaactcctttcaccattgttgactgcaacacaatctttttttgaggtggggggcagtttctactcccttttgaagctttcttcttcaggtatccttcagcattgctaacatcttggggtctcaaaagcaattcaactttacagtttcttgttccagtgactgggattgacaatgatcatctgggctcttttaaagggcttgggtcacttctctagctttgccctctgtaacactctaggctctttttgactccactcaactgttgctgctgttcttgatggtcactctctgttaacggcatttccaatatgctgtggtcttccatgcaactttcacaataacctttcataggctatctttgtggtaccaagcctcaacttcttagcatgaccccttcagtcctgtcattgaatgtttcctaatggtgtttcatgacctttcaaagggtcaagcagcagttgctcttcatcaccccttcaaaactagtataacaattgagattcttacacattaccaagcttggctgccattacaaggtctatctctggaacacaattactttgtcatctcagaatacacttcccagaagattctatttcagtgatgatgctgctctctttttaataacaggtaatttcttagctccagctaaccagtgtcatttgttcaagttacctcttctactcttgactctaaagccagccaaagcatctcagttctgctgcttgctggggcaggaacatagccccattgttctattacaactttacaatcttttcctttttaaattttattttcagcgattcctttattgcctaaacttggctgtcctgagacttgctctgtagactctctttgaactaagaaatctgcaagcctctgtctcctgagtaaagttttcagtatattttgtattctagctggtagactaagattatagtcactgacctggatttaaacaaaatttcaaattttgttttcaagtctctttagtcataattttcctcaaatttaatgtttaccatacagcccatacagcagaaactgtacatatgataaattatctttattttatatgtaagaaaagcactaataacagtgatataagaattttctttatgattatccagctagaaaatgatagtcttgaggttcaacatggttctcttagtaaaatcctactccctatctcctgtagtaattcatcctataatacccttaatttcacactgcatgcagtaggataacatccttccatattttataataactcccaaatctcacttgttttgaacactttcctgaacactacaaaaacttttaagttgactgaggggcctgccaatcatcttatctctgttattagtttggttaacagttactccctggatccctattgtttgccaagataaagaaaatgagggaaaagtcatggtaaaatttctctttcgtgataaagttcctgtctgatttggcagtgatagaatacttatctgtttcaaagaagagtcaaatcagatgggctgagtgcagttgttagaatctttatatcagaataggactggcacgtaaaagcagtgatgtgaagaaggcaaataaaaattatggaagcttcctctccgtggtcactaacaactcaaaccgttaatttctttttttttcttttttttttcttttttttattacatattttcctcaattacatttccaatgnnnnnnnnnnnnnnnnnnnnctggcgttcccctatactggggcatataaagtttgcctgaccaatgagcctcctactcacaacgtatttatttgtatcacaggcaagcatggcttctagttgtcactgcctagagattacctctgttctctgagacctctttacagagtctgactctgtgtgactttgacacagacctgagaaccaaaggaaacatgtcccttcacaattttatacaaaaaacagagtatttcctgggaattagatatgttccataattaggtactactctccctgagcgattttacaattcgtaaagttgtatcttaaagtctttaatttatcagggtcctttagagtaatataacttatagaatgaaatgcatatgtctgtgtatgctatttgaggggtagagggtgcccgagggataaagggagtgggataaaacccgcatccaaccagatttcctgtgctctgggtgagcagacatggaaggactgccacatgctttccatgtggcccacgtaggtgtctggctgtgtgaagccacataatctcagctcgctgggggatggacaaggagcagccctaagtaccatattctcagccttgggcatcccatgctaaataccaccgaagagctgagaacagaatgccccccccccctccaatgcagctcaggcagcttggtcagccccagggtagaagggaggagagggcaagaagagagggcactaggtggttcccacagagagtctttggtccggtccatggctgcaacacaggaaggccatctggtgggaggttagatgtggctcattaggagaaagcctatcccttctttcaagcaaggtggccttgattagcagagacagtctatgatttagagctttattgtggaaagtcagagaaaaagagagaagatagaaagagagagagaattcatcttggtagattttacctttgatgagtatgaagtgcccctccttgtctggaatgccagggtaaagaaatgggagtgggtgggtatgagtgcagggcggggggagggtacagggaacgttcgggatagcatttgaagtgtaaataaagaaaatatctaataaaatatttaaaaaaaggaaagagaaagaaagagagagaagagagagagagagagagagagagagagagagagagagagagaccagccatggtcatgtggagagagggggaaagggagagagagtgcgaaataaagaggtctagagaggggagtaagaaaggctagagcttaaagagagcaaggaggggccaagcaggtcctttcatagtgggctgggctatcaggtaactgtggggaggcatacctggctagaatgccaggagcttggggcattgtctgcatgactgatagtcacacacctctcctgtgcgggctgtggaggtggtaacttcaacagaagtcaggggtccaggatagatgatggaaaccttccatcccatggaggtggaatcacctcccattgggtctcttggggttcaagacctatgctctactggagaccaggctatctttgcacagcccactgccctatacacacatatacacaaacacacacacacagaaacatgggatttattcagataatttacaggcttcgattcagctactccaacaatggctggctgtaggttgaacgtccaagaatccagtagtagttgctcagtccaccaggctggatgtctcagtggtctttcctatgttcctcagttctgaagaaggctttaatgccagtgaaggaataaatatgatagcaaggtgagagcaagcaggaaaagagcaattccttcttctatgtcattgcggtggtttgaataggtatggcccccacaggtatgtgtttgaatgcttggacatagggagtctgaggacaagtggccttattggatgaggtatggccttgttggaggaagcatgtcaatgtggagatgggctttgacatcttatataagctcaagctacacccagtgtgacaaacagtcttcattctgctgcctgatgatcaagatgtagaactctcagctcctttctagcactatatatgcatgcctgctgccatacttcccatcatgataatagtggactaatcctatgaaagtgtaagacagccacaattaaatggtttttcattatgagttgccatggtcatgatatccctttacaataataaaatgcaaactaaggctttcaacagaatgtatggctcacatcaaagtcttgtcttcctgcctcaaagatcaagataagaagtaaaggattcactcagttcaaaacaagcaggtgtgcccacaatttctgtaatgtagtctatttcagatgtagtcaagctgataaccaagactagtcctcatagttcttgtgaaaatattgctattccccctttcacccaaacttttttgaacaaattcttaaaattataatcttgtgaatattaatgatgtatcctaacatgcgctgtccaagatagtttttcagcttgacacagataaagccatttgaaagaagagaaccttagataagaaaatgcctccatggctttcagttgttcttcataaaagactctccatgagataatggtaaaaatgaagtaaagtatatgtgtgaatgattatacacagggaggcagttttaggacatgattcatgacctttcaattactatggtacaaggaaataaattgtacttttctactaaaaaaaatgcctacataagatcagtctgtaatcaggtaaaccattaaggcatttttctcaaatggtggttggtagggaagaacctaaattgttggttggaacattcttgggatggtcgtagtgagttctataagaaaccaggctgagcaaggcagtgaacaacatactttcaaggcttctgaatcagttactgccttcaggttcctgccaggttgaagttcatgacttggcttccctttcataaaggactgtgactcagaatatgtaaacccaataattccttttttccttaagttgtttttggtcatgatgcttcatcacagcagtgtgaccctgagacatgttaataaatgcattcatttattgtggaatagtagtgcaggttgaatatagctctgaaatatttatgtttttgagttaaagcatttaaaatagtttttccagcattttgaatttttgtacatagtttaattatagtaactttactgtatactcctccgcatatcataagatttattctctattgaaaaacttaccaacctgcctcttttgtgtgtgatcagttgtgagtatataatacttgacattctgtgccttagtctgtgctgtatgaaatgacagaatttagttcagttttatagtcggatgctgattaattacacatacattttctttagctgttctttatttaatgggcgcttgtgttctttctcttcctcggagactaaaaataatgctataattcacactaaaagttgatattttttcagtatacattaatttcttataactattcaaacagtagtaggatcggcacttctaatgtgcattttagttattctatgcttaatattctgagggggtaagtattgatttccataatggctatattgatttatattggttcatagagcatgcaagggtccttctctttctcatccttgccagtagctattatcacttgaaagtaggtgataatatttgtgaaaaaattatttcattgtgacttttatttgtattttactaatgactggtaatactgagcattttctttctcattgaccattatagatcaattgtctgttatgaatgtagttattttgatattgacctttatccttccttacagagtctttcatttttattaaatcacctttctttgatacattctaagtaccttcaagaatgtggtgtctgggtaaatgaagaaagagtttggaacctgttttctgtaccaatgcgtttctttaaaaacaaaatatccaatctcaaaggcttaactgactccttctcactgtggttctgacacactgtgtctacaagtattttaaaggcatatttttttctttttttattaactattttctgtatttacatttcaaatgttatcccctttcctagcttcccctccccaaaattccctatcccctcccctccccctgctcaccaacccacccactcccattcctagtcttgtaaaggcatatttcttaatttctgatataactatttagattcctttcagttcttattctttttaaattgaaataagggattctagagcacataaactccattaagagaaacatagtcttgcctctcattttctgcttgaaaggattaattgatacacagtagtggacaccggcagctcacatgctgatctcttccaacctgttaaccatggttatgatgctcttagttctgatcattccttatgaatcttttttccctggggactatggatgagagccatttttctgtatttcatttcgtgctgcaatcctctgaaatcattaaatatctttatccttttcaattaatattaattggctaattaccttatggactcttcttttttttatccccggtgtattactaaatagaaacaagtcagagtatgaacactctatactataatttaccaccaaagatgaaactctttaattctatggaatgtctgtcaactcataagcagtggtcacaccatcacaaatagagcttttgataactcttttcaaaacttggtatcaattttactatgaaggattctccttttagatatcataccatatagaatggttaggataatacatccactgtcttgttgttctaaatatgtgaccatttctgatgaataatactgcaaaagtcaatgcaaacacaattgatctgattagaattgaggaatgtggagttaattggagaatagaaaattatagagtgtttgaaaggtttctttattttgatagagagataatgaatgaatggtaatttaaaatgttctatgcttcttgtggttagcatgactcctataaatttttgtttctttgatactggtttctgtcatatatacattcaccccacctccaataattagggaagtcttaaaataactgagaatttactgagactgtaagtatcctattcttaaaacttatcaactaatggaagatgggttttgatttgggatattattgatgaggtagggtgctatgtcttgattatattagatgtgtatccctctttaaatgaaaacaatgatttttaaagtccttaatctaacattatttgtctaacttcttctttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttgttcagtattttattgacttgagacaggatttcatgtagcccacattgccttgaaattgctgcacagaagtagtagatttgtacacctaatcctcctgtctctatcacaaaggctagctgttctagcattgtgtgttctgcaaatatccaaaactcaaatatcaaattaaaccagtgatcattgagaatcatgttatttacattcaatatccatatgtttttgtcattattgctcatatgtccactcattaatgcaacctatttatttgttcatattgtttaaaatattttccaaatattctatttgaattgaaaaatactgcatcaggggagcaagtatttgaggcaagaaaaatccctcctatgaactaatgaatcaattgctaacttcaagattattaaatattacagaaggtattaaatactgtgaatcagaaataagcatatggagctaacttattttcacatgaaaatgctttgacatggcaaagaatgataaattttctactttagtactgcagatggttaaatagctcaaattagtcaaacatactttaagacttaaggaacatagatttttaaaaagagatataatttcttcctttgtacttagtttaaatgaaccaggtggttagagggagaaaatttggataaaaggaagatgtgtgcagtagatacagatagctctgcttctgactgacattcagggaagataatttctgtctataaatctcaggttcccaagcatacatactcaaagataatctgagttgaaaatttgttaaatgtgagcaaatattccaatttaaaaatttaatgaaagaaaaaaaatgggtgaatgaatgaaaatacatacaatagtagatccttaagtatggatgtcagagacagctacattggatgtgttttgtgttcctgtgtgcgcctttgtgtgtgtgtgtgtgtgtgtgtgtgtgtgtgtatgtgtgtatgtgtttatacctttgtgtaaaaattatcaggcattatatttttgttcaatgccaaataagcactacatatatcagcattatgttacagcttgtaatactagtgtgtgtgtacgtatgcgtgtaagtattcataacaaaattgtttaataatttttttttgcttggatgacatgaagtgatatgtcctaaatcttattatttatacatatacatatgggaaattcttaggaatgaaattttcaatgaactccttatatactgatcagagcaattaatgtggtttttatgtactcagcacactgatactgagttcttttattaacacatattttttgaaagcacccacattcaaagcaggcatgagaccttattgctcagctaagtaaacataaatccagcaacagaattatatcaataccacactgtttttgcttttcttacactggttttgagtaatgcaaagactgaatatccatgtagggtatgacttccacttaaaggctattgttagagcttattgtattttgcaatactgagatgtaggaccctggttatcctttattttgtcaatttaccccaaaacattaaataagataatgtgtttttaaaatatatttctccaaggtgagaaaaaattagccttcactacaataaattccctcaggtataaatcagaagtttagggtttggattcagatctaaagctgagaagccatgatcactctcttactctgtgaaatctaccagaattatcaaaacacacagaattcattacaaatgccccaatagtctttagcaactggagcttatgcaccataggacattgtcatgatttaacttgaaaaaattcatgttctataatcagtttcaggtttagttatttgtagaaactgagtagccattggttaaacggaaatgttctctaataaacagtctagatggtttttgaaaaaaattctttagggagaattacctaattagctatgcaggaacaacctattgcagttaaaatttaaatttctatttcatttattttccattatggtcacaaagacgactgaattaggggaatcattctgagaattcacgatatatgaggaaaagttcatttcctatttacctaaagacacacacatattaatcttgatctataaagtttaaataaagaaatcaataaaaaatatatcattatattcatcaaatttcactgctcattggattcctgctcaccatatcttcactcagatgtgaagtgttttgaatatggccacagatagattttatacaagtatatacttaattacggcatgcatcagcaaagtggaaaagtagagattaaaagtaggtaagacacttggaaattctaaagctatacaagagatgtcgtgaatcattatttgtatgttctagaattgcagttggaatttaaagtggtgcacaaataatttgtgctaacaaatacccttaaatttacccacccacacaactgatgttttaaaaatactaaagtttattaatttaatcctcttttaatttttaatatttgatggaagttgtgatatatacaataatacaaaaacttgtgcagatgaagatactgcaaggataatttaaaagacccctttcatttaggatatgcacattagtgactatatactactaggatgtcaatagagtcccttactacaaggaagaacactagttcatccatacatctgcagaggctatgtatgacttaactttggtcctgtgtttgacaaaaatattttagtctttattctgttcctttacctacattcatgccttaacctagatccattgaaaatactcttctttgtgcaaatgagttggacaagttcattaccacttctggaaaacatcttgaagcttatgtcatgctgagttagtggttttgtaattaaatgtgtgcagttttattttcccaagtcgatgaattaatccttgtgctatgcagtttcttattggaaaatgtaatgctctatttgttttccttatacaaaatggcataactgcatcttgcctaatgaaattttataaagttgtttaatagatatttgatatatgtatttcatgcccctattcatataacacaaatacaattctacaaataaaccctccaccaatttctctatattaagactaatcagaaatcttaaagacatgtttctctatatacacacatacacaacatacacagcacacacacatatgtaaccatatatatatatatatatatatatatttggttaacatcatgacagtatgtgtttttagactacactcccaaatatcatcaaagctatattttattacattacatgatctcatttttgttcctgtttttttcttcctctgcttgttttcagcagttaattttattatgtgtcttgggtaatacactacataaggagatgtttaatatctatttgttagatccaataatatcttctatctcctagaatactcacagatttaggttcagacagaacatcttgctacacaaattcgtctgagaattgagttaactaccccacataaagagactacaaggaacgctcaccagatgtcagatgtgaaccctattttgtcttttcttctgccacctttacaaatagaggcaaggcacagaagagtaactcatacaaaaaagaactgcacggctattcatgtcgttactttttaacgttctgcactatattcactatttccataaatacacctgtcaaatgagtggatgtcattgttagaaaatgttcattgtcctacagtttagctgctatcttttgggttattttgtttggtatttgcttgttttgcttttaaatagccttcctcttttgagtttgactttctcccatgtcagcttgacacaagctagagtcatcagagaagagggagccacattgagaaaatgcctcaataaggttaggctgtaagtaggattattacttctggtcatggtgtttgagcatagtgatagtaaccctaacaaataagatttctatacgcttccatgtactgtattatgtttctatgaatggatgtcttcatatgttgacttcaaatattatctgctgaagtatattgaattaaagttagtagaataaagctagtttaccaaccgataattaaatccgtattccaaagcatgaaacaaatttaatactatgtgaaagactaatatgaaagtagatcctgtatccagagtagataacatgaactcatttaagcagttcagaaaggaagatgttgatttctagctctgtctcctatagctttagaaatatttattagatgttataggaatgccacactaaatgtaaattctatataaagaaaagacacttttgaagtgtttattaccccatttgtgacatctctgtatacaaactgttatgatagatgtaagatcagggactaaagtgttctctctttggcctatctctcctagttgcatgcttcctaaatggcgtggataatgcgtccaaaataccctgcagagtattttgctagaagttcagtaaatgtttgctgaattgaattgccacattaacatgtaaattgtcagattgcagagtttacagcttgtaaatcttattttaaaaatctaggtttacacaaatttgcatattatttagaaaatgaataaattaaacccaaatcagtgtctcatttatatgcatttccacaccctcatttgaatggtttaaagtgctactactggccagcaagtttgataggcccctaagcaatgttcatataggaattaattgtttcctttagaagaatgcccacaaaaattattatctattacttaattttccaaatgaaaattcttcagaaaatatagctactactcacccacaatcttttagctcagtgtttgaaaatatataaataattgaatttcacagacatcttggatgcttctccaacaaatacttttgatcaggtcatgtgagtgaattgcaagctacagatatcgtgttttatgctctcccccagtgcaaagctgttgtttactgaatggtcatttttggctaagtttcatcacaaaaccgtgtatatctgagtagctttcttttcaggcacttgtgaatatgattgtggccctgaagggggtaggaaccccacaggaagatcaacagagtcaattaatatggacaattggggttctcggagtctgaaccaccaaccaaagaatatacatgggctttacctaggcttctctacatttatgtagcagatgtgcagattggtcttcatatggatcttgagtaactggaatagggactatccccaaagctgttgactgtatgtggatatgttctagctgcgctgcttgttttgggaaacatctaacctcccagagccttgatgtgacagggtaggggggatactgggggggtaagatggtgaacaggacgtaaagtgaataagttaaataaataaataaataaataaataaatatgtttccaagtttttttttttattttaaacacaaagcctggcttattcgtaatttctctttcattatcattgttttattttaaaaagtacaatttataaatatttatcgaaaaactgagaaagaacatccaatatattagttaaattttaatagccatgactcaaaataatgctgtactcactctggagctatgtcttttaattgaaggtttacgtttgatgatggaaaaagtataaattatatctcatataatagcctatctacaccaattgcaactacctgcacaaataatttacctgatgaatgggaatcgtttagcgaggggatagttagcaaagttttcttagttggtttgttgtttttatttttgattttaaggtaagggttatttagaggcagcgaaaagaatacactttcatcttttaagtgactcagaaagagcaacattgatatattcatgaatttaaacacacttaaagccaaatcatggcacctttccagatccatcaagacatcagtttacttttactgggaatatgaaaggagactaagagaaagccaacgctgcaggaagctacaattatgttttacaggctgcaatgttccagggtgttcagcggatgatgtttttgtcttgtcgtcaataaattctgccccatgtttctataatcacaatgcagtttttacagtaggcaattatttttaattgtacggatacgcaaccccttattaagttaagaggaagagagttgctgcacatattaaagaaactgcaaactccagtaggatcttttgatttctaaatgattttgacagtctcttcaagagtggttgccccattttcctccttgaatttaaaaaggttgttttttttttttttaaagggaaacttctgacagcataatctctgcatgatttttgtatggcagattagatagtgaaaggttccatctaccactccccaaccaatcaattgcctgaaagactagctccatagttctgccatgcctgtctgagttattttatttttaaaagaacattgaatcacaactgttgagagctgcatatttagggaaagatgccatctctgtctctggaggtttcatttaaatcggaatgataacaagttgaataggttaaaagttgttgctatttgactggaaacaaattcttctcttaatattgcacagttgtgcatgtgtgtgcacactcacacacacagaaacacacacagaaacacacgtgcacacacacataaacacacacacacacagacacacagacagagacagacaaagactagagagacagagacagaaagacagttagagaaagaacaccaccactaccaccaccataccatcaatgtttattttaaatatgtactaatccttaattatttcaagtaagattcaatatttatttattgattgattcatattattttttaatctttttacagtccagtagttattttcctccttgtctgccctctgttcctcattcattttttcttgcccctatctccaagagtatgtctccaaatcccctaccccaccagacctggggtctcaagtctctgaagggttgcctgtgtcttatctcactgaagccagaccagacagtcctttactgtatatgtgttgaggggctcatatcagataagatatatatatatatatatatatatctgttccttctttcttcttttttttctttccatcttgaccagttttcatatcaattcctcctccctttgtttctttgcataaaatagaatatttcccatagatatcaaacacctatggcatttcaaattacagtaagtctaggcacctccccttgaattgacccaagaggaaagggtcccaaaaggagacaaaagagtttattttcactccatcaattctgttttcaattatatactcccttagttactgtttcataatattttttcagctctacttagtctctgtgctattcagctttgcaaaagattttaatatatgtagcagataataagcttcttataaacaaacgctactggtctttatactatacgtttctctcttcatgcaaataatatatacatagagagcacaagcatgcataaatgcaaatgcaacccatatatttagactgtaaatattatgtatacatgtctggtaatgtgttttgtgtatataaatttcactatgcattcattgagatgaagaagacagaaaacataatttttcttatacatcattacatttactggaaatgttatattatactatgtattgtatttcataaattatattatgaattaaatcaaaatttccttttgaataaacagtttagctaaggtgtttgacctttgacctcagaaacaatgttttatttgcttttcaatgatattataaagcataatgacaagttttccatgagctatctccctctccaaatttactcagttatagaagcttggccacacttagtgaaagtgaatttgacaaattagatatcattgttccagcaaagaaatgataattgattgccaaaagctttctgttcccctcctctaaaaacttaaaactaacaatcctcacaatggacttcactcaaaattaaaaatatatatatatatcttttaaacaaataacatacttgcatattttgtaataagagattgagctcattttctaccccagaaaaaggaaattgagtctttagtcaaaaggtggcagactgttttagcaactcatatgactatgaaggattcactctgcagtgaattttcaaagtcagccttgttttggttcttgtgatctcttcttgctcttcaatcacatcttcttaccacaatgtataagactctctttcttactccttactgtatggaggagtaacggagagtgttcactttgtaaactctgggttgtaaattttcaaattcaaaaacactgctagagagtgtttgcctctaacaaaatatcttggacacattatataaggttatagaataactttaaattcagtgttttgaaacattattgtttgaccttcaaggctgattagaaatatcatcctttaatatctatgttggatgaagagtgagagtgcatgtttatctttgtcaacatacagtctgcatgttgtcccttctttgtcactacttgcctcttggttcgtttaatctctggaatcccagtgtgttataggatgcacagtagtgtctagtttcacacctcagttaaacacatccaatggccatatgttcccttatcattggtgcaattttgtaatatttcccaaatctgcatatgtcatgagacttttttctatgaacagtaaagtttaaacaatattttttcagaattttaactatatttcaattctttgagaatatgttttgtgtagagacaattaaaaaacagatataaaaggaagtattatcaaaatcataaagcaacaacccacatggcttcacaggagaagtctataaagccttcaaatgtcatgccgcccacatctctacatatttttacaggattaaaaaaagtgacagaacccttcctgattcacattatctccctcccctctcctctcttctttactctccaatcccttctctatctcatggacagatcagacttagagcttgtggcatgttaagcaagcatactatgccactcagctaaactctcagccccacaatcttgataactaattaaggtataaagtattaataaatgccagtgtgtagaaatattttgtttcatactgaatgttcacacattcttaaacattctctcatatacacttattcttaattacaagatgaaaggcatcttacttggaaagtcaagaaaccatattaaaccaactattagtgctgtgacaagcagatgtcagtctttgatccactaatcgctcccatcccaaatgttgcttccattttccccctagagagtagcatgtgactaagaataggacttcactaattaatcactcgagcctctttagaaatctgctatgtgtgcaatcaccacataggcttcttttgcctttatcacatatagctctgctactcagaaatatgcttcattaagtcagttttataaagagcacaagtctatgttcggaagagaacaattttgtctatggtaatcataaagggcctgaattagagtcatggtagctgttttaaaaaatagatcaaaatttcatgactaaacaagaccaaagtttcttgcttaagaaatagtttggcaaacatcttcatgctataacctctagagacatgacttcctttgcttttagatgtcatgaagaggaacatcaagggttcatgagtcatacagaactgcaactgttattccattgtgggccacattcacagcaggaaatacagcaggtgtgatgccatcatgaagccaatgaaaggaaaaattgattgtgcatctttcatttccatatgtgtcttctcaaactccatagggaacaataattccaatggcctcttcaaaaagtgttttaatggtcacctcctcaatcttttcattttttaaatttttaaaaatcttttgggtgtttctgtgtaacagccctggatgtcttggaactctatttgtagaccaggctgccttgaattgacagagatcttcctgcctctgcctccagagcactgggattgagaacataagccaccatattcagctccacctacacattcttaatagaactctataatattcttcctcagaaaatttttacaaagatattttatcgtccatctatgtccttaaaggaatggaatgtaccagctgttctggaatcttctgaaggttccatgtgcctaattttagcaatggcatgtctgaggttcagatgtttatcatttacctggaggcactaattactatgaaaaaaaatccattaaaattggaaccacataagtcagttgaacattttttaatcaaataattcaggatgctgttaaaatattaatttcatatcttaaatatttatgcctacttgaaacccactaataaatggtaccttgccaattttcagtgcaagtcaaagtctacataatacaactcaggtgtctatcattcattaaccgctccaggatcagagtctacctacaactcctagccttaatctgttccctttttcttttcttcccaacccttcctcctctctctctctctctctctcctcctttctttaccccctctctaaagttctatctttcaatctttctttctactttgattaaagaatgaattcagagccctttaagatttagtatgagatcagagtgtattgagagtgatacaattttaacagtctttaccagcctgaatttaaaaatattcacaaaaatctcaattcctaagtgatgaatatttcatagaaacaaatttgtgtgtacagctgtactttgtaagtttatgaaatatttaataaaaattttaaattaaataataaaaactgtctaaaattttgagagctactgttataacaattctataaatgtttttgatttattttgaatgccattttaatcatataacttaagcagggtaaaaaacattttattccttttggataaaaaaattgattttataaatctggaagtaaagtcttagtttggacagttttatgcagtatatatagtttacttctctctgatgagaaagttggatatttcctgtgtagtcactgaatcattatgttgattgttctcatttgctctcatttatgattctgtcattaggtactcacctgtgcttagaatctttctgacttacttattccttcagtctactaacgtctgttagtattgttcctaggtttctgaattctagaaaaaaattccatcacacctgcttgttaagttcttgttttctctatcttttaatatacagagaagtaaaaatacatacattatgcttgcttcagagcatccaacccttttctcataatacagtgcattatagctttcatttctaatataaaattcaagtttaaatataattaatgtactcctttgggaaatgggtaaatgcaaaaatgctaaagtaaaattgcatatgcatttgcttgtctggactgcagatactgtcaacagattctgctgtcataataaacgtgtgtgctagaaattagtgctagaaattgtccatattagaaatatcctctcaacttctggcatgttactgatgttttctcttccatataaactccctttactgtttataggtttcctaatcattcattctcctctgaataatttctatttttaattagttgtctctgactcacttctacgattatagtaacatcagatgatatgacaaaggcaggtcacccttttttaacagaactccatacctgagagagagactatgtgaatgaatacaccactttaaacatgctatttcttatccccttcataatttaaaactgtattttcatgtcataacttattaactaattctacttatatctaatatgtataatctagatatacatatatttatttgtataagcaataaaaataatgcagtgagaatttctagcttctattctctttatattccatctgttgtaaaataaagtacttaaaatattaattgcttctaattgtttgttgagacacaactgcatataatttgttgtattctcattaaattatcttttagaaataaatattaaactacaaaatttagatattcaaatgacatgcaaattttaattaatcacaaaacaaacaaacaaacaaaaacttgacttttccccaccacacagagctcaagtcagtcttgaaataatatacttcaaggtaatgtcctgagtgtatgctttctgctcagaatggttatttatagttggatcaattaattcctagaatctgcagggtaaagaatccctttatcctgtcatcctatagagctaagtgtatggtctatgctgagctgaagcaaactttaaagctgatcaaacttctaagcaaaatcctgtattacgattagtgatgggtctgatgctgtgaagtgaatagaggggaaagaatcatagagggttcccaggttggagttggatgaaagagtcgtgggaatgaactgtatatctggggcttattccaactgccttggtggctggaactaggtctgaaatcttgttaggacaaaccttcttgggatactttatgccttttctctttttagtaagatcagatggaccaaaggagcagtttgctttttcaaaaagcaccaagagaaataagatgggaatttcagatacagaccacagaactgacaagtccggcttagaagacaggacccttcaaagtttctgaggctactcagagctaatttataagcgagtagcatttatagaaatgatacaatttgttttaagtaattaaattaggtatgtatccaaatttggctagtgattagaatttcacttttatctacatgtaaaagcaaataaaacataagaaaaataaataaaaatagcttgtgttgacttgatttaaaaatttgtatacacatcattgtgcgttatgtatctgtctttctactgattctatgaaatgggagacttctaattcactagacacacattttttcctgtttataacaaacctgtcaggcatcttttatctttgtagaatatatgaatgagcattttcatatctgaaagacagacaaaactaacagtaactggatcataagatccttgtgataacaaattaaacataattttgctttgacaaccataaatcaagcattttatataaaatgtagggaatgtgttctttcatatatattgtcttactttaaagaatgtggaaagcattaaaatgaaaaagcaatttaaaattgtgggcccttcggaaaccaaatctggttagaaaaaaagtttatatatttgatacttaggtttatttactttttttttttcttgtttcttttttattacgtgttttcctcaattacatttccaatgctatcccaaaagtcccccatactctccccacactcccctactcctgtaacacattttgctgtatatagccttaacttttactattactcaatatatagtattcaatttacattattattattattattattattattattattattatttaagcaaaactccgtttgttctatgctttaggagatttttaaaggatgaataaaacataaacacacaccactaagcatgagcattaaaaactagtaatggaagcatttaggaaatatttattttatactttcctatggattgtgaatgtagctcagttgtagagcccacacaaggacctgttttatcctatcagtgtaaatactaaacattggagttttcgtttcttatttcttttctttcttttttgagatagatttccctttacgcttcccttccctcccttcaaatctttccatatatgaacttcctgttctcctttaaattcagtatctttattaattgttatcacgtacaatgtttttgtatttatatataatttcaattcctaaggaagaccaatttagttcatataattacttgtgtgtatgctttcgggactgattgactagcaccggtcatccagtcagtatgaccttcccttgagaaaaccacctctcctgctctcagctttcttttttattaggttttctttatttacattttaaatgttatcccctctggaaagcccctatccaatccctcctcgccctgcttctatgaagatgttccctcacctattcacccactccctcttgcctgtcttggcattcccctacactggtgcactgagtcttcacaagaccaatggcctctcctcccactgatgttggacaaggcctccctctgcaatatatgcagatggagtcattgttccctccatgtgtacctccttgttggtggtttagtcccagggagctctgggggttctggttgcaaacctcttcagttccttcagtcctttctctagttacttcattgagggccccatgctcagtccaatggttggctgggatcattcacttctgtatttgtcaggctctggcagagcctttcaggagacagctatatcaggctcctgttagaagaacttgttgacatccacaatagtgtctgagtttggtaactgtatatgggatggatccccaggtggggcaatctatggatgacatttctatcagtctctgctccacacattgtatgtcctccagtggatattttcccccttccaagaaggattgaagtagccacactttggtcttccttctttctgagcttcatgtggtctacgaattgtatcttgggtattctgaacttttgggctaatatccacttagtgagtgtataccatgtgtgttcttttgtgattgggttacctcactgaagatgatattttctagttccatccatttgagaatttcatcaagttgtttttaaaaactgagtagtactccattgtgtaaatgtaccacattttctgtatccattcctctgttgaaggacatctgggttctttacagcttctggctattattaataagggtgctatgaacatagtggagcatgtgtcctgattatattttgtagaatcttttgggtttatgcccaggagtggtaacactggctcctcaggtaatactatgtccatttttttttttttttgatttcctgagtggttgtaccagtttgcaatcccaccagcaatggaggaatgttcctctttctacacatcctcagttgcctttagtctttttgcgtagacatgaggttctatgggctttttatctctatccattttaagatgtctattattgtccatattcagctcacgtttaggcagtcaagttactgagactatggatgtagcttctaatattagtgggaaatataacctgacaataaagtccctaatcctctagctcttagcaatcattatccctgcttagataatgttccctgagccagaagtacaggagtgttttataggtacatatatatattaagactgggtgccacaactgttcattttgattggttgtggctttttgtaatggtctccatctgccacaaagagaaatttcattgatgagtggtgaagaccacaatatctttggatgtataagaacatatctttgtagattgatgctagtggttattcttggttagtaaattagtgattgaaattcctcttccaataaacgtaactgtgctgatacaattgatttgctaggtttgcagtaccagacatggtttccttcttgtttaacatgtctttaagtccaatcagaaaactgatggtcatgcttgaggtgtgcatgatactgctatacccttaggatgtattggcatgctgattgttcatgtggttcacaggcattttattttttaagatgaaaacacagcaaacaaataaacaaacaaacaaatacagaacaaatccaaacctggtaagagttagggagtcagtttacaatttgttcaacttgaaagcagtactctagtttctggattttatttctacatactgtacaagtgatacacaaaactatgatacatggcattatataatgcagcctagaggaacaaagacaataaaggattagttctcgtccctataggatacagaaagggtcatagagctttgtataggagcatgacttgcctgtgactagaaatatgctggtgtttcaagaaagagccagttgtaaaaatgtagaaggtagttattagattcatgtatattttgctgttgttgctgttagctaaagttcttgaatattcagcaaggtaaggagcccaaggggattgtgcataattctgttgttgggaaatcctaacaagctgagattcaggaaatgactggatctaagccagacattacagtttctgacaaaatctcatgatcgagttactttttaatactttgtaaatttatttttccattcagaagaataaaatgataatatcactatccctgtaaaatggtcaaaatgtacttctaatggatttatccagtgaatagactgcccgcagtctaatgggattcttaagtgtacctaaacaggaacatccttcagaaataggagaaggaaatcttttgttagctgtgttctctctctctctttctctctctctctctctctctctctctctctctctctctctctcctttagttgatttatctataaatctattgtgctgttttgggaaagtaattatattttggatgattgattctctaaacgtgcaagtgttacagaattttttgcaaaatatgtaaaactttggactaaaattatatataatcatttagacattaaattatttattactttaggaacaagtttagtactaagaagttaggcaagagaagactgactatgcatctttatatgaaattattgaatgcattacaccaactaaatgcaaatggcctcatcgatatatgtttaaatgtttatatttgtaatatttaggttatttgtagattactttgtattctcttgtaactagtttgaagtcattaacgagatttcacttaaattccaaagcttgaatatatagataaataggataaagtaatatctgtccctatgtgtgctacagcacattacataaacatattactaaacaacatattaataagatattacataattgacagcacagtacagaaaaaggtgttttgatcattccttcaaaattaatacttactataattattaaaatcagtaaattctttcttgatcacaagcagaaccgctaagatgaaatctccatgttcttgaagttctctgaagcctgttcccactctcttttgtattggtgtgatggactgaaacactgagaaaaacaaaatctagtcataaatctgaattaacattggattaactcatgcttctctcccatttagttatttaattttgacattgggtgtcttttctaatttttgggactctaagatcttaggtggctttgggggcagtttccttagttaactagaccacttcaattattggagtgttttctttcttaataaactgtaatttctgcttcatgcctcatttaaaaggtgacttttgcaatctcctcctgaaggctgccaggatttatacctaaactgtaccatattttcccttaaataccaatacaattgataaaaagaaagaaacagttctacttgtctttagaggtaaatttgaggattaggctggcagaatttacacctgaattgcactatagttttctttaaacactgataaaattgataaaatagaaacagttctacttgtctttagaggtaaatttgaggattaagatggaaaaggtgtgtgtagtctttcatcagttagaggttgataaatgttagaagaagcactctgaatgtctatgtatttctctaacagtctccctcatggagtccctgttgttcttaccagtgacaacctcatgctataatgttgcttcagatgatcatatttttgagaccacaagcttttatttttaaacctcaaaatgcctaaagtctcaactccttctggcaatcaatttgagacagtcttctataaaatctgaataattttgaaagcagtgaagaaaactatatggttgtcaggggttgtttagaatttttactttatggtgattgcctaaatatttaaaatttccttttttatttaaaaagttgtgtgttattgtgtacacacaacatatgcttaggtagaggtttaagtattcactgctttgagacagaatcaatataaatgccaggtttattttctcattaacttatactattctataaagtagatatcatccctattttttttaacaaaacaacattgtatcatgcaaagatcctgacaaacttatctcaaggtaaacgttatatggtgatgtcacaaacacatatgagacaagaaaaacaattcagtgttgcctctagacaatttctttagaaatgctttcaagtagagcttctccaaaaaaaaataatggattagattttagtttacttaccttgattataaatatttagtatatattcatatacattcatattcatttactcctttcctgtttgggaaggtatatgcctttccccccctgttgtatttgttttgtagtgctaaagatgaaactcagaccttacaaacaataggtaagtaatctgccaatgaagtacatactacccccaaattttcagaaagataagattcaaaaacctattcttcttatgctgattttcaaatgattatagagtgttttcctcattaaattcttatctaatttccataaggaatttttaacagtcaaggaaagtcttatcccacagtgtatatttttctttaaatattgatacatacagacatacacacatacatacatacctgaacactataaaacattcataggtagacagatgtgtcattccgaaagacagaagctttgcatcatgtaactttggaacattctattcacagtaagcaatatacctgaaaatcatttcttgatgatagatttactttaacaaagctgacctctatatttcaggactgggtaccctttataaagatgctcaagaacatgttttattattttcttgaactttcagatgcattataattaatatgctaccaaatgcacatttttcaattattttgacttggtgaccatagagtgacatagtgcattaaagtgatacactaaattttaaggtatttgacaggtgttgccaaattgccctcttaaaagttaaaactctgtaggtaacaagtatttggcagttttattaataaatgttgattgttttaaaggaagtaattttactatgataataacgccaatgatgccttgaaggtattataaccataataaagaaagttatgcactttggtttgagaactttatttgtgctgccagatcattgtcactatgcaaaaattttccattaaagtcatagatgtactaagatatgtaaagacaagcttttattgtaagtacatcatattattcttcaaaagtttgaagcttggctaactagaagtaatttctttattttatgttgaagaaattagtgtatgattttatcataaatgaaacttatttttccaattacgttcatgaaagagctcatatcttgaatgtgtaacttagctttcccaagggacacaaagatcatgtaagtgggatgctttttacaaaatagtttttttctaagtttatttaaactaattaaacctccttcttcaaatctatgttaaaaacaagtgagaacatatgtttcatagatatattttgtatatacacgtgctgtagattgaatactaacattatagtgtcaaatttatatagataaaatatgatttttacctaaaagtatataaattttaacaaaaattaagaaagaacagaatatctaacacaaattgcatttataaatataatttacaatgcacttttgtgaggaaaacacaagtcatataactcatgatgtcatttctttgcaaagaagaaaatagagttatttgctatggtgcacttaatcaatacatgatcacttatacagtgcgcaacatcaaactatatctgtattttgtgataaaacctagtttatttatttttatcattctctgtatttaaatagatcacctgatcaatttaagctctatacataattcatgtgtagatgaaaatctaacaacatggctactctggcaaggaatcatacccaaaaaaatcttctaggtctttgtgatccagctggaatgtgacacacccttaatcccgctgggtagaatacagacacactcttagtacacacctttaatcttaaacaatgaagatagagttggttgtttgaatgtgacaagatcagacaaattattgaagcagaaaaaaaaaattgacctaaatgagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaatattttattccccccacccctgtccaccctccaactggtccacaccccatacctcctccccaccttctgtctctacgtagatgtccatcccccttacccacccaacctgatctctaaactccttgtggcctccagcctgttgaggattaggtacatcatctctgaatgaacacagccccagcagtgttggggacctcatatcagctggtgtatgctgtctgcttgtttgtccaatgtttgagtgatcgcaggcgtcctgattaattgattctacaagattgcccttctcagcgtctttcagcgggttgcagattaagacaggacaagctgtagaatgagaaggagccagaagattaaaagagattgctagagttagttcaaggccaagcagagctattgaatcagaagttgggagaagcaagtttgaatgagtcatcttggagagaacttttgagtcctaacagctgaattgaaccagccagccagaggtcaaagtttattcagcattaagcctctaaaacaattatacctaggtaataaaagatactcttacattcatgcattcagtagttttcacacactagaaattaggtcttttaaagtttttttttttttttatgtatattttaggataaccctgtcaatgagaaattagcaccatgtatgctccatagaaatttccatttagtaaacactgttaccatatctgaaaatactaagtgtcagtaaattcatcaatgcagtataaggtaaaatccgttaatgttctttgttgtaggtggtttttagaccccattgatatcgctgcctgaattaataactatacaatagctagaaagatgatgttttaaattgtgatttcattcttctatatttgttggtgaatactattttaaagataattctcatcagcttgcatgtcttaataacttcagaaatcaattcaagtacagtcagtaaggaatctttattttttcttttacaattttaatgcagtgttcagtgcagatagggaatatcttggctttgtattaaacacatttgaacacaagtgtgtagatatgtatttatttagtggtgttttgattatgtacagtaactttgtaggggtgggttagaaaataaaagaaagttataaaataagactgtgtatctaaactgtgtcagtcatttttaaattacttgtagtattttaactattcaacaatattaatttctatcacagcttttgaaatttctgtgtttaaatgacctctaatgacaaaaccataaacaattaaataaaatttgcgtaataagcagctgctaacctttatttgagtcatgacacctaaaaatgtccacagttttgctcagttcttttagttcaaaacaatcacagtacaccatgaaatgcaaccacttgctttgtgctcatttgagacatgaacttctgggactaaaaggattgtgactatgattgtgactgtacaaaatgatggatgttcatacgtgacatagcttatcgggcaagtaacccagaaccacaaataagatatcctgtgtgatgagttgtcagtcaggtgttctcagtgactaccaaagacaatatagattatattcattgctatttgttgtctgtagaacctattgctcaagacaccacagacattgaccacaggactaacctagaggttttctatctgctgggtagctttcacaatgctggaatatattttcttattttcggtgggagaaaagccatcaaaagtcttacacagacctgaatactatgactgacaataatggatcagtcacaacatcaatgccatcactactccagtgtgaagaaggaaggagctcatgaggctttacatactgtggaggtatttgccacttactatccctcgaggaagaagattcagtgtctttagtggtatgacctatgctccaatagatggtgacttacatccatgaacaaacaggcaattagaattagactcagtctgttataaaataaagaagacaacaatggtagaggacataggttgtggtataaatgcatttagtcatgtatgatattaccaaacaataaataaaagttgaaaagaataaatgttttgtgctctgtcttggatggtttggtctcttttttcaagaatgatttacaagggaccaatgatgattcttttgttagttttaggggaaaccttccactccaccagtatacagtcttactgggaatgaagtttttctttcccctttgcatacaggacaatgtatttttttttaataatagccattctcactcacatacagtgagaaggactctcaatgtactattgatttgcatgttcctgatgattaagggagtggtgtgtacaagaatataagtggggaagagaaaacatgcaaaaattgtgcattcgttctcaagtgcaggaatattatatatgtatgaagaatttggactacttgcattagagcagagtggcagcaggatccaaaaggaaatggacagtcagatgaataaacaaggatatacctatggagaaatggcataaatgaacacattcatttgtgttctaagtaaaaatatgaactacaccaaaaataacaaaaagacaaaaggcaccacaggaacaagatggatttgtatgtatgaatttaccacatttgaaccaagagttacctctaaactgcactcccattaacttgagaaagaataatttctattggtctttagggtcacttcacatgatcaagtattttttgtttgtttgtttgtttgtttgtttgttttgttttgttttgttttgagagagggtttctctgtatagccctggctgtcccgaaacttactttgtagacattgagattcttttaacaagtgctacacagcagggttattgtagagcatgaatgaatttacacatgaatctttctactgaaacctctcttggtagattggacttcgaatgaagtaaaagcattcttttactcatttaataatagaataactgatataatttagataaataaaagtattgtttactttgtacttatttacatctaagctgactgagactgctcccatgtttacaagaattctccacaactttttctatactctgtccagtggtatagcaaagctactatcctgatgtcctcaattcctcattaatgagaatgggagagtcctgtctctagtctactagacaaagtcattgcacatcatgcaggtatcccaaaaacagggtaattctgagaacaggaaaaacctcgaggaatttcaacttaagagaaaatcaataagggctttggagaacaagtacttaaaaggtgtcgtgtacaggatagaggctaaaaatatttgttgagtgactaagtagttgaatggcatctactcggcccaagtagattcagcctttttttttttccattttttattaggtatttagctcatttacatttccaatgctatactaaaagtcccccatacccacccacccccactcccctacccacccactccccctttttggccctggcgttcccctgtactggggcatacaaagtttacgtgtccaatgggcctctctttccagtgatggccgattaggccatcttttgttacatatgcagctagagtcaagagatccggggtactggttagttcataatgttgttccacctatagggttgcagatccctttagctccttgggttctttctctagctcctccattgggagccctgtgatccatccattagctgactgtgagcatccacttctgtgtttgctagaccccggcatagtctcacaagagacagctacatctgggtccttttgctaaacacatgaaactcaagaagaatgaagactgaagtgtagacactatgcccctccttagaattgggaacaaaacacccatggaaggagttacagagacaaagtttggagctgagatgaaaggatggaccatgtagagactgccatatccagggatccaccccataatcaacatccaaacgctgacaccattgcataccctagcaagattttattgaaaagattcagccttttaacattatttacttctagagaatgactcgggttttaagaagtgcttttccactatttctcagtctttttcttttcttttcttttcttttcttttcttttcttttcttttgtctcaaataattttggagaagctagagagattgtgaatgatgctgtacatctggaattgaggttgaatgaaacttgtgtttagcattgaaatatagctctaagattacaatggaattcacagtataaagaaacaaatagagtaaagtcctctcaggtttgtcttacatgtaagccacagaatctatgcttttgatcttcagccattgaaagttatacattgctcacttgatatggcctgtgctgatgtactgactttgtttgccacatgcatcttttaagttagttcttgcatctggcttcctgtccaacccagattttctttctttagaagaactttagtaatccccaacatcagtattcatatttgagcttaagtaaaggctaagcactacttttaagctcagtaattcaattggctgctactcaacagttcatttttgcatgcatattgttttacttgagatctaaatgtaagtcagaacataaaatgtagcagttatcttttatgtatatattcatttatttgtatatttgctttaagacaattgtttatgaagcctaatataagagaactgcaaactgagcagtaagtagaatacatttgcagtatggtgatgtatattaatgagttttttaaactaagaaatttaaaatcaactgtgccaatatttagatgattttcgtgacattattttgtcatataaattttctgcatatatgatatcaatgatagattttaataagcaacaaatctataaaaatcgcaacctagaacttagtatgctcaatggtatataagccaatgcatggtaataactattgctaacacaatcctcattacctcatatttagaaaaatacttttatcaagtctattatgttgtattagtttgaaggtttagcctagaatctagcacatccaaatttcttcaggaaatctatctttttaaattgtttttcttattttatttgtttacatttctaatgttgcccccgcttccagtctgtcctccatgaacccaccccacccatgcccctctcctttgcctctaagagggtgctctggaaatttatctaatacaacacaaagctttgtgtttaaagaagtcttcatagatttctatactatgtaaaccaagcaatatttttttttagatctttgaacttaacaaatgtgataaaatgtgaattaaattatgaactataaattaggtgcaaattgaatttacttttacaagatcagtttcttcattttttttccgagtacaagtttttgatagatgttcaccaggcctctgaaatacaggaaccaattaataaaggctttgaactaagaggctcttttataccactttcttggtctcattgggaattcacagaaaaatatgacatcttcctatcttaaccgaatttcatcttattagtgagacaaaaagcagaataaacagaatggaaaaaattgcctgtcttggtagcaaatgcttgtattatattgaggctatgcatattctcttaaaacctaggtgaaataaaaacaaactgtcaagcagggcttggggctttgggatgagtatagcaggacagacatcatctatactgtcaattaaagaggctctcactagacagagaaagagaaaagaagacacaagaaggaacagaataacatgcgggagagcaaaggattgaacaaaaggtgaggcggggtgaggtggactacatataaggatagagggtagaatgagaaactaaagctaaatgtacaacccttgaaatcttgcttaatgcatctggtctctaccccaccgtcataaggggtgaggacctcaccttcaggacttaattgacaccttttctcttgacatctttcctaatatcctaaccctcttttattctaattatgccaaacattaggcaatgcagggcaattatctgatcaatcttttgggagctattaaaagatttcccaggatatcagcttgcttaaatcctacttttctcagccatcactcctggatgctgtatgattcctaactaaagcccactagactatccactgaatcactgcccttgtaaatcaaatcttagtttaaggaagctattcctaatctgtacttattgattgtattgcatgcttggatagaaatcatgtagtctgtaaatctgaatatatttgatacctggattttacagaaaaatattgttgacccaatatgcaaattaaaatttagagacaaaaaacaaaagtgaggaattactaaatcattttatatatttattacacacacattgcatattttgttaccaacatgaaatgatatgagaatgtagacatctaagtggcaacattttatttttaaaagtccttcatcaaaccaagatattttgctaagaacatgtgtcagccacagaatgatgtttaaagtactatatctagaacacaagggtaatttattttgagaactttttgtcccaaaatttttttctggtgaaaaaagggctgtagctgccattatacattcaaattaaccaaatttaaatgtgaaggtaattaaacaaaatgagtacaaactacagaaggagaaactgttctcaataacataaatcacagaaacagaaaacataaatttcacactttgctttggctcttttgggagaaaaaaaatatgtaacagtctgagtattgctatgacctgaaagccccaacccaataaccctgcactctttgcaagttctaaataaatagcaaagtgaaagtgtttggtatgtgttaatggtcttagaaatgagtaaaacacagtcctaaaccttagttctgttggacaccccatgttctataggaatatataatttactagactgagtgtctgaggaaaatgacatcagagcaagaagaacccattcacccatttttttcccatactagtgtgatgattataaagccaaagaatggagattcactgactctttcgccacagcaaagaaagcacaatatttactggctaaaacttttggatcaagaagtgataataatatttgtaagttagaagagtgagtctcagaaggatgacataatttttaaaggccactaaatgggtgcaatcatatgaactcaagcttttttaataaggatgtagcttgttttctgagtatgtttttataacgtttttttttttttttacttttaaagatgtaatataattcaattccttgacctggaaactgaaaataaattgcatacataattaagtatttgtatatatgttttatttctactaatgtctaagagaaattatttttcccaattataaatgtaggcaacaaaccaagagtgttatagagagcactggtgactttattttttttttaaatctattttcatgctacattagactttatgtcaatactgcaaaactgtgatttatttttatcaaaactttgaaattgttactactaacaatattagatataatttgatgttagtaacaatcacatgaaacattttcataattttagcaatataatttttattttatgtactctcatatactcatttagtttaaattaacaagagtcctatagtttccaaaggaaatagtgagagaaaaaaatatgaaaaatggtgatgtgtggctcaatgacagaacacattattagcacacacagatcctggatttagtcactaagtcaccagtaatgtcttccccatagctcacacacacacacacacacacacacacacacacacacacacacacacacacacactcacagggataaaatactcatcgaccacatcaaaatacctacccagcaagatattgttgtgtaatctgtcaccttgaaatttactgcctaaaaatgacagcaactattttcctgtatctcagcatgtttctaggtttaatcaggctcagctagatggcattatatgccccactagtgtatcactgcttccttattgtagtgtagaaagaatgcagtttcaaagtcttctccattccttgattaaacttcagctgggtatattctcatttacacatgcagttctctcttagctttttcaaaagcctactgccttttagaaagtagctcagtcggtagatgacatcatttccatcaaagttccaggcttgcttaaattcaagaggagatggtctgaactctccatataaggaatgtcaaattgtaagaacatctaggacagggtgtatttggctagcttactttggaaagaatagggaatatatattccctatggcttggggaatttttatggaattcttctttggacttgtattttcttcccttctttgtatagtattgtactcttgattgtctttcttcttaaaagtagcacttttaaaacaaactgtttagctaaattttatttcaggatgacatgatactctctcattcccccgtttcctcctcaatccaattttggggaattctacgcagtattatctgaatctccctgtgattaacaacttacatatttactttctctttgagcagagtttgtgtgtgctgctatttaacttcaaccctactcatgggtttatttacttctttttttgcatcacttatatatgagcccctttatgtaccgtgagctcccaagggcatacttaacaatttctcccctttatctcacaggactagtcacacattaatgctcaagtaatatttatgaaggattgttctttcaaattcatttttctgctgtcagtcagagtcagccacccactttccataaattaactgattctgtgttatgggtaagtgttacaacatactttgaaaaatattctgaacatggtgacctggttatgtgtatagctaaataactggactggcagagttggacagtgtagtacaaaagtggatcctgtcaaaatagaagataacagaaataaagaaaagaaaatgaaataggttgcataattgcattggcagattgaggtcccagcaagtgaaaaggttttacagttacttacgagattcttatcttctgtcaaattgcaaattcaaattttccaatggttgaggttttttgaatttgtcaaaataccttttcagttggaaggtgattttccagtgatcatgacagtagactcacagagcataagcgcagaggatacaattttccaaggcagtatacaaaaatagtattgagaggaactaaagtgatagtgtcatcattgatgctacacttctaaaggtgtgtctcatgggttatccacagccatggcactaaatgtcaatattcactgtgctgaacggcttgagactcacagcacatgtggtagtgcaacaactttcatttactatgtctttccttgcataaatgaaacatgaactcaaggagacagttctagctcaacatatgcaaataattcttacaagcctcttggtgaagcatcacctctgcctcaaaatcaaggtcagatggaacatccaatgctgcagcacagaaccactgagaacactacatccaacactactaccaaatgctcaggtgtttggacaaagtaagtgaaataccagaattcctattgcatggttgtccaagtgacccactaggagagacaaaaacattctcaggacgtgcatttcaaattgccatgacccatcaagaattaaccttggcaagacttaaatacattgctgtagaaacatatctgattttttggaactcatctaaaattagaaactgtcaatttgatcaattatttatgtgacttttattcttaaaaacaggtcagctggctcacaagaatgacaaattttccatacaattaaagagctaataggatttatttggcttcttagtgagaaccaaagatgaacctttgtcactagagaattcctatagctttaagctgctttgaaaattcttttttttctttctttctgccctttgtgtaattcttacagtattatgcttgtttctgtcagagtcctatgtagcccagggtggtcctttaattcattttattttattttattttattttattttattttattttattttattttattttatttttatcgagttccactgatactgggcggattggcaacacaccttcctggtgatacagaggccatcactctccttcctggtgagaaaggtattttcacaacctagacagagattgtgctttggagagatatatttgactcaaactcaccgtaagtgttttacaaacagattgtccatgacatgtacatatgcttcactattccccaagaaacaatgccaattctgtctgccaatagcagatcatgctatttaaagtaactgcaagagaggctgctggcaagatgtctcagcaggtaaaggcacttgtttccaagcctgccagggacctgagtctgatcccaggttctgcaaagtaagagtagagagctgaccccttgcaagttgctcttatgtctccagatgcatgttgtgagcatgcaaatatatcccctttctttcatcctgtgttttgcttcattatttgtgactttttgtttttttattttagcatcttgagtcagcaggaatttgggatccaaaacgaccacttttataagtgctaatcaaatactgttgtttctattgtcgtttattagaggagaaagtgtagtaactgcttaaatagaggttttgatctaatgtacacatattttgaataaatattttcatactatcaatgattattagtatatttcttcattatttacttggatttttgtgaactaacatataaatttatatacattctgttcattggtaataagcaatctatgctgttttagcttataatgtcagtagcagatatttaaactactaccttttctagaaataacatttaaaatgatttgatacatatttagtgaatgaattaactctaagagtaacctctgcccttttttaaattcccatagcttcatcttcttagaatctttgagagtaactggcccatttcctgccagcctctactagcaacagaccaatatatatctagtgttttacaagtaaaatccagtgtccttttgaaacccccatattggtttctcaaaataaaattaactataaatatgtttttattcattttcttcaattacagttgaggaagcaatattaccttatgagttgggcttccttacattttctagaaccctgttcctcgtagcacctttcagggtactgatcactcttggtctcagggtgtaggaaggaacaaattcccatacaagttcttactgaagccagtgtattctgcaacacagagtaatttttctgcatctgaagatgtctcgtaaaagctttcctttggtagcacagcaattttagatacagaagtatggaatatatttccaactattgttatatgtttatataaagcacattttttactgctacagttattagtcacattatctactgagtgatctcagcaacacaagacttttgaaatatcttgattttattcacatcaccattaatgtcctatgagttaacattcatgtgaagccttgtcatttatagtgagggctgttgagtggtagaaacatattgattaacacaccacattcacaaagtaatattattattacttttacttgtttcatgaagtaaatctggaaactataattacatggaggaagcagctttctaaggaaagtctagtgaatcaaaccacagtctttatgagtctgaacacaagaatatctaaagtgccatttgcttcttgatgcaacagtgtcctgagagttgtaataaggtatttctcacctcactcacattaactctacaaagtattacaggaaatattttagcgatttaacaataaaattttgatataacatttggaattgcaattttattttaatgtacagaaaaaaaaaacactgtttaaaatgttgtgattctctcaatataagaagtgtaaggaaaccagaataaaatatttaatctcaatatgtctagtttcccctggcacacagttgacttctcttgtgatgggcataggcttaccttacattcaccccctgtattctcactggtcagagcctcatgagcatctctctacacactcaggctttaataaaaaaatcaatgttagcccagcatgaggcaagcctagcaaattatcatggaccaactctaccagaatttcaaaaccttccttaaatcttccttgagagattgaaaagcgaatgtgcatttcatgagcaagctgaactttcttggaaatgcaggggcccatgtggatttctatgaaccctttcccttgtaggtagctagactggcatcttctaatgattacgttaaaaaaaaagtctcagacagcagaggagagaggtgggtgtggtcacaggtgcaaacctatgaaagactggcttctaatcctgctttcagatatgcagatcagaatacccatcactttggattacccactaatgtaattctagctgttgtcctttgcatcttgccaccatattaattctgatagaaagagctgcataagccttaacccctgaaaaggtgccttctcaatgtggtgttacaaagcactttgagtgtagtaaaggagaaaatacacaaagcacaccacattactctggagaagcctttttttttaaataatttttgccttctacattaatatctaccattttaaccactaataaggatgttgcacatgacttttaagttatagggacagtgatcatgatgcttatatattaacatactaaaattgttagctcattctattaaaaaaactgcttgttttcccgagcataaggaactgagatcagttccctaacacccatggagaatgttaaacatggcagtatgcatctatatcgacgagcactgtggtgttaataacaagagcacatctggggcttcatggctggctacctcagcagaaatgtcaagttatatgtttagtaagagaattctttctaaagaaaaatagagaaaggtaaccaaagttgacctcttgtctatacacatacatacaaacacacacacacacacacacacacacacacacacacacacacacacacacaaagagagagagagagagagagagagagagagagagagagagagagagagagagagagagagagagagtctcatatatgagattaagttccaaacacaggaaccctaatcctaaacctgtgagtacacaggcatttccactggcctgatcatcatcacaggaatctagcaattgttgacatcatcatctgccccaggtgtgccatgtgtgtgctgtaaataaaaaaccctccagatctctttcaccctggttcttcttctctgtttgtgttctccaccctccccctgctcccaagtttccctgtttgcctggggacttctttggcctcatttcctgagaccagtgaattgcccaaaagctgtccccaataaacctgcttctatatttttatatttttccttcctcttgaattggcttattttgttggtggagcaaactgaaaacctgttatatataaataagtacatgcatatatatgcatcacacagagacaaacaaagacatagacacacacacacacagagaagaagaagaaggagagagagagagagagaatattacttgttttctcattttaaagttcatagtcagagggttatctttgtcaatatttttattgctgtgaagagtcaccatgagaatggctattattataaaggaagacatctccttgaaactggtttacactttagatatacagtccactgtcatcatggaaggcaacatagccataaagagatgtagctgagagctctgatctgggtcagcaggcaagagtaagaaagggagacactgggcctgacttgatcatttgaaaccccaaatcacactcccagtgacatacttcctccaacaaggccacacctactccaacaaggccatatgtcctaatttttgttaaatatcgccacaccctaacaaccaatcattcaaatctatgagcctatgtaggccattttcattcagaccatcatagaccctattataaagagtgtagatttgggaattagttcctgaaaggatatgatttattagacagcgctttagagctaaggaaaactacgaatggcttagttccttactttctaacttgcaattccctgttcatgtgtttcctacattgaatacatgtagaatgtcacagttgagatgagtattctttactcaatatttatagcaagcccaacacaggattctgttggtcctcaaacaggttatgaggtcctcaagctcagctttcttactgtcgacctaaagagatatgtgaaagaagggagtaaacagaaatgtaaactttggataggaaagaatacctcacagatagggcaccttgtctactatgtgaggcgatatccacagggtagatattctagtagtagaatttttcatgttcagatagaggaaggtgatgtgagagaaaggaagaagaaaaagaaagagaagttgagtcaatatatatggaaagaaacaaaactccatttcacaagattacatgatcaaatgttaatggactgaatttttgaagggaatggggctgccattgctgaactccttatgtgactgccattgtatcatgtttttcagggcatactaatcttaattattcttacccattcaagtcagacatcacagtgaagtcaaggttctcagagatgagataacaaatcctgattgaatttgtacatcttgactgtcctgcacagctgataacaacttttcatttcactaaacatttgaccagggtactgaatagttatcttctagtctgcaatgttgatgacgatcatagcagcatgactagtagactcaattgtgatgagtaaggtcacagagtcttaattacataataattgaaattgtgtataatttttgtgaacatctgtacccagagacaccattaacatttaatacttgatccccgtttgacattttctactttccagactttttgaggttttaaaaaggaaatatttcttttctgaattgtttttttctgggttttttttttctctctcttagaagaaagaaagtaaactggattattatttatataaaaatcgtgaaagaaagtaagaaaagataaagatcattttttattatttccttccttttctttttccttccttccttccttcttccttccttccttccttccttccttccttccttccttctttccttccatctttccttctatcctttctgcctccctttcttccttccttccaatttttaaaggagaattttcattggttttatatcagagactttgtgctgcttatgtattgataaattcattctatcaaaagttcagaccatatctaaccattcaaactggtaggattcaattgtagtgtttgcctcttatgcttttatttgtttgttacttctatagcacaagtaacttaatagaataaaatatcttcatgtcatctcttccaaaattgaaaaaaaatctatatttaacaccctttacatagttttcatgctctttgtttcactcttctgtaaaagggattcttttcttaatcatgtccttcctattaagcctaggagttgctctctttagttttcttttcacatttcaaattagcttttatttgtatttgattttttttatatatataaaaacattcacattcatcagaagctaaagttctgtgtccatatttctggtgttctttaagtttcattaaattgacatgggacactggatatcttctccataatccactgatgagattgctaagaatggtttgttactattgtttgattatttctgcaggttcaaaagttgggccaggtagtcatttacactttgatacatcagggttttccttgtggagacgatttttttttcactgaaattttttacatacatatgtgaggaaaatcttcttaacaaaagtagagcgttgaacatgaactaataaaagagaatctatgaatatccttaattcaggcagagcagatattctttatctcattttccagtgataagtatttaattgccctttatcttgtattattaggaagctgtagtcatgtgtgcacttagttgaaaagagtcccttacaccattaaacatgtttgccttggcacaaggcatcaagggagtttcttgtcaccgagttctaagacagcatcctgaattagctgtttccagtttttgaaaatgtcatgacagttgtccaccttaggggttgcctctctcaaaatgtttacaaaatcctgtatggcatccttggcaagcagaccacttgtagaagtgagttagtctgtgctttgttattgggctgatgagccgtgggcaaaaggttacacaagacaggacaatgcaattgaagttgaaggaaacaattaactttgcttttttttcgtgctgtttaaacaaataatgatatctcctgcttccctgtgctatagtgatgactctccctgcttccctctcataatctgttgaaatcagcaaatggtgatcctaattaatatgtgtcctgatgaaagactgaaaaacaagaatggcccaatctcataaaaaacaaaacaaaacaaaacaaaacaagcaaacaaacaaacaaaaaaacctgtgttccatggccaaattaaaaattcctcctttgcgtgaatctgaactgctatttaataagctatttagttagcaacctgttacatgtttgtgtttcaagaaccctccaaatgtttcttgagtcgttttcctcatattgcttttgatactcagagcatgaaactggatttttggtggggggccaggctctcctgtgaggtctttgcattcccagaccctgtatagcaagaaatgttctaatgcatggaggagaaaacagttttatcctttgcatgtaattgctatgcatatttaaagccagttattggactgatgctatgctataaaggttaaaaattgcagtaatcatacattattaaaaataaggatatgatgtttgaatttattaggaaaattaacttaattcccttttttatgataacttcttgcacaagggactcagactcatacaagctgcagtgttacatgtaagtttggcttcttgcatttgtgaaatccacttgctaggaccaggaagcaggagtgggtgggttggtgagaagggggagaggggagagaatagggggttttcagaggggaaactaggaaaggggatgataacatttgaaatgcaaataaagaaaatatctaataaaaatgctaaaaagattaaaaacttatctttttgaagcatagtaatctttaaatttcacactggtttgttttatacacacacacacacacacacacacacacacacacacacacacacacacatatatatatatatatctacttccaccatgtatgttctttggggtcaaactcaattgccatcctaagcagcaattagtattatctactgaactatcttcactccctaaacatttacatttactttttttgttttgtttgtttgtttgtttgttttgtttttgttttttcaagacagggtttctctgtatagccctggctgtcctggaactcactttgtagaccaggctggcctcgaactcaaaaatctgcctgcctctgcctcccaagtgctgggattaaaggtgtgtgcaactacacttggcaacatttacattttttttaataaagtttgcttgtccaatgggcctctcattccagtgatggccgactaggccatcttgttttttttcctctttttttttaattaggtattttcctcatttacatttccaatgctatcccaaaagtcccccatacacacccccaatcgcctacccacccactccccctttttggccctggcattcccctgtactggggcatataaaatttgcaagtccaaagggcctctctttccagtgatggctgactaggccatcttttgatacatatgcagctagagacaagagcttcggcgtactggttagttcatattgttgttccacctatagggttgcagttccctttagctccttgggtaatttctctagctcctccattgggggccgtgtgacccatccaatagctgactgtgagcatccacttctgtgtttgttaggccccggcatagtctcacaagagacagctatatctgggtcctttcagcataatcttgctagtgtatgcaatggtgtcagcgtttggaagctgattatgggatggatccctggatatggcaatcactagatggtccatcttttcgtcacagctccaaattttgtctctgtaactccttccattagtgttttgttcccatttctaagaaggggcaaagtgtccacactttggtcttcgttcttcttgagtttcatgtgttttgcaaattgtatcttatatcttgggtatcctaagtttctgggctaatatccactgatcagtgagtacatattgtgcgcgttcctttgtgattgggttacctcactcaggatgatgccctccaggtccatccatttgcttagaaatttcataaactcattctttttaatagctgagtagtactccattgtgtaaatgtaccacatttttttgtatccattcctctgttgagggacatctggtttctttccagcttctgactattataaataaggctgatatgaacatagtggagcatgtgtccttcttaatggttgggacatcttctggctatatgcccagaagaggtattgcaggatcctccggtagtactatgtccaattttctgaggaaccgccagactgatttccagagtggttgtacaagcttgcaatcccaccatcagggaaagaagtgaattcaaaagtaacaaagccaactcaaaacttctttatacccttatttgttcctttttggttttgtttttcattacagtaaagctaatatggtaataactttagatcttatgatggacaaagagttttaactctatcttcagttttatttagtagcttctctcgttggttgagcatcacgctgagatgctgaccaagttctgaactttcctgtctgtattcctgctcatattcccagactgtccatgaatgttatttgtaatacagtttccctgaccccaccccctgaccagtggaggaaaaactgaaatttgaagattgcataatactaagttcaattataaaatttatacattgcatttctgttcttaaaaagattatatgttttaaaattatctgtgtctttggttcagattcttccctgggacataatgttttgacattgtgtacactgagctgtataacataacttcatttctttttctcaaaaaacaaaaaacaaaaacaaaaaatgaaaataaaaaaaaaacaaaaacaaaaatcgccatagtttgtatatctcacaattgttcgtacctcactgaaatgcattggggttgtttctgctttcaaaattagtgtagacagtcttttccttactcctttcctttcttctttcatccctatctcctgtcttcctatttgattttatttttaaattataatttctgcaatatacatctaggagaataattactcctaacatggtaattctacacataaatctttggatactcccagaatttcatttgtaacctttggtttgattttattttgcaaatggttctcataattcatttacattatcttcatgagtgtaattttaccaaacatccataaagtagcaaagtggccatcatttactgatgttccatgcaagatacagaatcagcaacactaagtgctttgctgtcgttggtttcctattttccttacaagagctctgtgcatcaaccattttagtatctctaattttcagataaggggactgagcttagaaacgaaactttcagtgacccaagcttctgagctgttcagttgcaagtcaagtgcagaagtgtgaccagaggacccatgtaaaatctcttttgcctccagctctctaccctccaaatctctagtatttaatacaaaaagaattcaaaagttattttaacagtatgaagatagtttcacacattctttggagacaggagcctcattgacacctgtttttccattcctcctcatttataccctttgatttatttgtggaatcaaactatttgataatattaattcataattcacaggtccattacacccaaagttttttgttttgttttgttttgttttgttttgttttgttttgttttgctttgctttgctttgttttgttttagtttttcaaggcagggtttctctgtatagccctggctctactggaactcactctgtagaccaggcttgtctgtaactcagaagttcacttgcctctgcctcccaagttctgggattaaaggcatgcgacaccactgccctgctcaaagttttaaaataactttccaatggaaatggatgtaagccattaataatgtctgacattattatccatgtgtcagaacaggattttttctggtcactattaggactgtgattttaatctcttgaaacactttggcattatagtacaaaatatatgcccagttctactattatataattgattcaagtaaaaagaacaggattacttgagtaggttaagacaaaaatcatatcaattccaataataacctacttctcctttctcctattacctgttgtatgttggcttttacaggatcacatgtttcacataattatctactgtcaatgataatgtataaccaagtgatagccagaaagtatgtactaatcatacaggaacattggaaatgtagctatttacctgaggaattaaaactttgttttgtttaactttgattaacttaatttaatttaaataaccacaatcaggtagaaaccaaacaatgaaaaatctggtattgctttttctttaactctcttaaggtttgtttgttttttaactggttacacatcaattagctattcatacacttgaaataaaatcttcctttgaatttagagattattgtcataatacaattttcacttgaacagtgatccaaaacaagttttttgttgttgttgttttttgtttttttgtttttttttttgttttttgttttgttttgttttttttgtttttttttttgtttttgttttttgtttttgttttttagcaatagggaacataaaagtttattctatgaccaaaacttcaatattcatgctagacaattaccactccctaaatctacattctggggcaaaatgaatactaaatgcttggtctcagctatggctaatttggaacctgttctctgtactctgagcagtgctggggaaagatggcagatttatcctgatgacaaaccaacttgactgtttcaagatgaagtgattttattagaatcgtccgaatcaattacaaagaactatttatgttttttttttgtttactctcacaagtgaaggcaaaagcaagagaaaaaactcaaatgtcattgccaagaatactccattttatgcattttaattccttatgaaacatatgttgctccaaaacataacataaaaattatccgtaaagaaaattaatataaaaatatagagatgtttgaagcgatgtatgtcaactataaaaccaagaataagatgcagtaaagcattatattttaaaacaaaatttaaaaatatggtttgaaagtttcacacatacacacacaattttttacttcatcaatctctcacccatctctgtttccccattaaatccttcctttatggtgagtctcccacctaattttacatatttttttttgtttttctggtgtactgaatttaataagaggttttgtcttttcctttatatgtaaaagagtatatttactgaagcaatgttagtttatctgttactatactgttgaataaaatgatactctttattctaacaaccattattttccaataatccctactggataggctaggatctcatgttcaccttctcagtccacaataaaaggttgatgggtccagtcttctgtacctttcaggcagatacacacctattgtgaactcttgagagcaggggtcacgtccaatctagaagatatattttgactccctatctccccaatctgagtgtctttctttcattctgtcacatcttatgcaacattccaagggcctcattgtattgttctttttcttagacaagtgtgttctgctgttatatttacaaagagtgcacattttaagaaacatacattcactgttgtagtttaatagtgcagggagttgctctattagcaggtatggccttgttggaggaattatatcactgtggggtgggctttgagaccctgctcctagccacatgggagacagtcttctgtttgtctttggaacaagatgtaggaccctcaactcctctagtgccatgctaatctggactctaccatacttcctagcttgatggtaattgaactgctgaccctgtaagccagcttcttttaaatgttgtccattttaatagttgccttggtgtggtacattttcacaatggagtactactcagctattaaaaataatgaatttatgaaattcttggacagatggatgtgtctggaggatatcatgctgagtgaggtaacccaatcacaaaagaagtcacttgatatgcactcattgataagtggatattagccccgaatcttagaatacccaagatacaatttgcaaaacacaagaaaatcaagaagaaggaagaccaacgggtggatacttcattcctccttagaataaggaaaaaaatacccatggaaggagttacagagacaacattgggagctaagacaaaaggatggaccatccagagactaacccacccagggatccatcccataatcagtcaccaaacacagacactattgcatatgccagcaagattttgctgaaaggactctgatatagctgtcttgtgtgaggctatgccagtggtggtaaatacagaagtggatgttagcagtcatctataagatggaatacagggcccccaatgaggagctagagaaaatacccaaaatgctgaagagatctgtaactctatagttagaacaacaatatgaactaaccagcacccccagagctcatgtctctagctgcatatgtagcagaagatggcctagtcagccatcattgggaagagaggccccttggtcttgctaactttatatgctccacccagtacaggggaacatcagggccaagaagtgggagtgtgtgggtagggaagcagggggggagtatagggatagcatttgaaatgtaaataaaggatagcattttaaatgtaaataaataaaatatctaattaaaaaaagagagaaaaaaatagttgccttggacatggtgtctcctcacagcaatggaaaccctaactaagacactcacccaacattttaaaacttcttcatattgctgtaaataatgctttcagatatactaccacataaacatattaatcaaattaatattcgttcaagtctttatacatttaaactgtttcagattccgaagtattctctggactttataggtcttcccagaatttgaagaaaccacaaactatcatttctctttagctgaacttttattatagaggacatggtgactccctacagttttagagttgacatttaagtttatgatagagataagaaaaccattagtgtttaccagataaagaaacagcaaaataatataagtaatatatctttattttcatatatctatacttacaaagaggaatgccagaactaagtgaacaatataaaaataaaatttccattgattaatgccattaaaagtacacaaatactaaacctatcatgaattttactattttcatctgtgaagtcgggggcagaattgcctgtgtgtctatgtgtgtgtgtgggggggtatatatttgtttttgtgcatgtgtgttacaagtctttcaatcaaatttgaaagcctgtggaagctcaggctcagtgtcacaacccagcaactaattataaaatacttgatgaaaactgtgatctgccatgtgtttcttcataggcattacttgccagaatataaaaagtaataaataataaactaatactctatagatacttaaacctttactattctctctctgtgtgatattgtaaaagaattataaaacacacaccagggcacagttccacttatgcctgcatgagtgtgccaagccctagtaactgatgccatggcttgtggatggtgaaatgattaaggtgttgtgaggattttgcatcatctgaacagttagctgttgccaaagtgaagagatagctggttcatgttttataatgggaaattgttgtgtcgagcttcaagggtcagtgtttattatgacttttttcagtccccaaatggttctattctctagatgtctgaaatatgcaatctgaaatccttaatataattgaatctaattttatgaaaacaaaaacaaaaggaaaggaaaaaagaaggagtaggaggaagaggaggaggaggaggaggaggtgttgtgaagctgaacacactccggatcttaactgtgccctctggggaaaggaaagtcgaaagaatgaatattagtcctaataaggaaacatttcattgcactctttcattctagtaaaaatcatctcagtggagagataaaagcacatttactatatttgccagaatggagatgtgattgtcggaagtcgggttattttatatttcattttgcactaatctctttttttgatatctgagcacaaggaaacaaaagacatacttctttcataatacagttggaggacatggaaaatggactttatttccagacattttctattatgagcatcattctgacaatcattttaaacagagaaatggaagtgtcagctattaaaaagacattaactcccaaattacaatgacaacattaactttagttagtatatctacaggggaaatgactttctaaatatttatctaagcatgcatctcttttatattcagtcaattcagctcttgtcttcaattgtgaaattaatctgtaattgttattatcaggactaataaagtcataggagttattccagataaaagagaaacacagacaccatacaaagttcatctgtccttgtttgttcctttcattagctagatctatgtttaatcattcaactgaacaaaaattatataacttttcacaagctggccaaatatagtaacaaagataaaatgtgtacaaagtggacataccttttataaaagtgtattaaaagtaattgttcttaaatatccataggaaataaaaatgaaaatggactataaggatactgtatctattattttatacaacatatatttatatataatatgtacacacacacatatgtatacacacatgattttatatctatatagatagatagatagatatatagatatgagttgattacatattacaataatagtactatttattatctgggtcagttgggaacatctgaagtcagtgacttaatccctttgaaaactattaaagatttctgcaaagtatctgtcattccttttccgagtgtggaactttctatgtgttcagtaagagagagaaaataaacttttgttaaggtcagttacatgcagaaaaacctagacacagacacagcaccagttaagtagagagctttcaggcagacacagactcacactaatacaacagacaaagagaggagagaaaacacaagagagtgaagcagaggatttaaatttggtctttttcttggttaattgacaccgaagggaagtgctttgatttcattatttaatgtaacaccagtgcatcatcaataactcagacattaccagtgtttgaactggcaacatttccttatcaggaaactgaagataaacattgaaatgacttcaaagttcaaatgtttcttagattcataagaataaataaagaaaagaaaacagaaacaaacaaagtgaaaagagttgtcatctggaacaacagttcagtggataaagttcttgtcaaacctacaacctaagtttctatttccataaccatgacacagccatcgtggcataaaacactactgcagggatgtgcagaaaggataggtagatcccagaaatgactgatcagtccatctacctgcaatgctgatctgcaggatcaaggccagactccatctcaaaaatgtaaggcagattttaacagtattaatgttgcttttatgaacttggttgccattgtgtttggtgcatagattttaaagattgcaatatattcttgttggatgcttctattgatgactaggtagtatcttctgattatttttggttttctgtctgctttatcagatattaaaatacctatgccttgtttcttgtgtccattttcatggaatatcttgtttttttatggaatatctttttccatatttttaccgtgagttgacatctgtccttgatgttaatgtgtattccttggagtcagaagcatggatcctgttttctaacccaatatgttattttgtggggtctttagggggcaggaaagagggtaaactctctctctctctgtctctttatctctctctctctctctctctctctctctctctctctctctctctctctctctctgtgtgtgtgtgtgtgcgtgtgtgtgtgtgtgtgtgtgtgtgagtgagtggtgtaaacacacactcatgtgaaagcagatggcttcagagatcagtagagggcagtgctctggtgtgaaacttatgcatggttagcagttcagtcttccttaagagaaaaaaaacaaacaaacaaacaaaaaaaacctcctaatcctaacctctaagtagtctatgagatgaaataatcttaatcatttacccctataagatctgtgaatttctgtatgcagtaagctaaacagattttcacagaaaagtgttatcatgggaagtgtgtctatttagctccctaccttttgttcaattccactcatatgtcctaaactgggttaatgtaatatctttaacttttattttacaatggcagctgactcacatctatgtcccaatatagcctttgtttactacatattttcagtgtttattcttctgatgtttgttaagagtataagctgatataatgaactaagtctacttgacttctgaatgctattcgtcatttaattcattcatggccctgaggctgttcacaatttaaaacaattcaggagtcaacccaaaagatcctttcatttgtctttgcttcctttgatctttggagtgccctgattataacactaaatctttgggggttggcgggagtatggttaaaccaagtttccttcctgattgatccccttttcttgatcgtcaaagaatatggtaattgctcaatttatttctaaaccaatgatagaaaatcttgacacataaacagctcatatttttcacacttagatgagatttcattagtttaccacatcactaattcactgcaatgcaaacacaatcttaagagttcttctcacctcagccttttagataatcaccaatgaatcatcataggttaccacagatatttattgtagtagtagtactagtagtagtagtagtggtagaagttgtagtcgtagtcgtagtagtagagtgtgtgtgtgtgttacttaaggccagtaaatgcatccaagcatgcacattttcttttcccctttgaattaaacatacctttgacacctacttcagttctactgaatctatcttgcaaacggttttaaaattaagcaagtgggccaatatgattttaaatttcaggaaactattttctaatatggaattgatcttgacgaatgactgaagcagcatcaaactttatagaaaggcacttgaaagaattactctattctgtgtcctcagtggttatcacaaagaaacatagtatatttctatccttcatgtattagctaatgtacagtcttgtttaaaattcatcatcacatctaagatccctatagtgaatatataaactgtatataatagaagcatatgaaccttaaccatttctaacctgccagacctgagttgttcccagttgttgccagagtatgactttactaattttgtctgaagagcctatgctaaaagtaataatgacagtcttttttattttgtccatgataccaccatcatatcaatgctatgtagcagactgtaagagttttgatctcgccattgtctataaagatgaacatgatgttgttatttttaaattagaagcttgtcccttgcttctaggtcttctatgcagatccaatctaaagcttaaaatgaaaaaacacaaagcaaaaacaaaaacaagcaaatgaacaacaaaagagtctaaaccaaaataaaaacaaaacaaacagaatgaaactatgaaatacaaaacaagcagaaacctgtggaaatttgcttaagaattattatggaattacatgattattaaaattcacttaaaaagttgttggcaaagacaagtttgaaattatataccgaaggctacaatgatggtacatgaaagaactagtcttgaattgagatctactttccttcaaaggtcaaatgggaataactgtcacaatatcaacaatcacatttccaaagacacagtgttctcacatctagcatagcctttgtaaggaccgattttgtaaataaaatttttggttatatgatttatgaaatcaaatgtttaatatattatgtatagcatatactctaaggcatcaatacattgtgtaatatttaaatcagattaaatgtatctgtttccttaagcatctgttcctctatgactcagataaatggaggagtggggagaaggaagttttagggaattctgtgttgcactagagatgagggtagaatggaaaaggaagctacagcaggaggtctgctactgagcctagtgagacttaggaactgaatttagagaaaagtcgagagaggtgaagatctgcagttaggctacctgcttccttggactagaaaacctatatacctagtgtaaaatttccccaaaatgtggggattaaagtgtgacactacatgagtgtgtgtgtgtgtgtgtgtgtgtgtgtgtgtgtgtgtgtgtgtgtgtgtgtaagccaaggaaatgtatgtaggaacaaatcccccccccccattatagtataaaataggtttgggggattgtcttagggtttctattgctatgaagaaactccatgaccatgactatgacaatggcaacacttataaaggaagacatttcattgggcctagcttatagtttcagaggtttagtccattatcatcatgacaagaagtatggtagaatgcaggcagatgtgttgctaaagaaggagctgagagttctatatcttgatctgcaagcaaaagaatgagactatgctgggcagtggtggcacacacctttaatcccagcatttgggaggcacaggcaggtggatttctgagttcgaggccagcctggtctacaaagtgagttccaggacagccagggctatacagagagaccctgtctcggaaaaaaaaaaagaaaaagaaacaaaaacaaaacaaaacaaacaaacaaacaaacaaacagaatgaaactatgtttcatactgtcacctcacagtgggcatagcttgaacatatgagtcttcaaagcccacttccacaaggactcactttcttcaacagggctacacctactccaacaagaccatatcccctagccatactagtctttatcaagaatttaagcacataagtctatggggaccattccaattcaaaccaccgcagagaacaatttcttgttgtcagacctgatgaaaaaatacccttacatgctgagatatctagctatcttccaacacataatttgaaaatgaatgttcttcacatgtctctaaagtttcttgttgttctcatgatgcaaaatttattttgtactcatctccaatatttcaaagtttaaggacctcaacagtattgaaaggtctttcttatgactcaggacttttttaaaactgagttcctctaaaattattacattgtcacattcttacaaaaaattaaagtatagagaaaatgatttgtttctttctaacaatgtggtcctagatgcatttgcacctccttgtccacaactgtaaagttgcccactgctattcttgctaatttgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatatccctcatctagtgttattataccacataagtagtttttagatttcactatgggttcagaatgcccagaatgattgttaaaacaaggtgtctgtcttcctacatacaggccaccattagaccagaaccatttattaagatggtttctttattccactgtgtgtttttggtttctttgtcaaagatcaagtgtccatagatgtgtggacttacttctcagtctttgattctattccattcattgacctgtttgtctttgtaccaaaccatgtagcttttatcactatggctttgtagtacagcttcaagtcagagatggtgattttcatggaagatcttttattgttgaaaattgttttggctaacctgggtttttctttttccatatgaagttgagaattgctcatcccatgtctgtgaggaattcttgaaactatgatggagattgcattgaatctgtggattgcttttggtatgatggccattttcactatagtaatcctaccaatccattagcatggaagatctttccagcttctgaggccttgctctttgtcacatagttctttcatttacttggttataaattcatgaagatattttatactatttgtagctattgtgaatagtgtttcccctcattcctttcatagcttgttatcatttgtgtaaaggaaggctacaggtttgtttgagtttagtagatccatatttatcatcctgaaaaaaagctcaagtctaagtggtccaaggacctcaacataaaaccagtctctcaaggccataagatcaacaatcaataaatgggacctcatgaaaccaaaaagcttctctaacacaaaagacaccatcaataggacaaatcagcaacttacagattggtaaaaaaaaaaatcttagatagccctatccaacagagggttaatattcaaaataaagaaagaattcaagaacttaacttccaaataactaagtacccaattataaaatagggtacaaagctaattcataactgaataatcccgaatggccaagaagtacttaaaaaaatgttcaaagtccttagtcatcagagaaatcaaaatcaaaagaatcctgatattttcccttacaccaatgagactagctaagttcaaaattcaaatgtcagcagatggctggcgagggtatggagaaagatacatacactcctccattgttggtgtgattgcaagctagtacaaccactctggaaatcaatagagtggttcatcagaaaactggaaatagttctacctgaagacctagctataccactcttgggcatactttcaaaagattccccaccttgtggtaataagggcacgttctcctccatttttatagcagccttatttgtacagaatacttaggatacaattcatagaccattaaaagtgtagcaagtagaaagacccaagtgaggatgtttcagtgccacttacagggggaatgaaataatcatcagaggcagagggagactgagaacttggtggaagagcgaagggggaggcaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctgactgagacagaagcaaatatctacaccaaacattggaatgaagtcagggacccctatggttgaattaggggaagaactgaagaagctgaagttggggaaagtgaccctataggaggaccagcagtctctattaacctttctattaacagagaccccagagagcacccacttggagtaaagctagaaggagaaatggaatgagaaactgtgggagggggcccctagaagggaagggggacaactgaaatgcaaataataaaataataaaaataaaagaaagtaaagaacaaaagaaacaaaaaacaacaaggtgtctggctccacacagccggatagaattagggaaatctaggcaggatctacaaatttgattcctaatgaatgtccacatgtctctaaattttaagagtttagagaccagtgtcacccaatccatacagaattcagtataagaaacagtgaattttctgattatcactggaatcagactcataaacggaaaaaacaaaaaacaaaaacatttccctttggcagaaaatttcaatagttctattgtgtaatatggtaagcttagctgtgaataattttatatttgaaaattgctaacagaatattttaattgttcacaacactaggtatataatgtatagtacatatattaattaggtcatttttgcctatccacaacttaatggttattccaaaatatcatgttgtcaatgataactgtgtatgaatttttcttagttgtccactaaaaatgaataaaaagtttaaactgatgctcaatataacactgaagataaaacttacaaggactttgctgttgtgagaagggaattctgtgaaatatttagcatagggactagtataagaatttctgcattggagtggcagaggtcaaaggtatataaacttttctggacagagttgtagtagtcaaaggtgaatatttatgcaaagggcttctggtcttcccacgggattgataatgcagtaatataatcaaacaatgtacttcaaccatacagtgaccctaatgactgtgaagcaatgtgactcagaaagtgatttataatgcaaacctgaacaggtacaagagacacaggctgccctcttgaaaacagcatatgtgaattgccagagaaaggaagtgtagcagacacaagcatatgccaagaagggacggtgcaggtgtcttatgtactgtgcagcagtagctgagaggctcaaatgtagctgctggagcctgaatccattctcagcagtttgccctaataagtttcatcaagtttgctttacacatgctctagcttagaagtcttagttggcatagtcttatgccaaaaaagaaacacatgtttttttcacaacttaattatctccagtgatttcattacctcccagacttgcatatttggggctacagtgaggaaatgtcacagactgggcaacttaaacagaaatttctttctcagagttctcgagaagatttcatattcaggttgcttccagatttgatttcttagaaggactttctgcgtgaatttcacatgaccgccttctgtggtctttacatttatacactcaagagcaagaaaaattgagctagacctgtagtactttttttgattgaagaaatcaatgtaattgggattagggcctttcccttttatttcaactgacctgaatcatagcacttcttttgaggaccccctctccccgcaatgcatgtacattttgattggtggctttactacaaaaattttggagaatgcggtcaacaacaaagagttaatgaaggaagtctatgaaacttaatataagatgggggctaagaaattatttaacgatcatgatcaatgtggctttgcttttttgttgtttttggttttttgttttttttttttttattttttagacacggtttctctgtgtagccttggctgttctgaaactcactctgtagaccaggctggcctcgaactcagagatacgcctgcctctgcctcccaagtgctgggattaaaggcatgtgccaccacacccagccagtgtggctttgcaatgagttatccagatattgatttagtgataaattaatatattcatgtatactaagtatgccaaaattacatgactcaagtaacatattcttaagttaatactactacttatttatgtaaggtacaatagttatttatttggaatctgtgatgtttaattctatatcttattacacttaacaatctcaagtcactttatattttgctctgtgaacctccacagagtgctcctgtgaaagttggtggggcattttaaaacctttccttagtcaccatatctaacaattaagaagaaaagttgaatgacatatggaaaataaaacgaagaaaataaatagttcaattagtctgcaaagcattgaacataattaaagaaaccttagagatattaagtaatctcagcaagatagaatttctgatatttcccctttactttcactgctcttatttgtaagctgttggatcttgaaaattagttcctttataaaattttcaaacccttttcgttttttaatgttgaacatttacagctcaagagaatagaaatttgatttcactaggaagagaaatggcaacaaatcaaaatttatttaccagttcagggaaagagaacagtgatctatcaccagatggtaaatagattagtgttacctctaatgaggtttccgatttttcaactcaatgttctttgcgaattttatgttatttgacttcccagctatttcatttattacaacaaattattaggcacaactgtaaagtctgcatttcctattcaacttttcaatgtagatttcaagatagatgaaaatcagaaatataagcaaaggagggactgttggaataaattgtgtnnnnnnnnnnnnnnnnnnnntgggaataactgtcacaatatcaacaatcacatttccaaagacacagtgttctcacatctagcatagcctttgtaaggaccgattttgtaaataaaatttttggttatatgatttatgaaatcaaatgtttaatatattatgtatagcatatactctaaggcatcaatacattgtgtaatatttaaatcagattaaatgtatctgtttccttaagcatctgttcctctatgactcagataaatggaggagtggggagaaggaagttttagggaattctgtgttgcactagagatgagggtagaatggaaaaggaagctacagcaggaggtctgctactgagcctagtgagacttaggaactgaatttagagaaaagtcgagagaggtgaagatctgcagttaggctacctgcttccttggactagaaaacctatatacctagtgtaaaatttccccaaaatgtggggattaaagtgtgccactacatgagtgtgtgtgtgtgtgtgtgtgtgtgtgtgtgtgtgtgtgtgtgtgtgtaagccaaggaaatgtatgtaggaacaaatccccccccccattatagtataaaataggtttgggggattgtcttagggtttctattgctatgaagaaactccatgaccatgaccatgacaatggcagcacttataaaggaagacatttcattgggcctagcttatagtttcagaggtttagtccattatcatcatgacaagaagtatggtagaatgcaggcagatgtgttgctaaagaaggagctgagagttctatatcttgatctgcaagcaaaagaatgagactatgctgggcagtggtggcgcacgcctttaatcccagcacttgggaggcagaggcaggtggatttctgggttcaaggccagcctggtctacaaagtgagttccaggacagccagggatatacagagaaactgtctcggaaaaaaaaaagaaaaagaaacaaaaacaaaacaaaacaaacaaacaaacaaacaaacagaatgaaactatgtttcatactgtcacctcacagtgggcatagcttgaacatatgagtcttcaaagcccacttccacaaggactcactttcttcaatagggctacacctactccaacaagaccatatcccctagccatactagtctttatcaagaatttaagcacataagtctatggggaccattccaattcaaaccaccgcagagaacaatttcttgttgtcagacctgatgaaaaaatacccttacatgctgagatatctagctatcttccaacacataatttgaaaatgaatgttcttcacatgtctctaaagtttcttgttgttctcatgatgcaaaatttattttgtactcatctccaatatttcaaagtttaaggacctcaacagtattgaaaggtctttcttatgactcaggacttttttaaaactgagttcctctaaaattattacattgtcacattcttacaaaaaattaaagtatagagaaaatgatttgtttctttctaacaatgtggtcctagatgcatttgcacctccttgtccacaactgtaaagttgcccactgctattcttgctaatttgctcatttttcatatttttctgctctctttgctgctctttcttaatatattcctagatcagtggtgtgagcagcaaccacaaaacagcctgaatattgctttagtgaacctttcttctactagacgaatttttccattacatttccattacataattcagccttactcaagttatgtacaatgtagctaggtccctcccccttatccagaatttactatgaatagcatttatcctatctagcaatagagttcttattcttctctgaaacctcatgagccaaatctctgctctctgcatttctattagcattcatatccctcgaactcttaccagaatagtctatttaactgtgttaaatatactttagagcttctctagtgcttagattcaactttccttttcagaaatttcaaaacctattaatgacatagtcaagattatgagaagagctcaattctcaacaccaatttaaaaacaaaacaaaacaaaacaaaaactattggttctatttctcataactgagccataaacttgacaaaaacaacttaaaaacttgtttatcttcactcactatgttaggctcagtctttaatacctttcgatgttggttagtaggagtatgaggttattggtcattttatatctgtagaaaggcatcagagattaatctttgtaccctactccatgtcttctttaatctccattggaagcccagtctgtgagattattttatcttatacaagttgagtattgttccaacttagaatttatatggaaaaccctcacacccaggtgtgtgacagatatgtttcttttttatttgtttgtttgatttttgattttcaagacagggtttctctgtgtagccctggctgtcctggaactcactctgtagaccaggctggcctcaaactcagaaatctgcctgcctctgcctccaaagtgctgggattaaaagcatgtactgccaccgcccagctgacaggtatattttttgcgtgagaatgttatccattcaagttgacaatgtagattaactgtaagtattgttgactggagtaacaagagatatccctcatctagtgttattataccacataagtaatttttagatttcactatgggttcagaatgcccagaatgattgttaaaacaaggtgtctgtctcctacatacaggccaccattagaccagaaccatttattaagatgatttctttattccactgtgtgtctttggtttctttgtcaaagatcaagtgtccatagatgtgtggacttacttctcagtctttgattctattccattgattgacctttttgtctttgtaccaaaaccatgtagcttttatcactatggctttgtagtacagcttcaagtcagagataatgatttccatggaagatcttttattgttgaaaattgttttggctaacctgggtttttctttttccatatgaagttgagaattactcatcccatgcctgtgaggaattcttgaaactatgatggagattgcattgaatctgtggattgcttttggtatgatgaccattttcactatagtaatcctaccaatcccttagcatgggagatctttccagcttctgaggcattgctctttttcatatagttctttcatttacttggttataaattcatgaagatattttatactatttgtagctattgtgaatagtgttttccctcattcctttcacaacttgttatcatttttgtaaaggaaggctacaggtttgtttgagttaagtagatccatatttatcatcctgaaaaaaagctcaagtctaagtgatccaaggacctcaacataaaaccaatctctcaggccataagatcaacaatcaataaataggacctcatgaaaccgaaaaaggttctctaacacaaaagacaccatcaataggacaaatcagcaacttacagattggtaaaaaaaaaaaaaatcttagatagccctatccaacagagggctaatattcaaaataaagaattcaagaagttaacttccaaaaaaataaatatgcaattaaaaaatagggtacaaagctaattcataactgaataatcccaaatggccaagaagtacttaaataaatgttcaaagtcctcagtcatcagagaaatcaaaatcaaaaggattctgatattttcccttacaccaatcagactagctaagttcaaaattcaaatgtcagcacatggcgggtgagggtatggagaaagatgtacattcctccattgctggtgggattgcaagctagtacaaccactctggaaatcaatatagtggttcatcagaaaactggaaatagttctaactgaagacctagctataccactcttgggcatactttcaaaagattccccaccttgtggtaataagggaacgttctcctccatttttatagcagccttatttgtacagaatacttaggatacaattcatagaccatgaaaagtgtagcaagtagaaagacccaagtgaggatgtttcagtgccacttacaggggggatgaaataatcatcagaggcagagggagactgggaactgggtggaagagcgaaggggaggcaagaaggcaaacaggatcaggacannnnnnnnnnnnnnnnnnnnaccagagatcccggaggtaagagactctaaagattcaacgggggtgaccttagccaaaacgcccaagtctggggctagggaactcaaacagttaacctcccatagatgggtaggacctcaagcagaaggaaagggtcactaagccacagtccaaattgctgacccagaactgttccagtctaaaggaactacagggacaaaaatagaggagatattgaaagaaaggtgggccaaaaaccagcccaacttcaggtccatctaatgggagagcaccgaggcttgacactattcctgatgctatgatgtgcttatagacatgagcctggcatgtcagtcctctgagagaccctacaagcagctgactgagacagaagcaaatatctacaccaaacattggactgaagtcagggacccctatggttgaattaggggaagaactgaagaagctgaagttggggaaagtgaccctataggaggaccagcagtctctattaacctctctattaacagagaccccagagagcacccacttggagtaaagtgaggaggaatggaatgagaaactgtgagagggggcccctagaaggggagggggaacaactgaaatgcaaataataaaataataaaaataaaataaagtaaagaacaaaagaaacaaaaaaacaacaaggtgtctggctccacacagctggatagaattaggaaatctagacaggatctacaaatttgattcctaatgaatgtccacatgtctctgaattttaagagtttagagaccagtgtcacccaatccatacagaattcagtataagaaacagtgaattttctgattatcactggaggaatcgtcttacatgcgttctcgcgaccggccaggaaagacgcaacaaaccggaatcttctgcatcaaaagctttattgcttacatcttcaggagcaagagagcaagagcaagagagagaatggcgaaaccccgtcccttttaaggagaattatcctctgcctaggacgtgtcactccctgattggctgcagcccatcggcagagttgtcatcacggggaaggcagagcacatggagtggagaactacccttggcacatgcgcagattatttgtttaccacttagaacacaggatgtcagcgccatcttgcaacagcgaatgtgagggcggctccccacagaatcggactcataaacggaaaaaaaacaaaaacatttccctttggcagaaaatttcaatagttctattgtgtaatatggtaagcttagctatgaataattttatatttgaaaattgctaacagaatattttaattgttcacaacactaggtatataatgtataatacatatattaattagctcatttttgcctatccacaacttaatggttattccaaaatatcatgttgtcaatgataactgtgtatgaatttttcttagttgtccactaaaaatgaataaaaagtttaaactgatgctcaatataacactgaagataaaacttacaaggactttgctgttgtgtgaagggaattctgtgaaatttttagcatagggactagtataagaacttctgcattggagtggcagaggtcaaaggtatataaacttttctggacagagttgtagtagtcaaaggtgaatatttatgcaaagggcttctggtcttcccacgggattgataatgcagtaatataatcaaacaatgtacttcaaccatacattgaccccgatgactgtgaagcacagtgattcagaagtgatttataatgcaaaactgaacaggtacaagagacacaggctgccctcttgaaaacagcatatgtgtattgccagagaaaggaagtgtagcaggcacaagcatatgccaagaagggacggtgcaggtgtattatgtactgtgcagcagtagctgagaggctcaaatgtagctgctggagcctgaatccattctcagcagtttgccctaataagtttcatcaagtttgctttgcacatgctctagcatagaagtcttagttggcatagtcttatgccaaaaaagaaacacatgtttttttcacaacttaattatctccagtgatttcattacctcccagacttgcatatttgggctacagtgaggaaatgtcacagactgagcaacttaaacagaaatttctttctcagagttctcgagaagatttcatattcaggttgcttccagatttgatttcttagaaggactttctgtgtgactttcacatgactgccttctatggtctttacatttataaactccagagcaagaaaaattgagctagatctgtagtacttttttcattgaagaaatcaatgtaattggattagggcctttcccttttatttcaactgacctgaaccataccacttcttttgaggatcccctctccccccaatgcatgtacattttgattggtggctttactacataaattttggggaatacggtaaacaacaaagagttaatgaaggaagtctatgaaacctaatataagatgggggctaagaaattatttaacgatcatgatcaatgttgctttgcaaagagttatccagatattgaattagtgataaattaatatattcatgcatactaaatatgccaaaattacatgactcaagtaacatattcttaaattaatactactacttatttatgtaaggtacaatagttatttatttggaatctgtgatgtttaattctatatcatgttgcacttaacaatctcaagtctcttcatattttgctctgtgaaactccacagagtgctcctgagaaagttggtgtgacatttgaggacctttccttactcaccatacctaacaattaagaagaaaagttgaatgacatatggaaaataaaaagaagaaaataaatagttcaattagtcttcaaagcattgaacataattaaagaaaccttagagatattaagtaatctcagcaagatagaatttctgatatttctcctttactttcactgctcttatttgtaagccattggatcttgaaaattagttcttttatacaatttccaaaccctttttgtttcttaacgttgagcatttacagctcaagagaatagaaatttgatttcactaggaagagaaatggcaacaaatcaaaatttatttaccagttcagggaaagagaacagtgatctatcaccagatggtaaatagattagtgttacctctaatgaggtttcctatttttcaactcaatgttctttgcgaattttatgttatttgacttcctaactatttcatttattacaagaaattattaggcacaactgtaaagtctgcatttcctcttcaacttttcaatgtagatttcaagatggatgaaaaatcagaaatataattaaaggagggactgttggaataaattgtgcaattaagctcaaggtagtaaaagcaaaaatagaaataattttttatgtgtgactctgagaagctctgaagaataaaaaaggaaacacaatgtcattgagaaacattctgtggtatccatttgttgctgtcaatttaagatgtgtatttgtatagaaaggtttgttatatatgtcctggtattaatctgagcacattgtgtgtgtgtgtgtgtgtgtgtgtgtgtgtgtgtggttttagagataaccatgcttcattaataaataataagggagcttgtttgagggaggactaattttcctttcctagaagtcatcagttttttacagttgtctagtagtgaaaccttgcctaattcccctttctacatgaacctgtccattgacattgttaccattcatgtgtttttatgatgccctttatatgagagacagttatacactggttcttacaatgattttgtcccctctccatgatgttcccggagccaaagatacagtactgaagtagatgtgtccactgaggctgagctccccaagatctatctgttggtctcttcattgtgtccagtcatggttttctgtgttgatatccatttactataaatagaggtttctttgatgagcatcagctacatgtctttgtggacctagggagatttataatgaaataagtaattatattggtcatcaaagagaagtacacatattcttttataaatacccttattctttatcaatgcctttatattatttttatttatttataacatataatagttcaaatttagtattccaggatcatagatctgtattttggtatgctttgtatatggaagacaaaaagacttgttcaatgatttcatttggattttaaatgagcacaaaataatttttggtactagttagccaagctacttttcaaaaataaaattttattttgcagaaaggttggttttccattggggaatgaaaattgaatcatagtatacgtctttactataatgtagaatatttatatatctaatcatcaactacttcagaacttattgtgaattttctaaatgctacagcccttgtgatattggtttgaattaatttttgcaagatgaaaaatatacgatagaaatagagttcttcaagagtagttatattgccattctttcactgttatacatggtaaataatacaggagtcatggctttggcatttaacatgtttgaagatctgttatcaacaagactttcctgtctcctattattcactatagaaaagtgaacagtagtgggttctcttctagggaaatgggaagatgtcatatcttagctttcatgtgaagtggtttgaaacaggtaaagagtatttgtggaagatagtatcttccatcttaagacaggaaatgaagtttaagagaaatcacataaaaactagaaaataattagatattgttttttgtttgttttgtagaatagtaaaaggagtattgaagtattggcaatcgctcttctttgaattctgcactaaatcaatctggccctgggcttttttttttttttttttttggtggggaggttttgaatggctccttctatttccttgtgggttatgggattgcttagatagtttacctgataatgatttaaatttggtgcatggtatctatctagaaaatccttcattttatctagatttcccagttttgtaaagtataggcttttgtagtatgatctgatgttttttgagtttctcagtttctgttgtcttatctcccttttcatttctgattttgttattttggataccctctcattgccctttagttagatgactaagggtttatctatcttgttgactttctcaacaagggtgttgttaattctttgtatcattctctttgtttctagttggttgatttcagaactgatttttattatcttccaccttctactctttttgagtgtgtttgcttcttttttcctcccttgctggtggaaatgcaaacgtgtccattcattctggaaatcaatctggcagttcctcagaaaactgaaaacagttctacctgaagacctagtgatcactcttgggcatatacccaaaacgtgtcccatcatagcacaaggccacatattccactatgttaatagtagcattatttgtaataatctgaaggtggaacaacccagacgtccttcaaccacagaatggatacagaaaatacagtttatttatataacagaatactattagaatactattaaaaacaaggacatcatgaatagatcatagaaagcttaataagaaggaaggctcaatgataagaaggaaggctcaagtgtggatacttcagtcccacttagaaaagtaatctaaataatcccaggaagcagagggagggacatgggtgggagacaggagggacagagcaaaggggaaaggatcaggtatgtggggagacaggtgagaagctcagagggccaggagaatgaatggaaatgtgcagcagcagggattgggatgcaggggagacctctacaaagtttcagaaacctggaatgtaagaggctcgcaggacacaatggggatggacctagctgaaatgcccaagagtggggagatggaacctgaagagaccacctcctatagatagacatggctcccagtttaggcatgaggccacacacccatcttcaaaaattttgacccagattgattcttgtctaaaggaaatgctagagaaattacccaaggagctaaagggaactgcaaccctataggtggaacaacaatatgaactaaccagtaccccggagctcttgactctagctgcatatgtatcaaaagatggtctagtcggccatcactgcaaagagaggcccattggacttgcaaactttatatgccccagtgcaggggaacgccaggtccaaaaaggcagagtgggtgggtaggggattggggttgtgggtatgggggacctttgggatagcattgaaaatgtaaacgaggaaaatacctaataaaatatatatatatatatatatatatgaaggaaatgcagagacaaaaaaggatcaggtactgaaggaaaggccttccagtgactgcaccaacttgagatccatttcatacgcaggcagtattacttataccatgttgtgcttgcacataggaacctagcgtggtgacttctctgagatgctctagcagctgctgacttaggcagatgtagatacttacagccattggatagaggtcagggtctcctatggaagagttatgagaaggtttgagggagctggagagcttcttccctctccccacaccccacatacatatatagcagaggactgcctgtctggtctcagtgggagagtatgagtcaaatcctatagaaacttgatgccccagggaaggcagacgttggtggggaggggatagaggggagcatcctctaagaatccaaggggactgcagatgaggtgaaattgttaaagaactcagggaccaggatggggggcataatttggaatgcaaataaataaaatcatataataatattattaataataataataatagaaaagaatgagaaagcccattggtcctgtggagggttgatgatcccagacaggagatcatctaggtctctgaggtaggagtgggtgggcaggtgggaaagcatgctcatacaggcaggggggatggaggaggggatagggagcttgtggaaggaaaactgggaagtgggataacatttgaaatgtatataaacaaaaaactaataaaaattaaaaagaaacttccatcattacataatcaatgcatgaagcaaaacaatccataaaagcaaaccaaaaaagggattaagtcgattaaaatattcacaatataatctgatggttagtcttgtttgtcaacctgactaaatatgtaatttactggatacacagatactaggaacacctgtaaggaattttcttaatcagattgtttaaagtaggaaaatccagaatttctggaccactatttctggtgacagcccagataaagaaaatgcaagagggaaatactggggtgttgttgttgttgttgttgttgttgttgtttgtttgtttgttttttttttttaatttgtctgctagccctcactcttgctggaatgaccttctatcctactgctgcagtcgatgttaaatctaaattctacatgattacaatatagactgaagaccagcagttctccaggaatcctccaggactctaggaccaacagcactgcagagagatgcagctacatgaactgaacagctgcaagacattgcctgtctgtcataagacagccattgttcaactatctagaccaaatcatttggaatggctaataaattccatatgtatataagcacatatatatatatacatataacacacacatatatatatatatatatatatatatatatatatatgtttttcacatatatgttactttttcagaaattcactggaacagattataacatcattttcagttctctttaaattatgttttattgcaaaatatttatataatatattttattatgttttccctctttcccaactgctcttttttgacatcttccctacctccctttccaccaaactttatgtgtgttcctctttctacttaaagaagacaagcaaaatgagaaacatgcacacacacacacacacatagtcagtaaaacacacatgacccaccccaaaaaaaacagaaaaatgaaaatcaaaacagcatgaaaccaaaatggcaaagaaccaataagtcgatgtcaatgactactgctactactactaatgatgataaagtcaaaacaacaaaaaatgaaacaaaaagtctacaaaattactatggagtttcttttgggttagacaatttcctcagggcatgatatctgtctgggaggggcagggagtcttcctcgatatacccagtgatattcaattagagaaaatagacttatttctctttaccagcaggtgataattgcagatacgttttggttagggtgggagcccatatccacttccatctttcagtcctaagactttatcgtatttgaatctgtgcctggcttcctatgtgatgtcagtctctgtgagttcatatgtggatcatttctgttatactggaagacactgttcccttgaagtcatctgtcacctcnnnnnnnnnnnnnnnnnnnncacacacacacacacacatagtcagtaaaacacacatgacccaccccaaaaaaaacagaaaaatgaaaatcaaaacagcatgaaaccaaaatggcaaagaaccaataagtcgatgtcaatgactactgctactactactaatgatgataaagtcaaaacaacaaaaaatgaaacaaaaagtctacaaaattactatggagtttcttttgggttagacaatttcctcagggcatgatatctgtctgggaggggcagggagtcttcctcgatatacccagtgatattcaattagagaaaatagacttatttctctttaccagcaggtgataattgcagatacgttttggttagggtgggagcccatatccacttccatctttcagtcctaagactttatcgtatttgaatctgtgcctggcttcctatgtgatgtcagtctctgtgagttcatatgtggatcatttctgttatactggaagacactgttcccttgaagtcatctgtcacctctggattttccaatcttcctaccttctcttggttttgaactaatggaattatgtccaagtaaacaagtctacaaaagcaattcctgtttctgacatagcactttgaggtgagtgtccctgagaatgtttccattagcagtttccaggtggtgggtagattggatcaattttcaaatgcacatttttcatgagctgagtggcctgatcccaggaggagatattctaacagacaaaacatttttatcaaacttggaaaggttgagaaagaactaaaagtgccaagcacattttccactgttgtttcaattaaccaccaccatctcagatgctctttgcaaacaagaaaataaaaatgtagaaatgtggctcttcactgccttgctatggaactctataactactaatcagtgagaaagactcaagtgggaattaagaattccacgctcacctggagacccaaaaacatccaacagagcataggcaggagctaatgttcaggatgtattattagcattagaagcatatatagttaaatacattgtttgaaacaggtattttcttttttttttcaaatctaaaatgcacactgtttaaaattgcagatgaatagttgcatatataaaggagtgtcagtatgtttgacaatcattggtcatttcttctctcttaaagagaaagaattgcagtattccttaccatatttgcattgtgtctatttatttgactacctgaaagatttgacatattccttgctcagcccaggtttagtcagccatgtggatgaaacttcaggtttctagccttagctcagccaggaaccaggctgcctttcatgctcccacaaccatgtatacacaagtaatgttataaagactaaaagagttgtatttatattattcataatgacatgaaaaacagaaaatgtcatagtataaatataattaagataaatactgtccaactatatttgacatataggaaatggaaattggtaaattaaggaattattgcttgcgatgcatttatttaggttcaaactcttttaagctgaggttttcacatagtgatagaaaactggataatattctgcacgtgttgatatgtcaaaagttaaaatgatattgatggagaaaggaattaaaatactaatggtcattctctacctttttttaatgttctgattacagatattctttatcccatttaatgcccactgcacatgccctatatatagtaactgccctaattgtttagaaagaaggcactgatgtttaagacaaatgattttcttgtgttatgtaactgatagaataagacatagaaagtttagagtaaaatgttggtctgaactgtaaggcaactttatttttgaattatgagacacttgttgaaagttttgaaaataaaattatatattttgtagaaatatggaataaatttctctattactaagagaaaaatgacctgcttaggaggaccagaaacagtttttttttttaagtttttgatgtctactagggtgtatataagcaatcatgcaactttctttcataagatcttgattattagattataaaatatcagtacacgtcgcataaataactctaatgatgcatggccaacttgatcccaaaggatgactagtatctggggaaagtatgacctatgctttaaaatgacacctgtttttcacctaaaaagttttgtctcagagaaatgaagatgaatcattgggatcactagtgtggtcataatggcattggttctctcctctactatgtgtctttatgtgcatctctatgttctgaaactaaaggcctttttagttattaaagatctagtcagaaactttcagttttagtagattcctcctgaattttccaatacctaacgtttcccttttagacagtgcatttttctttctgaacatgcaacaactggggttaaggcacagtaagtggaaatgtagtgtcatggatataataaatgttgttcaacaattttaacaagatcaaatacagtaagaatattaactggacatttttccttcttctaatccctccatacaccccatgccctcaaatgtatggctttttgtctttaattgtagttgcacatatacaaccccaccagactcacacacgtacataaatagaacatgtgtagcctgtataatgatacttgtacgtggatgatttcaagtgtgactagttggtattagatacagtctgtgtaacacaatttctactgctcttggaattttttagttaggcagagttctttgtctattgccgagggcctatgagcttcccaatccatgttagcatgtctcctggcgatatccttgttcagattttgtttagatagtcatggtgaaacttcatgtgtacagacatttttttcagaaggactctccaaaccaacttctggttcctctagctcttctagtctttctgccccctatttggatatgagctctaaaagtatttttaatgtttctcattattgatactctgattaaaactgaggtataacacacacacacacacacacacacacacacacacacacacaattcaccttatctctaattctcaatgaatcatttgcatgtcctgaaatatgcagctgcacacatttcagattgtcttctttgtgttttcaattgaaacagcagtgatttcttccctcagatgtattgcttgcaaattcaaggtaaagaataaaacaaagatatagaaagcaggtaatgtggattaatttcttacatgagggttctaaattaagtttttgctgttctcattaaattatttgtcttcaattgggtcatgtataacattaaaataagtcaaatttcaaaaattggtttattagttattgcactcccaaatccagaaagtcagaacagtatcagttttttaaatcaagaataaaatctagcatattatagactgagtaaatataaattaagttcaattattcattattgtaaaagtgaaatatttaggagactaaagtgaaacatatgcaataataaaaatggatgtggaagtcaaaggatggaccaggagggaaagaaaatctggagtgtaaataaataaataaataagaggttaaatagaaaataaaataacagctaattttaaaaaagcatacatttataaagatagttcaatggcagcttaaatttagcatctgaactacagacccatgtgaatctgttaattcacacagtctctagaatcatagccacagattttcaaaaacttacagtcaaaaaaaatttgtctgttgtatataatactagatgtttgatctagaatttgtatgtcatggttggtattgctctttcactagcattttaaaaatctattcttttctcataaaatacaccctgaccttagcttcctctccctccactctcctagaaccaccactcccaacctccctcacccaaaatccaatcctcctccatttccatgaagagaaaagcagccttcttgagaatattaacagaacatggcataaaaggtaaattttaaacaagagtcagttttaagtaatgtggaaaattaaatatcatggagtccctttatgaatagttctctacctgaaactacaactacagtcttatatctgattctgaaatatatatcttaatttaaataattcaaaatataaacatatattaaaaatttttgcaatgtactatcatgacttggacctttcttgatatatatcattatatcaatatctatatttttaatcttcctgtacttccctatatctctatatatttatatcttttcaatataaatatatatggatatggacagaaatacatgtgcaccagataagtctaataggggggtatctaatgtgtgtgctttcaaatcttttttatccctaaggggttaaataccaacaaatgcatggatctttccttctatcagagaatcgtcatgtttgatttttttttatattttacatttatcaatgatcaaaagaaataattctgaataattttatatttagaatttttttgtttagaccccaataggaatttgtatatgattctagcatttgagtccccgaaaaaaacaaaacaaaaccaaaaaaaaaaaaaacaccaaaaacctggtatgaagatataagtagtgttggagagcccaacaaatcaacaaattactttaagtggtttgagtaggatgttgggacttacctatctctcaatagccatttattttgatgatgaattaatagaatctttgatcattatcttcttcctaggatttttttttaatagttctaagggcaagacatatttgggtaattacttactctgcgattaggaagtcagtcgtgtaactaagaaaggggacagataaggtcagaattagtgtccactacaatccaggatggactgacctcttagggtaactgtgaagattaatactgaagggaaatttctatcaagtagaactcttttctaaattcatatgctctctggttggtataatgtacctctttagtactgctttgattaaacctttatctccatatttacttgctactgaacatcaggcataatttcaacacaactgcaaagctttccgtgaaaatatatcccaagttcttctagttgcctgagagaggaagcaagttcacttaggtcagtgataaacaggagcgaggcaaagccaggcactggcttgactttggcaatgaaaaatcaatagttagtggcatacatactgctaccctgatatgcagatagcaccaaaagcaaatatgggaacataagagctagctttttaaattgaactcatcagcaaatcaatagaaagttgatgacattttaatatattgtcccatattttattagagtatatttttctatgtttgaatacaattattttgtgaagttctgcatttaaatttatgcagaaatttgtttaatcttagcaaaattttattctcatttctaccttttaatgttctagacacatggccattataaccagcatatacttactttaaagtggatgctcacagtcatctataagattgaacacagggcccccaatggaaaagctagagaaagcacacaaggagctaaaggggtttgcaaccttataggtggaacaacaatacaaactaaccagtagccccagagcatgtgtctctagctgcatatgtatcagaagatggactattcggccatcactaggaagagaggccccttggtcttgcaaagtttatatgccccagtacaagggaacaccagggccaagaactggcagtgggtgggtatgggagcagggcagggagagggtataggggacttctgggatagcatttaaaagttatataaagaaaatatttaataaaaaattaaaaataatttaaaaaaaggattctaaaatgttcccccttctactaggtctcttaatttttacccacctaatcattcatgaaagccctattcaactaattattgtgtttctggactgcatttactgaacaatatacaacttcactctttctaagaagcaataatattatacatccaaggtttacttgccaatttctaggttacttgaaaagaatctgattatgtccatgttattaggttattttaataacaatagattttttaaaaaaggtaattctggaaagttatgtttttttgggtcatgtgactcagcatggtgggggacacattttaacattagtataaatctttctacaacttatataaaatcatttgataaataaataatgcaagtatctataataaactgtattaaagtcttttctactgctcagacctttacttgaacaaaatttttcaagtggccttgggtttagtgcctttgaaaaatgtatatatttatacttgttacttacttttcaaatattctaaaatggttggagttaaataccattcaataaaataattatggaattgttttttatactgtatttgagggggatatgtggcaaaagtttctgagttaatgcactgcctaagaaactgctcatctcttaccaagcagtgccatcaccatatgcttctcagtgtatgttttccagaatgttctgatctacccttctaggagctgcaaacctttacacccactaggaggtaagattaagaatgcagcttaagttgaagattacattgttatgcttaaatactggtaggacctgatcatctaagagtattttaacatgtgtatttatactctttgaccactgaatacaatattgtctagatatacttcttttgaatatttattttccttcttgttggcatcaaagcagaatccaaaagtattgtttatgatgatataatcattagtatagaaaccaattttgacgcaaaatgaacagcaagcaattctgagttccaacccgaattttgtttgtgccgtaatgcatttagaaacaatgataaaacaagaaagagccagttcactaaactaggtgccttttaaggtagaaaagtaatatattctttaaagatttgtttttattttatgtgtataagtgttttgttttcaagtgtttgcttgaatatagcaaacttgtctgatgtctatgattgacagtagaaggtattatatcatttagacagatgtcgtaggtaacttaaaataagagggagggagagcaagacctagagcatgccttagcacagagagagagagagagagagagagagagagagagagagagagagagaacactttgtctcctttttttcttattcttttgtttgtttgtttgcttttggtggctgttcatttatatttcatgtattttttttctgggttcagtcagagaagatgcacttaaccctcaagagactagaggccccaggacgtttagaggtttggtggggtgggggttgaggggtgggcacatcctcttggagacagaggggcagggaggaggattgggatgttgaatagttggaaggtggaccagtagggaaataaatgcctggggtgttaaaaagaaagaaattaaataaaaatattttaaaattaagtttactttttaattttcatagatatgtactatatttacatcatcctcccgaaatcctttgatatctccctctcaaattcatgacctctttctcattacacacacatacacacacacacacacacacagagagagacagagacagagacagagacagagacagagacagagacagagacagagacagacagagacagagacagagacagagacagacagacagagacagacagacagagacaggaaacagagagacagatagagctgagtctatttgatgtttcttgcttctattgttattgtctaaataaacagtgagcttgtcttggaggaagactactctctgtttgctgttgctatttgcctgtagacttttgcctatggacctggcctatgaaatcccataccccctgtgcacaattggcatgacaactggcattgccattgttcagttctcatttaggcagccatatttgagatgttataaaagcaggctccctgacatacatgaaagacaaaattagacttcctgatcttttaccttctctccccacttctgtactattccctaagtataagggttgtgtgttatatgtatcaagtggtgctaagcagtacatagtcagttgtttgtattttgaccagttatgactttctgtaatatacttgctgcaaacagagacttccttgataagaaatgagaactgcacttatcagtgagtataaggacacatatttagaaagcagttaggaagtataccatttaagaaaagtgacagtaaccggttctcctataagatctgtaaccttattatttaagagtatttggttgggtttagagtaccaggcatgatttccatcctattcaggggacctttagtccaattagacagttgctgattaccatcaaggtataaatgccactagttagaatgcacattcttctcaccctactaggcctctatatcctcctgaccttatcctgaggtcaacatatccaacctgtaggtccaacccaatctggccatcctgttttctggctcagtttgcaaatcaccctgattctccccttcagatacctctctaatccccagacctaacctggtttaacatcttgtgctcttgctgattctggtgaatcccatctgcaccagctgcaaactctgagctttacttttttaaaaaaattattaccgtcttgaaatacacttggagacaatttgtacaaagttcatgtccaagtggatcaaggaactccacttaaaaccagatatcctgaatctaataaaagagaaaaagagaaagagcctgaaacacattggaacagggaaaatattcctgaacagaacaccagtggctcaggctctaaaagcaacaattgacaaatgggacctcataaaatggaaaagcttcttttaggcaaaagacgctgtcaataggacgaattgggaaagcccttatagatagaggcctaatatccaatatgatacaaagaactcaaaaagttagagaacaaaataaccctattaaaaatggagtgcagagctaaacaaagaattcttaattgtaaaatctcaaatggctgagaaacatctaaagaaatgttgaacatacttagacattgggggaaatgctaatcaaaataaccctaagattctacctcataccagtcagaatggctgagatcaaaatctcaggtgacagcagaagctgtcaagggtgcagagaaagtgaaacactcctccaatgctggtgggattgcaagctgttgcaaccactttggaaaaacaacttggcagtttctcagtaaactggaaatatttccacttgaagaaccagctatactactactgggaatatacctaaaaatgctccaacatataaaatggacacatgctactatgttcatagaagccttatttataataggcagaagctagaatcaacccagatgtccctcaacagaagagtggatatagaaaaatgtggtacatttaacacaatgtaatactactctgtcattaaaaacactgacttgggctggtgagatggctcagcaggtaagagcacccgactgctcttccgaaggtccggagttcaaatcccagcaaccacatggtggctcacaaccatccgtaatgagatctgactccctcttctggagtgtctgaagacagctacagtgtacttacatataataaataataaataaatctttaataaaaaacactaacttaagtaaattcacaagaaaatggatggaaatagaaaatatcctgagtgaggcaacctacccaaaaagaacacacatgatatgtactcattgataagtggatattagcccaaaagctcagaatatctatgatgcaacccacaaccatatgtgtgtagcttaaaaggaagaccaaagtgtggatacttcaatcctacatagaaggaggaacaaaataatcacaggatgtagagggagaaagggacctgggatggagaatggagcaggagaaagaaaatgggaaggatcaggtatgggaaggagtagaagagaagtacagtgggccaggaaatcagctgcctatatctcagaggacataaatgggaggggaggcccttggccttgggaaggctcaatgccacagcataggggaatactagtgaagtgaagcaggagttggggggtgggtgggtaggggaacaccctcacagaagcaggggtatgggggatgggatagggggtttgcagaggggaaacagggaagggtgataacagttgaaatgtaaataaataaataaccaataaaaacaataacgaaaaaataaatatgtagcagtggaggataaggggctagggggtagccattagaaagtctcagatgccaaggaagtaagaccctcccaggtcccagtggggatgactttagctgaaatacctaataaattgatagaacctgtagagcccacatgtaggtaggcatgacccccagttaagggctgaggtcacacaactatctcaaaacttttaacccagatttttctcctgtccatgggaaagacagggacgaaaaatggaacagagactaaaggaagggccgtccagagactgccccacctagggtccatcccatctgcagaaaccaaccccagacactatcgctgatgccaagaaacacttgctgacaggaccctggtatggttgttccctgggaggttctgccagcatctgactcatacagatgcaggtactcacaatcaaccataaaactgagctcccagaccacaatggaagagctaggggaaggagtgaaggagttgaaagggattgcaaccacatagaaagaacaacaatatcaactaactgaactacccagagctcacagggaccgaaccaccaaacaaagggtatgtgtggagggatccttggctctagatacatattagcagaggatggccttatcttgcttcaatgggaggggagacatttggtcctgtgttgacttgataccccagtgtggggggatgctagggtggtggggcaggagtgggtgagtggaaggaggagcacccttagagaggaaaagtgtaggattagaggacatatggaatggggaatttgtgagtggaaacagagaaggaagatatcatttgaaatgaaaacgaataaaatgcttaataaaagaagtagcaaactctatttgcataaatttattccaaaatgttttaattataaagtccccaaatatctcaattttagaattaagatgaaaatgtaaatacaatattaaatataatccgaagtttatattaggtttgtgggtcgtttcctaaaatacagcatacatgtggtctctctagcctcaagacttcagaatacctttgatgttaacaagctagaaaaatttctttgaagaaacaagaaagtatttaaatacttttttccattccagttatataggtctcatgttaacttaattgttgtcactatgctagaaaataaatttaaataatttaattcaaatatttgaatcaagaaaaatattacttatatatacttacttattgtattagttagagttttactgctgtgaacaaacaccatgaccaaggcaagtcttataaaaagcaacgtttaattggggctagcttacagattcagaggttcagttcattatcatcaaggtgggagcatggcagtatccaggcagtcatggtgcaggaggagctgagagttctatgtcttcatccaaaggctgctagtggaagactgacttccaggcaaatagggtgaggatcttatacccacacccacggtgaaacacccattccaaccaggacgcccctattccaacaaagccacaccttcaggtggtgccactccctggtccaaggatatacaaaccatcacacttatatataggcaaatattttatatacatatgctatattttatacccattattagtgactatgtacttgcatgtacacaaaataaggaaagcaatacctacaactattttaaagctcaacattttctctacttaattttggtttcaggcactatttggaaatattgatcaaataacaaaactctatgaatttgttattttgatagatttatatcgttggagaagactctaattttttttctgcaaagggcagaaattctctttttcgttagatgagaactaatacatctttccagcaaaggtcatgcctcttcatcactgtgctgatgcagctcaccttcctcagtcctccatatatggaagtcattttgtttagcaacagatgtattgtatggaaacttatagagtacacaatttaaagatggcacaattaatattttgaaatttaaatatatttaggtacagccctcctatttgagagaaatcagaaaaaaaataccccaaaatacttatgtagtttatttttccaatttaatggaattctatccttgagcagtctgacttcaatctgcttagatattaagcatagttcataggtagctacataggtgtttcatgttagaatgtttctagtttttagttaacctcagagacattgtatacatttgtataaagatgaatgggaagaatcttgtctttacttctggacccatgaaaaactttatctttcctttcagatactctgtctagcctatgttcttccaagggaacttcacagatgtatcaaataatggatgatggtatttatctcagaactgcacataatgctcccttggcacagcaggtctttggcttattgagagaatataaattagtacagcccactgtttgccatctaagatgaaaaatagcctggagaggtgctcagcagttaagagaacttgttgctcttgcaaaagacccaggtttccatttccagcagctacatggtggcttacagtcatctgtaattctacttctaggagattcaatgctctcttctggatgcttgggcaaccagcagatatgtggtgcaaatactgataaaccctcatttatagaaaattaaaataacatttacagttaaaataagattcattcattgtcctggaatgcattttagcaaataactgttaacactcagagttttaaatgtattacactaaatatctgtaatattctagctgtgaaataattgcatcatttgcaaaagctgtcataatgtatagattaaatttttgtttatggtattggaatcaagagccattcactttgatagacacatatttcacaatatgagtgaggttagtggattgtccctgtcaaaaagttacataaagatggtccattcattttagtaaaatcaaaattttactatttttcattacgtgtatgtatattattgtgggttggtgtatgtgtgtgaagcacccatggagataagaagaggatgtcagaatcctgaaacttgaattacaggttgttatgagatatacctatgtgattgctgagaaccttagctcttctaaaaagagcagaaagtgttcttaattgttgagccacctcttcaaacagcaactgaaattttaaatattttttgaagagagtatcacctcttgaatccatttaaaagtttgtcatcctgctgttcatatcatagtttaacttaaagtgagtttatatgtaagcaattaaacaacttatttgctgtattaaaatcctcctaatttaaatactttcccaatctactaaactctttgttgtaccaagaggggtgcattcccagtagcatctcaacttgaacaaaactagacaggttgtaaataaccatatataaaaaaaaatcaaagcatgatgttttttcttttccctttttagttagtcatctctacatcactgacttctgattacatacttcggatttataaaagtgagagccctatttttttttatccaacttgaatgtagataatattttgaaatttctgagatggggcagtattacttggccttgggtagaatctttctccttttaaccttgtgctcatgcttactgtctttgccttctaagtacccattgctcatcagaaccctattcagagtcactggagaaagcttctcggaatccttcaggctctattaatgtcaaataccactgatattgccattattaatgggacttcgggcagagagggaggaggtagatggagcttgactatattaacatgcattgactatatattgactgcaaagaagaattgtatctgcaggaagaaagttcaatttccatgatttagtaagcaacagagagacagcaatctggctaaatagaaaggagtgctttgctctttatcaagcagttagtcctacctggaagggaaaaggaacacttttataaatcgtctccttgttttgtgctctctggacatcacaagagtatgtcacatagaaaggaagccttacagactaccacgttcttgttttcctctcgtacactattgcatatttgcaaggtataatgaatataatattatatgaggagctagataaaatcagagaagagaggtgctcctttcattttttttcctcttttcttcccacaaagagaatataatattggcttatttcattccaggaatcctttagccctttctggattcacagcatccattcaacatatgtcaacgctaagtggactctggcagattttttcatagggatatgatgtgtcttttgtcaggagagaaaagaataccctcccttgtattactctcctgttctctgaaggaaatggatgtgaggaaaattaaggccaggtcaaagccatctctgtattgtaccacatgcctcagctcctgtgcactttaggatgattgcgcattgccctgggtagcacttaattatttaaaggaactttcgcttattcttacagcccgcgcatgattgagaccttgctgtgatgccaagttcctctgtctcagagagaaagaaggcagtttggagatcaatctgaggtggcagactgtaatttaacaaggagaaaaaggcactctgtagctcttctgtacagcaaggccaattgcagaatgagtaactctaacaaaacagaaggttgggtagatgaggcaatgggatatgagcagattcactaattatgtacttgccatccatatcttgacaaatagttatagcgaatttcaatgttttctatagaattttagatagaatttctgctctgatgccagaggcttctatttgagccacacaacaaacggctgggaaatgttgaatttagttaacttccaggtctcattttctctccatataaaaagagatgccttaatatctagctcaggtttgttcttaatattaagtaagctaatgcatgtggaatcacttccctaatgtggttatcagttctaggatgaatatcaggtcccctcttttgcagcatgaaatgtcattagagtacctgtaatggccatttaaaaacaaggaccaacttgctgtgaaggagcaacgacctgctcaatcagtggcatccacgatagaagcatttataccattacttgtgttgggaaaagtactttaacttgtcttccctatggcatgggaataataatgaccagactgcctaggtctcttcagccaagtagctagacacctccaacaaatgctgataactgtaattccagttgtgatttgagagagttctactgtgcttctccacctatggagacatgttgacactgctaataatgtagcactttgaatttcaggcctccttgggaatatgcattgagttatttgattatgaagattattagcatgatgagtcatgcctctaacattatgaatttaggtgagtattaatagagtggttagaaaaacagggctggcatgaattgaatatttaaacttggagaacacttttcttagtaagagttggaatgaggaaatttcacaagctgatatgtttgctactttatttcgtttaattttagcccccaagattattaggctacatctgtctccacatctagtggttattgtatactgttctatgcatgaataaaaatcagaaggacaagtgggtatgtataaatagaagataatggaaccttaatgctttataactatttcatatgtgaaagttaatccagcctcagaatatagagcagtaattccccagatatccacatcctaatactgttgtagtgacacctgcatttcgacattcactgaagaaggaaggagcctatacaatccacagcagaggttatgcgtggcttaggaacatgccttcatactcatcaaagttgtcttggcttccatgggtgttgagagcccactctttagcagactggactaactgaattccagttactattctccaattgacagcctgatgattagcctgttgtcttgttacaagtgatcaccttagatggcactagaaaggactctgctgtctatcttatatccggataagatttgaggaaaaattgtaaaagctttcctacctttttttcttgttttatattttctagaaattcatttttaagcttagttcatattaactttaattttatacaaatattctatgtattttagcagttttaatgagatgcaataaaatatcatgtagctattaaaattttacatttaatgaatagtagagttccacaggcattattgctattcattcttaaaagacattcatcatctcctaaccctgcatgtgtttgctgtttgttattcctacctacctccagttatttggagccactgatgtgttttgtagctacaaatttgagttttctgggcacttaagataaacagaattgtcatgtagcacttaattaacacttacttttttgcatattgttctgtcaggtagtgtagtaattttgagaggcacctatggtagaatgcattgatagtttttgttttctgttttgtttgtttgtttgtttgtttgaacttgctgaggatatcaggtcatagctgtatgaagttgtgtcgaccttcttaaggtgatccattgaaatagtatttctgttttactcagtttatatgtccctgctataaacaccatgttatgtctctgtatacaaatattcacatttcctttgaataaaccgaaggctagaattactagcccatatgctgtgtttgggtttcacactattactaccaaatgtttcatcatattagctgtgttatttgatttagccctttgtaatatatcaatcagcacaccaattcctctacattcttgccaacttttatttatgtgtttttgtaagacaatgtgatgggaaacttctttgtggttttatttcacagtaacctgcttataaaagtgaatacttttgtgtgtcttttgtcctttcatgcaacctaatgaaaaatccctcctaagatttcttctagagttttgtatatatatatatatatatatatatatatatatatatatatatatatatatatatatatattgtatgtactaattacatatgtagagtgaagtttatattttcatgtggatatactattacctaaatatatcagataatatgatgtacatcattatcaattaagtatctttgcactttagtaaaagatttaattgatcataaatatgagagtttaattataaaattccagttctttagtaattttttatggctttattagaatcaattgtattctgttttaaacattgtcatttaacactaatatctagaaacaccattgtgtattttctaatttggttatttgtcaaaatttcttggttaggcttggtcataatctctgtaaaattttttaaaaatattccaaattttctgttgagaaaacgatatgtcaaacttcccatccactgggggggtgggtgtgaattgacatttctaggttactgagtgttctggtctataagcatggaacatttctgttatttgtgtttataatttccctcagctataaattctttaatttttagactcggaattttttctagtgtgtagaaatacaatatttctatgtatcaatattttgtattatgtaattgttttacacagttttgtacaaatggatattctgtgaatatcttagaattttctctgtatagataacattttctgcattttatttcttgcctttcaccttggattttctgagcagaacagaaattttagtcatacttttactagaagaaacaagaacgaccatatttatcaccttcctgattttggaatgaaccatgagtctcttccaattaagaattatgtttcttaattctgtaggctcattataattatttacctgcaatatgaggaaattcacaactattttatgctctatggtaaattgaaattccatttttttaaatggctctgcagcagttaggaaaataattttgttttgctctttactactatggtgtacacactcaattttcaagaattaaactaaatttgcctttctagattaaatttcacttggtcttgcatataattttcttgttcaatttcggaactcagtttcctaacatttacctagcagtgctgttcaagtattcccactgttaattgtttatgtatttactctattttttttcagcatgaagtattgaaagacacagcttgaataataaattttctcttgacactttcatttctgtaactgttgtattcctgtataatttgatacaccttcctgaaatactgacaggtctatccatatttaattggaacaactcattgaaatacagcaacatgtccttttgttgtctttaaaatatttaactgccattctgcaagtagtgtctaagatcaacttcacttatttgtacattatacaaggcttttctcttttaactcaacttttgtgtgtcttttttttttaatgtgtctcagtagacaagaatatagttgaataatttttcttctgccagttctcactatgtacactagactggccttgaatttatgtttctccagctcttgcctcttgactactaggatgacgagtgttgtccaccacatttgcctggatatgattttaagtctgatcaagcagttcaggcactttaggcagtatatttgacgattcatatttaatataatcttaaatagttacattaatttgttatgcttttgtttctttccatgttccttgtttttccattttcatattaagcccatgctagtttaatgcttaagtttaagtttttaaactttctcaaagtttgctctatattgtactatcctaacttaccacaatcctcttcatactctaattctgaaatagtattttttaaaacttttctcccatgtgatcttattcctgctccctaattacattacatatatttaaaaatatttactagtgaattttcatataacactagaacagtcagtgaaggtgggaatattcccccaagggatttaatgttcattacatgtcttcatttctataaatttgaattgttctctgaggcctttataaaaaaaatgttttatcttccttttcaagttatgtctcaagccaacatattttcttcatctgagaaacatgagataacatgatgtttcatctaaacttttggaagagaattgatcctggaagtagtgttctcagggactgtttgtgcctctcagcctttgaagcatgtatgtacatatccatggctgtatggcctctattttctttttccagaaattaccctggaccttctttgtgtgcatagcttctgattcccccgttctctttagccatgggtctctggaatgtagctataggctgtgaggtgatatatatgaatcattatgatttgttaactatgaacaatttcttccctgtctttcttacatacattgtacattagggtaaatattttgtattgctggaatttcataaggcagtttgcattgttcatttttcttctcttactccaccttctaactatgcacacttttgtgcaatttatgttttcttacaaaatttaaagtttttgatcacatttttttacaatatctttttttccttaccttcaaattaggtcatttctaccaaactatcttcaaatttcttaaactttcactttgtaatgtcaaatctattcagacttatctaagaagttttcgtattattttataaaacttttattccagaattttaatgtgtgtatgtgtgtcctgttacttacttgagagtctttaatttctatgtagtttagattatctgtatattaataaactcctggttccaataatgttcataatgtagtttttgaaatatctgctaaatctttcaaatgtatgccaaatctagcatacatagatgtgaataaataataacttttgacttctagtttaactaataactttatatttccttgtttcaatatccattgtattggttatggctggaataacatatttcatatgttattatgaataacatatgaaagcaataacatattaaataacaacaattctagattcttgactatttttgattggttggtattgtttatttttgctgtcattgtttccattgtttgtattagaaccaaattgatggtgttcttggtactgatagaggtggcatgaatgtgaaagaaagcagactggcacttatggaacagaattgttctctcgtcagagcaacagaaggttggaattctctcctaagagctggagactgtgagcacttggcctgggaatcgtgagattttaacagaacaaaaaaggtggacattggggaaagcagatcccatctgtaggtctctgttcctgaactctgtaacttatcggtcctatggttccatggttttctccttatcagaagctaccgtcagtgttattggtcagctcaaatttcctgtatggagcttctcagtctacccaaggcttttagaaacttgaccctacagtttgagaacatcatacatacattcagtatgtttttattaagtttactttcaattatttccacaccaatatctctcatacctctctcctctattccataccaacttcattctccagcttccttcttcacctcaacacacagcaaatatgtgtgtctgtgtagaatcttgcactagagagcacactgcattcttgaaaacagagttcctgttccagaagctctcaattgctgattgaatttcaacacgggttaagacatcataaccacctccacttctactgctggaagtttacatcttggttgagctcattcaagtcttgcttgtgctgctacaatcactatgcgttcatattttaaatatcccacttttatcctaaaaaaaaaaaaaaaaacactgtcattgtagccgtctcttgcctttggctgttgcaaaatttctattcccttttccacagtgattcctgagccttgagagaaaagtgtttgaatagatgtcacactcaggactgagaactccacagtctattatcccctgcctgcttagcagttatagctctctgtcaatcagcatctgctcctaagagaagcatctctgataagagctgagagatgcactggtgtaagggtgcaatgtgaagtcattatgagtcaatgtaaactaaatacctgtagaaaataggtttggggccctcggaggggacctacttccattgcttgatggaaatagtattaaatcatttatttattttgtttgatttccattttccttgcttagtaacatttttggcttaagtatgaaattcatatcttccatgcatgtggctgcttagtctttgccccaaactttggtgtgtggttatgggtgggtgtatgctcaaatgcatatatctatgtgtctatatgtgttttaattctttttgttaagaatagtaatgtttattgctattatttttatattgttattattaacttgataataggggctcactaggtagcttttgctgtggaattgtgttttaattcttaattttggtttaatttcagatttttaggatttcctaaaataggttagtttattaattttcaggcctgtcaccattttagagtagtaagcttccatttctttaaagatgtaccaaattggataggacacacataactttaagccaactttcatgttttctctgaaatttattttctgttgtgtgtattttcaactatgaagccttagaattagtaaaatatctgtgaatactttgtagaatcttacattttatctatatgtatattaagaatcaatcaaaaatttgatttacacattagtgaattcattgtgtgggctgagagagcttgttatttgttatgaaatatcaacttcattatgaatcatactgttgagaataaattaattcaccattagtcaaaatgtgtaaccagatatcaagaaaaatggaaacatggggtcactgggttcttccttatgttttaaattcagttgaaatctttttaaaaatacattgtcagtgttactaaaactcatcatttcagttgaattagttcaggatatacctggacttttccttgtgtaatagttctgtggttttattttgagatattgtaaaataaagagaatacatacactaacgcagtaagaatagagtgagctgatacaggatgagaagtgtatttcatagttagatacttatagctggaagaaagacaaagggacacatgcatgagacaatttttcataaattataaatatagtttcattgtcttctgtccatgatcatgtattatctgtctctggtatgaaataattgctgagattttggctcttatctccaatatgagaatatgaaatggactataatatttttcaaactttgaggtgaatagacgctaaatacatgattatatttcactggaagatttcacagatgagatttcataggtaaagttcaaggtttcatatttttgccttcctaaataagatagttttctgtaatgtttctgggaaacataaacaaaaataccaagataatattaaaaattacatttattttgtaattccttagctatgtactctaatttggaaatagtttttatcctttgaaatcccttatgcagttggttgcataataaaaataaatttaaggtctgcatgttcaaattacttgttggcacagttcatgaaacagaaaaaatgtaggcatgtacagtgttctctcagaaagatattaagattgaaataaattatgagactaatatgaaatataacacttgtgagaaaagttgaagacctgatccatgacagtggaaatggaaaaataggatacaattctaagatttgtgtttacaaataaaagtgtgaaatttaggaagttaaactttgcaaatggaaaggatacatgcatcaaacatcctgcctatgtctctaatctcaaatctctgctctcattttgtcattcattgcacaaagaataaaatattggaaactcaattctattgggaataggatgacatctgacactagaaaccatgtctcctcaacaaaacgatagtaattctctgtgccaggcagagaaaccttaaataaactcctaggttctaatgaggctgacagtctgaatcatgctatattagataatgttctatagctgtgaggagacatcatgaacacagaaacttttaaaaggaaaagcattttattggaccttgcttacagtttcagcgttttaatccattgtcatcaccagtgctgcatgaagcttggggagttggctgcaggcaggcagacatggtataggagaactaactgggagggttgtttgtttggtttttttgtttgtttttggtcttttggtttttcaaggcagggtttctctgtatagccctggctttcctggaactcactctgtagaccaggctggcctcgagctcagaaatcagcctgcctctgtctgccaagttctgggatcaaaggctttcgccaccactgctcagcctaactgggacttctacatccagatctgcaagaagcacgaagagagacattaaacttggcttgagtttttgaaaattcaaagcccactccccgtgttacatttcctccaccaaggccacactcctagtctctctcaagtagtgccactcaaatatatgggcctttggggggccttttcaaccaaatcaccacacttgctcaaactttcctagttatcccagttatgataaaacatcactatccataaaggtcactggaatcttgataccatgagttaaaagttttaaaaaaatatttttaatatattaataggaaaaccagtccacaaagaactgtggtatcagaaaatatttgtgtgtttcttttgtctctccttccctaattgttcttctcttcattgatatatatatgaagaataaaatataggttgatttctcagacctgccacctgcaattcctttcagttagacaaatatgtgagtctgccacctgcaacagacatgctggcaggaagttttctgcttgtggcaaagacatgttcatgttggctgttctagcccgagatacttgtaattacatcagtacagctgccttgatgtgagactcgggccaagctaactggtgtagaaaaatattactggggaaagatagtgttctattaacttacacattctgtctcaagactgtctgcttttcctttgtagttgtgtcagggagggaccgcaagcattacatcttcatgaacagccattcaaaggcacttacagccttctctggatagaatgtatttggcaagggatttgatggtgaaacatgtcagcttgccccatgaaagctggtcctaataatagttctcagcttagtgttaattcaacagtgtttgtaaatccaggtaatctcgtagataattattgattcttcatgtattttcctatttcacttaattttcacattaattctatgaattattataagtagcattatacatatgcttaaatcaagctagttcacacatacatttcatcatgtagcttgcatttatgtggtggggagcactaaagatcaactctgttaacatttctgaagatgtttgtacaaaacacaccctctagaatccaactaatagatatgttttgataagtacatattatcagtgcttaacatttgttttcatgacctttgataactgcacttcatcagaatattcaaaatgcaaagctgacaagactaaaagggtaaaaccaaccctgaagacttggtttccaagctgggaaacgttttgtagaaaaagaaaattgactcccatgtttccctgcttccacacacaatctatgtcagaaatgtgtgaatgtgcacacacaagtacatagtataaatcaatcaatcaatcaatcaatcaatccatcaatcaatgcaacaaaattttgaaaaataataagcacaccccttctttaaatgatatctgaattatgacagaatcaagaagttaagccaatgactgcccttctgaatgcctgtcttatacaaaagctaccatattcttctctaactaagaagaaactgaaacttcagacacagtcatttgggcagaatctcctaatattccctgtgagtctgtgaaggataggacagccacatttgcttttcagaattccctatgggtaacagctcctttgttttctgctttctggtctcaaagaaaagccaagagtgaaatccaggcaagatgttgtcccagagaattggggtattgtcaagctcttgcttatgtctttcagatcatccttatactctctagtggcctagaaattaagagttaccatttgcatccaaaaggaagcaggtaccagtcaacccatatagacgttagtctctcatctagtcccaaaggtgattgcttaggtttttatttccagtgttacttgtatacatgggtcacagagtttcaagaacttgtgctgcacctgggggtgtggggggtgtggtggtgcacgcctttaatcccagcacttgggaggcagaggcaggtgaatttctgagttcaaggccagcctggtctacaaagtgagttccaggacagccagggctatgcagagaaaccatgtcttgaaaaacccaaaacaaacaaaaaaacaaacaaaaacccaaaacaaacaaaaaaacaaacaaataaacaaaaaaccaacaacaaaaaaaccttgtgctacaaatagcttaaatactataagaaatatatctaatttttagattcaaagctggaatacaaaatatatgtctttattaaaaccagtaaacaagtagacctgataagagtcatgcttgtattatagtcatgctcttttcctgaatttacctgcaaaccagtttttatgagactggttgtcctcggtggtagttgagtattgactgatcagagcaggaaagaatgagcatataaatagagagagagagagataaataaaaagaacatacacggaattgaagaatgtgaagtggtttcccatgcacagcaattcgtggagattttccagaaattcatagtccggagcagggattttaaacctaatagggaatgaaacctgaaaatccatcaatggtcaatgtgaactggaaatgaaattatctgatacaatgtaaaacgtagtcagttatgccatacattctaaattgaaaattggatgatctgagcagttagatgaccattctaacactgcatgatttttctacccacccaagttttggcttgagaataggtaatttggggaacaatgattgtgagttcttgagaaaattgagacattttataaaaacattctttataaataattaattttagaggcttatagcaagaaataaagcttgttttgttttccctttctcttcctttttctctcatcatctatctatctatctatctgtctgtctatctatctatctatctatctatctatctatctatctatctatcatttatatcattgtctatttccctcttctttcacactgtcttgctgcaccaatttctgtacaatttatagattccaaattcactagtatttccagcttcaatcctgtgcttgttcttgatttcaacctacatgaattatagaagaaaggtttctttgctgtattgcaaacaaatggatcactatgttttaatatttttaaaaataatgctttatttaatttttgtatttatttttgtatatatggtggtatgtatgctcataggatgcaggtgaaggccagaggacaacttgtaaacagtttctgccacacagtcctaaggataaatctcaggttgttaagtaggttggaacatcattacccacagaaccatctgtccaggatgatgccttatttcttatttttctaatgttgcaagtctagtttctcagttcctatagaagcattttttatggtcagtgaacatgaaagtgcttgtgatacttgatgtttgtcattggagtcatggggtcattcattcatatattttctcatccacattaaatgatatccaaggtgatagagaaaagttattctttttattgtatattttctttatttacatttcaaatgttatccctattctcggtttcttcctcagaaatcccctgtcccatccttcaccccctgcttctatgaggatattcccgaacccacccacccactcacacctccccaccttcgcaatcccctacactagagtatcgaaccttcacatgatcaagggcctctcctcccattgatgaccaacacagccatcctctgcttcatatgtggctggagccatgagtaactccatgtgtagtctttggttggtggtttagtccctgggagctctggggctgggggtgttcattgatattggtgtttttcctatggggttgcatcctttcagctccttcagtcctgagaaaacatattcataattatctagagttaacaatatgtgtttatacactatttctgcagtgctctccaaacaagtgaagttttccagaacttatcttcattatttttgtaaaagttttcttaccataattattaatatcacaattgttattataatataaacattaaatattaagaggtagcttttatatttgataatcatatagtttataaatgtattactattattttttcactatccattagttattttgatgggtttcattatcacttctagttctcaagcacaaattggcacagcttttgttattatgtctctgtttaaggaataaggaagccaagagaggtcatgaaatcactcattagaaataatataactagcaattagaataaacaaaatactggtcctgagatgtcagagtcttatgttattccagaagatgtaaaacattggccctcaggcacagacatggcagctgctgtaccctggcatgatcaggaatgcagatttttatccaaaacctttcagagtgcaatccaacagtatggtaatttctaaaatacaactttgtctgtagttcccacacaattaagataagaaatcctctgtcttgccatgttctagtactcccaagttgagaactattggattactgctggcttgtgatcctctatctgaaaagcagagacataaaaaaaaatcctttacgcccacagcagagacctgtggtatatcactcagctcaaaacacagttctttctcctctaaacagaacttacttatgttacagaaaagggatggcacaacctttatgtcttctgtcctctcagggaaagtctggaaaaatacaacttaatgtttccttaaataacaaggctagtatagaaagtatcttcctggagtaagtggctcacatcactacatagagatgcaaaactaataaaggtacgatcatcagggtattcagggtattggatgcctacagctgttttgttgtttgtttgtttatttgtttgttgttgtttttccagatagacttatcaccatagggttgaaagtaatgatacatccttggaaataaaagtgacccaatatcctgcttccggacagatcacactggaaggtgcctgtgtgaaaattaacacactattgccttgtagacatgctgaaatatatctcttaactcacagaaacaaattcctagaaaattaaggttgtcagggtatggggtgagataagtagagattgaaaagtgttaaggaagatgtccatgaagttgggaaaatcaaaacatcttgtttctaagcgggagtagggatacaatgaaaaaatgatattttgtttgttattaaatattgtgtaaatgccactatagaatatttctaaaatgtcagaattccatttgcatagaatatcacttcaaatgcgttattaattggagtagtaaaaagtcagtcagtctaggcaatacaataaataattgtcttaattaaacatcgtgaggtgtgacctgacaagtcaacactgatcccgtgacacaaatgatatgaaaaggcaagacttcattcctttcttcatactacagagtttcagtacatagtactacatattttcagttaactttgggatgacggatagaggatccacctctgtatctccctttatacaagttgacaacatatatatatatatatatatatatatatatatatatatatatatatatatatatatcctgctcttaaaaaatccacgtgatgtgccatatatcaaaaaaattgaggaactagtagaggtattagggattagctttgcattatgcctgatccttaaaaatgaaatgagtctaatatttctgctttaccacaacaattgtgtcctatattcctccttcagttaggaaagggtcaacaacctatatgtgtagaagatacctgagataaacaacttgccaagagaaaagccttatttggcttaccactttaagtggtatatcatgatcattatccagaatcactggtggcacatcaccatgagtgaatattgcagggaaaaatacctatcctgtgactgtaaaatgaaaaaaataaagataaaaagacactggagaggcactgtcccaaaggcggtctcaaaaaatattccagatctttcagtagagccaatataggaatctgtggatgaaaatgtttaatcttactctggggcttctaccccacctttgaatattagttcctgaataaaacaaaaacataacttttatatttataataagcctttattaggaacaatattgggcagatatctaccctctgtgctattgaaatctgttttctattgataacctcaagttattacttagtctctttcatctgggctgctaaatccaataggtcattcctcatggccaataattattgactttcaacccatggcatcattcttcttcttcttttttttaatatttttattacatattttcctcaattatatttccaatgctatcccaaaagtccccataccctacccccacttccctacccacccattcccatttttttggccctggcgttcccctgtactggggcatatacagtttgcgtgtccaatgggcctctctttccagtgatggccgactaggccatcttttgatacatatgcagctagagtcaagagctccggggtaactgggtagttcataatgttgttccacctatagagttgcagatccctttagttcattgggtactttctctagctcctccattgggagccctgtgatccatccaatagctgactgtgagcatccacttctgtgtttgctaggctttcttctctctcctcctgtttgtcctcagaccccaagccaaggagccctaaacctgcctatttctcctctgcccagctattggctgttggcgtctttattcactaatcagggataactaatcaggtcacataatgtcactttggtataagtgattctgtaagagcaaccagtgtttgttaatatatactaatattttattaattattttatttacatttgaagtgttgttccctttcccagggctcactccatgagcactccatgctagcacccttccccttttcctctaagagggtgctgcttcacccacccactcctaccacagtattctcgcaccccagttctctggggcatcaagcctccagaggacaaaacacatgcactcccactgaggccagacaaagcaatcatctgatacacatgtagccggggccacggaccagctcatgtataatcttgaattggtgtcttagtccttgagagctcagagtggtctggttacttgatattgtttttcttcctatggggttgcaatcccgttcagatccttcagtccttcccctaattcttccataggggtcctcaggttcagtccaatggttggttgtaagtatctacatctgtctcagtcaggtgctggtagagcctctcagaggacagctactccaggctcttgtctgcaagcacaacatggcatcagtaatagtgttttggtttggtttctgcacatgagatggcttccaagtttgggtagtcactggatggtctttccttagtatctgctccaattttgtccctgaatttcctttaggcagaaacaattctgggtcccaaattttgagatgggtgggcgggcgcatccttcaactggggccatgtttatctagaggaggtggtcacttcaggttgcatctccccactgttaggcattttggctaatgtgatcactattgggttctgggagcctctcatatcccgcgtgtctgggagtttttagtccttccccttgtccccaccccaaactgctgcatatctccattcatttttttttgacccaaggggctttcatcctgtctcctctttcccccacctcatttctgccacccaggttcccccttcccactgcctcctatgattattttgttcactcttctaagtggattgaagcatctacattttggccttccttcttaagattcatatggtcagtgagttatatcatgggtattctgaacttttttggctaatatcctcttattagtgagcacataccatgtatatccttttggttatgagttaactcactcagtatattttctagttccatccttttgctctgaaaattcctgatgtccatgatttcagtagctgagtagtattccactgtgtaaatgaaccatattttctgttcccattctttggttgagggacatctgggttgtttccagcttcttgttattaaaaattaaggctgctatgagcatagtggggcacatgttctgtgatatagtggagcatcttttgggtatatgcccaagattggtaaacctgggtcatcaggtagaactctttccaattttctgaggaaatgccagattgatttctatagtgtttgcaatcccaccagaaaaggagtgttcctctttctccatatccataccagcacctgctgttgcctaagctttttaacttagccattctgattggtgtaaggtggtatcttagggtcattttgatttgcatttccatgatgactaaggatgttgaaggtttctttagatgcttttcactcatttgagatttctcagttgagaatattgtgattagctctgtagcccaattcaattgggttatttggttttctgaagtttcaattcttgagttatttgtatattttggatattagtcctctattggatgtagaggtagtgaagatattttcccaatcagtagattgctgttttgtcttattgacagtgtcatttgaagttttcagtttcatgctatcatatttgtcaattgttgatcttagagaatgagacattggtgatctgttcatgaaatttccccctgtgccattgaggctatttccctctttctcttctatgagattcagtgtatctggttttatgtgaaggtccgtgatccacttggacttgagctttgcataaggagaaaaaaatggatcaatttgaatttgcctaaatgcagatctccagttagaccatcagtaattgttgaaaatgctttcttttttccaatgtatgtttttttttccttctttgttcaagatcaaatgtccataggtgtgtgggttttcttgtttcttcagttctattctattgattgagatgtctgtctctctaccaataccatgcagattttattactattgccctgtagtacaccttgcagagagggatggtgattcctcctgaagttcatttatttttgagaatgttttcactatcctggtattttgttatttcaaatgaagttgagaaatactctatctctgtgaagaattgtgttggcattttgatggagattgcatttaatctgtagattgtttttgataaaatggccatttttactatgttaatcctgccaatccatgagcatggctgatctatccatcttctgaggtcttttggatttctttcttcaggaacttgaagttcttctcatgcagatctttcacttgtttggatatagttactctaagatatttcatattacttgtgactaatctgaaggatgtggtttccctcctttatttctcaacctttatcttttgtataaaggaaggctaaatatttagttgagttaattttttatatagctattttgctgagttttttttatcagctgtaggagttttctggtagaatttttttgggtcgcttatgtatactatcataaagtctgcaaatagtgataccttgaattcttcctttccaatttgtatacccttgaccaccttttgttttctatttgccacatctagaattatgagttctatattaaataaatagggaaagagtaggtagcctgtcttgttcctgatttttgtaagattgttctacatttaatttgatgttgggttttcagttgctctatattcacttattatgattaggtatgttcctttaaattctgattgctccagcacttaacatgaagtgatgccatattttgtccaaggtgttttcagaatcgattgagatgatcatatgattggttttctttgaatacgtttatatactggatcatgctgatggatttctttatattgatctacccctgcatcctgggaatgacgcctacttgatcatggtttatgattatttcattgtgttcttggctaagatgtatgagaattttatttttacatcgatattcataagcacaatcggtctaaatttctctttctttgttgagtctatgtggtttagatatcagagtaacagtagtttcatagaacacattaggacatgttccttctgtttctattttgataatagtttgaggagtatttgtattagtcttcattgaaggtctggtagttttctgcactaaaaccatctggcactgggctttttttggactggagacttttaatgactttatctatttccatagatgttatataattgtttaagtagtttacctggtcctgatttaactttggcacatcgtatctgtctaaaaaatcttccatttcatctatgttttccagtttgtagaataagatctgataaattttttgaattttctaagtttctgttatacccacgttttcttttctgaagttgttaatttgtatattgcctctgtgtcctttaatttgccttagcaagggtttatctagcttgttgattttctcaaagagccggctcttagttttgttgactcactgtacattgtgtttgtttctacttgatttatttcagccaggtgtttgattatttcctgtcatctacttctcttggttgtatttgcttcttttgttctagagacttaaaatgtgctattgtgctgctagtgtaggatatctccaatttctatatgaaggcacttatgctatttattttctgcttagcactgctctcattttgtcctataaatttgacaatgctgtgccttcattttcattaaactctataaagtttttcatttacatttttatttcttctctgaccaagttatcattgagtaacatgttcttttttttatgagtacatgggctttcttttgttttccttgttatttatttatttatctaggattttcaagaacgggattctctgtggaacccactctgtagaccaggctggccttgaactcagaaatctgcctgcctctacttcccaagtgctgggattaaaggtatgtaccttcactgcacagctatgtttttcttgttattgatgaccacccttagtctgtggtgatctggtagaatgcatatgattatttaaatattcttgtgtcagttgaggcttgtattatgtgcaattacatagtcgattttggaaaagttaccatgaggtgcttagaagaagttatattttcttgttttggggtgaacagttcttcatatatctattaaagccattttgttcataatttctgttaatttcactgtgtctctgtttagtttcttttcagtgacctgtccattgttgagagcggggtgttgaattctcccaatcttattgcttaaatttcaaagtgtattttgagctctagtaaggtttcttttgcaagtgtgtatgttattgcatttgggtatggatgttcagagtcagaaatttctcagtgattttttttcccttaattagtataaagaattgttccccatttcttttgataacttctgcttgaaaatctattttattagatattagactggctactccagcttgtttattttgggaccatttgcttagaaaacttttttccagccttttcctctgaggtagtgtctgtctttgtcactgaggtggttttccttattcagcctatttctgggtccaatatatgtatccagtctgatagcctacgcatttttattggggaattgagtctacggatgttgagagatattaaagttcaatgattattgattcctgttatttttgttgttagaggttgtattctgttcgtgtgattctttttttggcttattatgagataattcattttttgtgttttcttgagtgtacttaccttccttgtgttggagttttcctgctagtatcctctatagggatgggttagtagaaagatattgtttaaatttagtatgtcatgaaatatcttggtttcttcatctatggtgattgagtgtttttctgggtaaaatagcttggactggcatttgtgttctcttagatattacatgaagtctctctagtatggtctggcttttagagtctttttttgagaagtctggtgtaattcagatagggttgactttataggttggccatttccccttagtgctatcaatattctttatttgttctgtgtatttagtgttttgattatatgtgttggaagggatttcttttctggtccaatctgttgggtgttctgcaggcttctaagtttatgggcatctctttcttcaggttccagaagtttgtttgtttgtttgttttgttttgttttgttttctgtgattttgtgaagatgttttctggccctatcagttagagatcttcactctctcttattcctattattcttaggtttggtcttttcattgtgtcatgaatttcctggatgttttgggttaggagctctttgtactttgtatctgttttgactgttgtgtcaatatccagcagcaagtatttagcatagcaaaagaccaaacctcaacagaaccatgagttcagcatgtggtctcaggcattcctgatgtgatcagttgtggtagccatccacagcagatactacttcaagagtaatattttaatcttgagtgagaaaactgaaatgttaacttcaatgcagctaatctattccaataattcttcttttatatggactgctttaggtatgtctttgatcaatgcaatgtggtactaaatatttatagaaatattctcctgtgttaagagtttttattcttggtgtattatatcatcacttcttgttttgtctttttaaataaaattcccaattgtgcacaaggcacctcactgtctttatatctgttcttttctcctccatttcttaatctctttctctctatttgtttgctttgtcctattcccatgtgttagttttttgttttattttatcttatttttaaaatactatcccttagatgactgcttgttttctaatgagtgaaacagcatagatctggatgggagggaagatcaggagggattaggagtaaagggaatccactaatcatatatattgtatgaatcaaagtattttcaataacagaaaaataaacaaaagcacacacacacacacacacacacacacacacacacacatatatatatgaaatctggaatattctctcaagattctctactgttcaactattgataaactaaggtaaaaaggtagtaacttgaaagttttgaggatcacttggcttatggtttatccaactttaaattagactgattcaactgcgtaataaggataatgatgatacatgctcaggtagaacgcaatgaaaggataaaggggatattccctctgcttctatagggttcaaagaatgcttattagccaagcaaattatgcaccactttacgtagaatcattaaacatgtaaaaaccaagggtggttatgaaactatatcaattaggtgctgcacatctcagggaagtaagtagtttgaagaaatctgggtcactggaaaagccaaatttcttggaagtatatttttaaaccaaagcttcagagatatttttattctactgaaatatttcatattctacagaatatgtttgcattttaattcacagtaagaatggacacaaagtatatatagatgataatgatatttataagcaaatgaggttgggagaaattttaccttttcaacaactaggaggaaaactgtaaggaggaggataggaatgagctatataaaattagtctttcgattaattgattatattttaaacaataggataaaatggtgacagtgtttaattgaatcagaattatttggttgttggtaggtttctggtttagaatagcaagtgtcaccctgatcaaagtagagtttttatgttttaagttggttgttgatgttaggcaaaggcgcaacccgttatgtttggacagagatcatcaattttaatttttagtgctgtcacttaatagggataggacataatgggcacacttttaaccttttaataccttaatttctttatatagaaaataagaatacactgcccttatttaggattacttaaaagttaagtatggtaccacatgcaatatttgattcaacatcaatagagccactaaatatctttggaacattatgtacaaatccttgtagtttgcaaagctacagaatcttacatggaaaatgtcatcttccattttattaatctcaagatagtaactcctttttaacctacagtcttgaattttattgaagataaaagaaatacatatagtccacgtttatgtaaagatacaattttagaggtaatcaatatataattgacttacaactttatttaaaaactgctagctgggcatggtggcacacgcctttaatcccagcacttgggaggcaggcaaatttctgagtttgaagccagcctggtctacagagtgagtttcaggacaaccagggctacatagagaaaccctgtcttgaaaaaaacaaaaaacaaaaacaaaaaacaaacaaacaaactgctatgatttctacaaagtagtatgggcctcatgtggcaatagtgtaactatttcttaagacattctgaaaatgttaaaggaaaaagtgatatccagtgaggctttcaatattctgtaacatttaataagggggaaagcatattatgtagaaggcaaaatccatattgttgctggtatcttgtgtacaaacactcttataacttttgtgcatgatttgttaacagaccagaaggcaaactgtaagcaattacttataattatataatatgttagttgatgatagttatgaatatttgctttcctttgtgcaaatgtagtaatccatttcagttgaagaattcaggaagagtttcctagtcaacattccacatgacttacttcaaaaaaagcgcataacttatataagtcggtaatagaaatagtgtgtttattttgagacatatcatattaaagaatgcagggcatacataagccaaagaccatggcataattttacataattcatataccatagagatatactttaaaaatattagaactaacaaagagaaattttaatatgttataaaatgtgtcttattgttttcagtggtatggatgcaatattcaaagactgccaattttttttttctgaaaaacctctgacacagagctagagaataatttattgttgaaataattctttttctgattttcagtagaatagcacatgagataatattgtagacacaaaagaatactttcatgttagaaagtacaagcaagaaaattaagggtcatttgagaagaagttagaaaacctagcacggtagaaacttactacacacacacacacacacacacacacacacacacacacacacacaaagataatttaaaagtgatagtcaaataagaggagagacagagccctgtatggacatcccttgtcaccaaatgaagcttccattcttggaaatgggctatatcttattgagtttttcaccaaaggggtcccatggaactgtactctaaacccaggctgttgcaaaaaatacgaattttttttctacaaactgatagcaagacttcattgcagtagttaacacctatccaattctttggaaatggagaagctgagcttgtggctacatagggccttcatccctacattcttgtatctttaggggaagaaggtattctgcatgctgctaaaagagaaatgtagacaggagcatactcttaaatctttcaatctacaatggtgttcttactgcaagatgtgttagtgcaatgatgacacaaagtttctgacaataaccaatcattatctcatttgaattaaggcccattccataagatgggactcattctgagacaaaataccccagagatttagggtaaaaacaaacaatgctattctactaaaagaacataggaagaaaatgactcctaatgacattctgttatactagtagaccattgtcttgtttagctagaagagttgggaacaatacagagacccacagccaaaacatatgaaaagaatgaaatgcattggaatactcaacactatgccagatgttcccactaaattcttcccctaaggtttcagggaacctgcagaagagaaggcagaaaacatctaagatccagaggggaaggaggacacataaaagaaaatgaaaagaagagaaaagaaaaaaaaaaacaacaacaaagaaaatgaaaccctgtaaatcaacatgatcagtatgtatatgaaccacagaaacagagccagcatacagaggacctcattggtatgcatcagatgtgattggtgagctaaaaggagaagaggacacattcttttatccataacccaggatccatctccaattgacaagcagctgaaaaacaaacaaacaaaaaacaaaaaaagaaaaacccactcatctagaaacaaactattcttaggaataggctgtatcaggtcttcttaaaaatctttaacaaaatatcagatttattattatttatatttttctctgaccatatcctacaagtaatttgtgtatattatagcttccaatttagtgtttttcttggattcctggatgggctagaacatatatatccagatctatatttgtttcttctgtctttcttgatccattttcattctgtttatttgtttgtttgctttatcctataaagatatactacattttattttctcattatattttaccatagttatatctcttaaaagtctgtttgtgccgggtgtggtagctcactcctttaatcacaacactcgggtgacagaggcaggcagatttctgagttctaggacaacctggtctacaaagtgagttccaggacagccagggctatacagagaaacgctgtcttgaaaaactaaccaagcaaccaagcaaccaaccaaccaagcaaccaacaacaacaagtctgtttgttttctagtgagaaacagaaagggattggatctgaatatgagagaggttgtggagggaatggaaggagaagagagagaagctgaaatcaagatatattatatgagagaaaaatccattttcagtaaaggaaaaaagaaaacagtgataggtgatgagggaccctgaagtttaatttcctcaaactttacaacaaggaactaacgatccctgctctggtctcataaggccactgtcaagatcatcgtcaaggtaatgatgataatctcccaagaacatatggaagtcttattgtgaaggagaagtaaaggagtaaatctgggcaatgaatgccatgcatgacactgagcatctttcagtaatgagccacaccatacccaggtactcaaggtccacgccccagtaaaaaatatactattgtggaacaaaagtaatatctacctggaacctcactttttgttgtgggtgagcaggttctctaaacatcccccaatttagaagagtctagggtgtcagaaacagacctctcatattctgccagttcttcttactttgccatggtgcctcagtagagagaatacggatagcattaaagttaaccagcaagaaaaatgaaagactgaagactgaaaacattgagaaaactacttagaaaaaactcacctaagaacttaaaaatcttgagaattagtacaaattcagatttagtgctctgcagctgaaattggtttttcttcttctctcctgtattctttgaactacaaattctagaatacttattctatcacaaataaattttacaacattatattgtgcataagttatcatcatattattattcaatgtgtttaacactgccatgtagctccttatatttaaaacaaatgaagtctctccttcatattaatgtagcatatatacttaatgcaagatgacaaaggtaaacaaacaaactgttgaatgcttgtaatgaacaataccgataaaaaattgtaacagtcattgaagatggattataaaaagcataatattaaaagcacttaaaaacattgaaagaagggcatatttgttggtttccaaagatatttagcatataataaaatttctaaacccaaataaacttttgatttacaaatacgacttatcaaactagtaagcacgtggaatttctataaacatacgttaaaaatactgctaatattgctaactgaaagagaaaaggtgggcaggaggaaaagaagaaaggatgatggtcattttatgcttattttatagttataaaatattttgtgatagattgcattgcatacttacaatttgtgttcattggaaataaaagtagaccatattgaatagtatttaagattattcacagcttccaagtctgaactttgaaattagaaaaataaaacatgctgcttttcaacaaggccagcctgatgaaaagtcagcataaccctgtgtgtatagaaaatgtacatacgtgggatgatttttcaatgtgacagctggagggaggaatctggtcaaaggctgacccctagcatatggcctcacaggtttcttgatatgcatacacaacacattcttggcaaagtcaagggtagaccggaaaatgactcattaagctctttgcagttgctgtgcttagatgtgtaccgcaagtctgcatcttgtgtatgccaacttatgctccaaccttcatataacaaaattcttccaaggaggcaaacaaaagctacatatgcaggggcaaagagctgagcctacagattgtacactcaacaggaatggaactgttccaacaacataacttttagaggaaaaaaaaatgtaattaacaataatattcctaagttggaattcctcctacacagactgtggctaagtagccttgtcaatgttctaatttgttatgtgtctttcaggtggagtatggtgttgtataatgctttatctacagcaagaaaatatttccatgcccaatataattttttagcatttaaacatttttatattgtctatcaagctaaatagcaaccaatttacaaaagtttatctgtggatttcttagcccatgctctgttgctggaatatagtagacaatatattagaaatacttttaaattatttgaattatgtaggaaataagttccttctgtttacaactttggaaataacacagtctgagaacattgttttagcaccctgtgagggcttaggccttacttcacctcagggcggaagacagagagactgtatacaaaacgaggtagcctcattttggataaacctgattatttgttgaccaacccaatcttgaaaaagctaaatacacttgtataaaagaatctaaacacgaaagaaacaagctaatctatattttaacctaatacttttatttatgctatgaaaggatcatatattaaacaacattattaacttatctattttcattacttcttgtctactaccctctgatatatccacctgtcactcaaatttacggattttctattgttatttttatcatcattattaacaatagacaagctaatctaattagttgtacttgggaataaatgtatagttattcactggctgttcaaagcctttcagtagttatatcaccacataaaggcacctctttatctctcagtacccatcaattgccaatagcactttagttactacaggggcctcagaagtcccttctatctatgctaaatcgtttaaatggcctgaactggggaaggtcttgtttaggctaccatatctgattcaagttatgatgtatatgagccatgtctgtacagagcagaatttttcttagcttccctcctaatcctctgattttgctaattcattactaatctagtaagttgtaaaggcttcacctcacaatattgccaccaaaacaagtttcaacaagaattctatagctcggacattgtatgagaactgtatcaatagtacagattagaattaataaaaagaaaatttcaatgtgctgaaatacatgtatttttagaatactaggttattttagttcatctattccaacttaactaatattttgtatagatttgagcactaaattgtagaaaatatgtttggctcttcatccaagatatcacacttgtttatatagcatattttctattttcttcattttctaactaattatagataaccctcaaatccctcacccaatctttatatccttttcatggttttcacatctaagtgcccagatagttgttttttgttttttgtgttttttgttttgttttgttttgttttgcctctttaaggcctacatcacagaacatttctaataacccgagataaaactttttcagcactaaactcaaggcaggggctaaccttaggaatagtccaattgtctaatatgcaccctggatttgaactttatctgcaataataaccatgtaactaaaactattttactcatttcagttcactgactatgctctgttactgttttctcacagcaggaatataaattccctaaaccataaatattgagctgtgttttaaaaactgttttttcttatttctgaacgttttcttccaagcttagtactacttttgttcaatggctaatgtcattatttcaattctcatgttctaatgtacattcattatccaaattattatattttctatccaacaggtccatcttgtccaggtgtgcatctctctcctctctctctctctctctctctctctctctctctctctctctctctctctctctctctctgcgtgtgtgtgtgtgtgtgtgtgtgtgtgtgtgtgtgtgtgtgtgtgtgatttgtgctggctcacgaacatttattaaattccatttctttcctcataccatcagtgagaccaccttactcttgttcctataacttctgtcaattttaaagctacaggtattttaaaccaatgattctcagcttttttagtccattttttgaacctactaaccaaatgcttagtgttttctaaatatctaatataattgttcaatttattttttcattttctcttttttttttcaaatgtaatgctttattgaatgaggagatcatccactcaccaagtgaacagaagaaaacaaaaagcaggcaaactaaatgtgctacagatattccgtggccatgcaagcaacttcctattgccatgtttattatcatagcaaaatagtatcagaagaccccactttatatggcatgtagtatatgtttctatttactatcttagattacaaggattcagtaaactgagagaaaggagtatcccaataatctagccatccttgatatttcctttggctcaagcacacatcattataaagagaggcccattggacttgcaaactttatatgccccagtacaggggaacaccagggccaaaaagggggagtgggtgggcaggggagtgggggtgggtggatatgggggacttttggtatagcattggaaatgtaaatgagctaaatacctaataaaaaatgaaaaaaaaatacagacaacacacacacaaaaaaaatatgtaaactgagagtactataagtgcatctgagcacttcagtgttttgtggatagtctagtaacattatcaagattggatattgagaaactaataagcaaacagcttgctatctctttataatgatctgtgcttgagtcattttctctttttaaactactaatgttttctccaacaaatgtaggaacttagaagtttagattataccatttacttttataaacaacaaataaaatacatgactaaaaatatgaacatatgaaaatctcattcatcctgagattttcttattaggatatctttattcactgtatttatttatttatttatttatttatttatttatttatggtttttcgagaaagagtttctctgtataggcctggctgtcctggaactcactttgtagaccaggctggcctcaaactcagaaatctgcctgcctctgcctcccaagtgctgggattaaaggtgtgcaccaccacgcctggcactagggcagttcttataaaggaaaacatttacttggggctggcttactgttttagagtgtccgtccattatactcatggtgggaagcatggcagtatccatggccctcaaagtcctgccaccacatatttttctctaatgtacactgtaaacattaaaattagtcttttattactgaagaagaaattgtattatattatatttattctcatctctaatttaatgcttgttgtaaatattccctcaacacaagtgtccttatagtaggaagacaaatgagtcccttctttaaactctttatgtcaaaatttctacctcacatgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccggtttacctttcgccatctggtaatctctggagttagtagttttagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagagactgtgttgctttggcagttcccaggtggtacagactctcacctaagcagactaaactcctaagttccttggagtcccgggaccaagatggcgaccgctgctgctgtggcttaggccgcctcccctgccgggtgggcacctgtcctccggtccggaaggtggctggctgtccccggcccacacagggtgctgcctcagcccctctgtgcttctgcctgttccagaggctgtcaggttctctggcgcaccctctcacctgttcagactaatttcctaagttcggcgggtcccggaccaagatggcgaccgctgctgctgtggcttaggccgcctccccagccgggcgggcacctgtcctccggtccagacggtggctggctctctatttttctttaaatgctctattaaaaagttaacacacaaaggatggagaacaagttggttggaaaaaaagaaaagatagcaactttcacatctagctggtaaagttgactaactctaataaaagaaaaatgagcaacaggaaattttgatttccaggctgatgtctcttcttcttatgtttttctcctgacatcttttgctccctgttttaggacatgcaagaggatattaacacatagagagattttcataatggtgtagatgaagtttaatatgtgtaaatactttacagaaccccccaagtcacctgtgattaaatgcaaatatctgagctgcccttgagggtgtttacaaagaaaaaaaaagaataaataaaactgaattgttaatatatcttttagagcagtcagcactttcctctttcaccctgttaccccagccactgtgttctagatatacacttggaatagagtgttacattcccagtgtatgtcctaatacaatgaaaattgcttgtggaatctatgtctggtgtgcaaacctatttcttaatgtctctaataacactctgtagtgctgtgacttcacttaaggaattgaattagctgctgcattatctatgtcagttgggaactaattaaaatcttttcccagtgatgagactaggggttgaaaagttgaaggacataccattggatgataatgaggctcaaaattcacacacaagttttgtcattgctcataaatcttgcctgacactagtagaattcagctgttggaatcacagacttacatttatttctgggcaccatcgcttatcgtatccagacagaaatgtgttaattagcataacaacatagatttatagttatgtgataattataaaattgtagctgatttgactaaattcaaaaatctatccatatattgtcattgcaatgaatagaagacccttatcaatttaaaacttgtcaggtttttttttttttttaatgtccttttggtgtcagccgaaggtaacccttccttaaaagaaaaatcctgcatagtcaaattttcttcctgtcctttcctttcattccctctttttatagtcatgaatgttcttcttctcccctttcttctatataacttatcaaattctgaaaccaatactaaacatccatatacttttctgttccctttgccagtgtcctttacaaacacctcaagtgtcttttcctagtatctggctctattggtactttttataaaccatagcctacattattatagatgagaaccatcaactaaaatcactttacttaaactattatatacattgtcacaaaagatctggaaacattcaaaaaagtataatggggaaggaatattgggaggacttagagacttaaaacattcaacatagtcttcaaagaggttaccgtaagtacttgactagttatttcaggagacatggaattagattcctataatcaactgactcgtgttcaggagcttgtattatatatatatatatatatatatattaggtattttcttcatttacatttccaatgctattccaaaagtccctcacattctccacccccccacacttccctaaccacccatgtcaaaaacatttctaacccatgactattgctggttacatattgcaagaaattgatggtagaggcacagtagattttttttaacttgaattttcctggtctcttgactagttttatagcagggttttatatccttaaccatctctaggacaaagcgggatagttacataatgaccacttgccagatgctcacagattagacatgaggtgtgagaagcatcaatgttcctaagttttcaggaaattgaggcatcgctatgattaagtaaagtagcaaattcagacaagaatatgagggtaacatttttcagcagtgagtttgtttattttaactgattaaaatttttcttatttgagtaaaatgttacctcaaaatatctctctacattattcacaaaccaatgtttttcaaataattgttcctgcaaaggataatccagtttgcttttaattttctatcttcaagaatgtcagtttgaaaaacatttctagcccatttttataattgttttataactgaattacaaacaaatttatgtcaattctttgatttgaacatatatacttcttattgtttagattattagtgtcttagattactatgtatcttcaaagccagtgtagtatcaaaatttaaacatacaatggtcagtcatggaaataaatgtatagatgtaacactgtgcaagctgagctggttgtgtctatgtatttaggaatatacatacaaagatgcacttgtatacacacactacatggtggccaagagcttgaaggagaacacggagagttctccttcaaacagaaggagacatgacttaattttattataatctcaaaaaatattttcaaactcaaaatctgcatatcaatttcacacaaaatttcaacatcggtataaagagaacttagaagtgataagaaagattattatttacaaatgtagttaaattggctaatgataataacaataaaacagtgttcatgtagacacgaaagatttatgtgaaattattaaacattgagaaacctgggttgtatataagcatatttctaactttattattttgatagtgtatatttgccaatatttcaaactttaatatcatgtaagcaaaatcacctctgataacagtgtttttatggaatgaggatcatcaatactattaaagactgaataagcatattttgcttattggaagaaaatggttgtgcatcactaaagtgaaaactttgctttactggggcaataaattttagttagctggggtgacgaaatcagttgtaattagtaggagactagtctcattgcagtgaggtctactgagtcatatttgcttagagtcagccataaagcctacggtcctgagaagctgatctttacctgcagaaggtagtcaaacagtactgtaataatggctcatgtgctactagtttgggtggcataaaagatgaataattaaagtgatatttaaaagtacgttgaggtttggcactataatacgctaagtcagtgaaggtcatagaatatttgaaattctaagactgggatatctgccaaaggcagaggtaattgtggattgaaggcagtttgggcatcaaagataggatgtgtgtatgtatggcagaaagattgctgagtctatctaagctcttggaacctgcaaaaaataatattctattctgttgaggtttagttttgctttggtattgtcatttctgtgaccaaattcttccctgttggaataaaaaaatatgtaagctctttctttttatttttgcaggaacaatattgcagttaagaactctggatttttaagacagacattggattttaagctgttgaaattgttgaagactgtgaaatttataagataatattatgttttatattatgatatccacatggaattttggatataaacataaaggagttagaagtgcatgatgatgtttatattgtcaagttgacaaatgatcagttgtgtttcttaggttagtttagttaacttgacaccactagggtaatcaggaatgatggaaccccaattaaagatttctgccatcagactggcctgtgggcatgtctgtgggctatattacagatggacatgataggacctagcctactatgagtgctgccatcactggactgcaggcactcttgagttgaataagaaagcaggttgagcaaaccatggggagcaagatagtgaagaacacttctccatgctttctgcttcagtccttacatatagcttgtgacttagattctctccatgaggaattgtaacctttaacccacataaaatccttagcttccttagctcttttctatcagtgttttatcacagcaacagggaagcaatttaagctaactggattcattatgagaaaaatttcaaattttttaattaaataattttcctttttatagcaaaccaggaagtaaaataatatagcttttattataattgttaactatattgaaattatatcattttgaattatatctaagaatcaacataaaattcccagcttcatgtatgtattctattaataatttctaccataggaaatgcatgttacagaagttctgcctaagagatcattacagagtaactaccctaactcagactcctaaaattaatacatgtgtcaattgcctgctgaagtggaacaccctaacaagggtgccaaacatttcaacgatgcaattccaaatagtcatccacaaagtgcatgccgaagaacaatacgtttatgttacctcctcccccaaatattaaaatataccataatatattagactacatttatggttttgggttgagctgtactttcggatatcattagtgatttttgactggatttaaagattgaatttggagaactgtaattaatctcagtattttagttgtattcaattacatttaccattaccaaaagattaataaatatatatatatatatatatatatatatatatatgtgcccatgtggtgtgggccaaaaaataaaaaaatacataagtaaataaaaaagtgcagtaggcattgtcttattcattctcatctacctatctacctgaagtgaagatagttgtcattcgacttgaagcagaaattactactaatgtattgccatatggtttgctgtgcccagggattcagtattcaaggaagacctgacaaaatgttagtgtagtgtgaggaaaagtgtctgaaagtatatatgccaataacataattaaggaaagcagaaagtagttatttacagtgtaaaacgagaagctggtgcagaggaagaagcatcgcaggctgctgtgaggaagtatggtcagcaaagtccattttagggataaagaaaaaccagacatacaggcttctggctggaaattaagtgagtgtaaaggattgtagatcaataatgcaataaatgggacagaaggctaatggttcttttgtttcaaagtgtaaatggcatttttgtgttccactgtaaaccttaagtggtagcttttttaatcacagcacagaaagcctcgcattttgcctttcttatcacagattgatctgtttaactatgctttaatgtacatactctgtacttagcctcattgggtgttagataacaattttacctaaggactgggcatggagaggaccagtttgtcaaaacaatattgtcacctcagaagaatttaatatagtttaagaaaggaaaaaagcccagtgaataaatgtagtgaatatagataattatacatgaaagagaaacggaagcatttagactatgtattgaaagctcagcctgtgatgctcttaccctttctctgtctaggttcaagaactaaaagcccaatgccacagccataaacatgtcttttggtggtacctttgggcactgtccttggaatgtgtgaaagaattcttgataaatgttcacaggccaaatcagactgcaggagaggatttagtttttaaatgtgtcataataaactgatacattttgaacttttcataaagtgctgacagataagctgatgaggtggctcagtgggtaacggtacttggtggcaagcccaaagacttaaatttgatcactgggacctacacagtggaataagagaaagaactgttgactgtcttctgacttccacatctgtgctatggcgtaatgagtccatacatgccatgtgaatgtgtcttcatatatgcaactagatcaatgatttatacacacatacatgagagagagagagagagagagagagagagagagagagagagagagagagagagagagagagagaggtacagagagagagacagaatgcaaaattgaaaataaaggctgtttgatatgatagtgtttggctttggtgtcttacatgtatatgtatatagattctgcatgtcttactccctttcattttgcactttatttaccctttctctttcatgaaattttactggccatctgcatattcatttagcttccttgcattaaggaagaagaagaagaagaaaaaaagagactgcaacggggttttaggttgctatttctctgatttcatcaagtgttcttatactccattatatgtcataagtactcagtatgtaagtcgatttccaagaacagtctctaaatgccatttgttataatggtgtttaggaacaaggctttggtgatgaccctctgtatctattttatacatataaagtaggtcaaacagaaccacttaccctcttgtattcaattcatcattactgtggcactactctcttcttagtatcttctccttttcatattaagtattccttgtcctctgaaagtctcctgttaggaaattgctttatggtaatcacatctcttaccctcctgaagatctctgcatctttcagctacattcggcctttgtcatcttagaaattggatgagaataatggagtgcagtatgcaaaaagaaggcacccatttacattatatatttctgcatttttctttatgcatgtgtgtccaaaagaactgtagtgtcacaagtgatgcaaagtaatgccctctaggaaggtaattttacaatgtggagagtattagaagttattgagaggtggaaatgaatccacatggaagaaggtaccacaaatctagacaagaactttcatggtatcttttctaagatggatggatctttaaaaacaaattttagtgtcagcagattagaactagatgtagtcttagaaaagggatcttatgtaagccttatttgtacggatgaaaaaagctaagccactctgctctttaagaaagagtttgcagtgttcaactcaaaagtcttccgtcataaaaatattgaggacatatatgcaaatccatgatatattgaatagtcacttataataacagtcattttcatcatataattttatgtaattgactaaaagccttatagctaaggtaacagaaggaccaaagtggtagagatggtagagttcattttctatatgtttactattctatcacattgattctcctgtttgaaacatcttacttgattgtcatttgacttataaaccttagttttagtttagcaccttggaaaaataataataagtatgatatataatgatagctgaaaacatttagaaagtnnnnnnnnnnnnnnnnnnnntgtgtccaaaagaactgtagtgtcacaagtgatgcaaagtaatgccctctaggaaggtaattttacaatgtggagagtattagaagttattgagaggtggaaatgaatcccacatggaagaaggtaccacaaatctagacaagaactttcatggtatcttttctaagatggatggatctttaaaaacaaattttagtgtcagcagattagaactagatgtagtcttagaaaagggatcttatgtaagccttatttgtacggatgaaaaaagctaagccactctgctctttaagaaagagtttgcagtgttcaactcaaaagtcttccgtcataaaaatattgaggacatatatgcaaatccatgatatattgaatagtcacttataataacagtcattttcatcatataattttatgtaattgactaaaagccttatagctaaggtaacagaaggaccaaagtggttgagaagttagagtttattttctatatgtttactattctatcacattgattctcctgtttgaaacatcttacttgattgtcacttgacttataaaccttagttttagtttagcaccttggaaaaataataataagtatgatatataatgatagctgaaaacatttagaaagtatctttcttttctgtatatactatggataattataaccaagtcattcatttcacattttaaaacattatcagtttcaaacatgaaaataagtttagaaatattaacattgttatcaaatattatgaaattaatatatagctgaaacatgtctcacatctatgcatttttgctagcttatcttttccaacctgctatatgataacaatatgtcattgaaacatatcttgatgtgattgtaaaatagtattattctctctctcactctctctctttctctctctctctctctctctctctctctctgtgtgtgtgtgtgtgtgtgtttgtgtgtgtatgtgtgtaatagttccatttaaaattacaaggattttcatctgataataagttgaagcaaagatatagaagagctctacaatgattactatagctacttgatatgagaaaaagaataaaaattaattttcaaaagaaataattatgttcatggaaaaatcagtattttaaaatgtttaacaactaaaaaaataaataatctataaattcatagaaatgtctatctaactacaaatgaatttttcagaaaattggtttaaaaattagtcttaaagttttcattgatccaccaaacacttggtaaccagtgcaatattaaggaagtttaccaggagaacaaactataaagaagtataaattacaccacaatgtatatttggctaccaagacttcatggtattagcagatcagataaatgtagcacaaaatagagtccaggagtcacatcacttgcaaggtcaattgatttatagcatattttccagggacataagttcaagaaagttatttctagaaacaatacaaggacaattgtatatcaagggactaaaaaaatgaaacatttctctgttctacaccatctcaaaatgttttaaataaaaaaaaacataatagctaaacaaaaatataggaaaacttatggcttttaaaaagtaagaaaaagataagaaccaaagcttcagaaaacaaaagtaaactagagaagaaggacataatttgcaatctcccatgccacaaagaaacagaataataacaatacaaatgcacattgcataaaaatatatgcatacttaatcatggacaaaaatgtgaacgactttttttacgattactaatgaaagaaattcagatcacagcactgatgggagttcacaccactaaatcctaccatggaaaagagcaaatagtcaacaaaattttagagaaaagagacaagcttgcacactaccagtaaaaatataaattagtatttccattattagaaatagtttggaattatcttaaatatataaaaacaaatgctgcagattctgcagtccaacaaatcagtgtgcgaaaacacaggaattgaaagctgtgtgttaagcagcctccacgatttctatgttcactgaagaaccatttccaaggaaataaactgaaacaatctaaagtgtgtgtcagttaataaatatataatgcaaacattatataataaataaaaagggataaatttcatagatttaaaaaaaatagaatgaaccctgtcttgtgtaacaatatggagcggcctgaggtttattgtgtttagtaaatcaagcagtgcacataagcgataaccacagaacctcagtaatatataaccttattaattttaaattgatggtacaaaagttaagtatgtaatgtgtacaaattggagtttatgggtcattaaaataataagtagacacaaacttgggtgtgtgggtagggaagaacctgggaggagttaaggggagaatttttgataaataggataaagatacatagtatgatgttcataaggtactcataaaatattttttaaaagcaacaccaataggaaacagtatattggtgttacatgaatatgaggagctgtaggttgaagactggagaaaaatgtatcaatctgtactggagatgtataggatttctggccttgggattctacagaaagagaaaaagatataaggatgataccattcatatcaaaaggttaggctaaaggtttatctatcttgttgattttctcaaagaaccaactactcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgtttcttcttggaggcactcagagctatgagtttccctcttagaaatcctttcattgtgtcccaaaggtttgggtacgttgtggcttcattttcattaaactctaaaaagtctttaatttctttctttattccttccttgaccaaggtatcattgagaagagtgttgttcagtttccacgtgagtgttggctttctattatttttttttttttgttattgaagatcagccttagggcctggtgatctgataggatacatgggacaatttcaatatttttgaatctgttgaggcctgttttgtgacctattatgtggtcaattttggagaaggtaccatgaggtgctgagaagaaggtatatctttttgttttaggataaaatgttctgtagatatctgtcagatccatttgtttcatcacttctgttagtttcagtgtgtccctgtttagtttctgtgtccatgatctgtccattggtgaaagtggtgtgttgaagtctcccactattattgtgtgaggtgcaatgtgtgctttgagctttactaaagtttctttaatgaatgtggctgcccttgtatttggagcatagatattcagaattgagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtattctgttgctgatgctcaaatctatggttccagatttctttcctagggtttctatctccagtgttgcctcattttgagttttctttattgtgtctacttccctttttaggtctagtatggttttttcatttccatcacctgtttgtatgttttttcctctttttctgtaaggacttctacctgtttgattgtgttttcctgtttttctctaaggacttgtaactctttagcagtgttctcctgtatttctttaagtgatttattaaagtccttcttgatgtcctctaccatcatcatgagatatgcttttaaatctaggtctaggttttcaggtgtgttggggtgtcctgggctggacgaagtgggagtgctgggttctgatgatggtgagtggtcttggttcctgttagtaagattcctacatttacctttcgccatctggtaatctctggagttagtagttatagttgactctgtttagagattgttcttctggtgattctgttactgtctatcagcagacctgggagacagattctctcctctgagtttcagtgctcagagcactctctgctggcaagctctcttacagggaaggtgcgcagataacttgtttttggacctcctcctggccgaagaagaaggcccaaaacagggcctttctcagaagctgtgttgctttggcagttcccagaagctgtcagcttctgtggtgcagactctcacctatgcagactaaattcctaagttccagggagtcccggaatcaagatggcgaccgctgctgctgaggctgaggccgcctcccaagccaggcggacacctgtcctctggtccggatggtggccagctgtctgcagcccccaagggtgctgtctcagcggctctgtgcttctgcctgtcccagaagctgtccggttctctggcgcaccctctcacctgttcagactaatttcctaagttctgctgagacccggaaccaagatggcaaccaatgctgctgaggctgaggctgcctcccaagccagtctttaatttatcagggtcctttagagtaatataacttatagaatgaaatgcatatatctgtgcatgctatttgaggggtagagggcacccgagggataaagggagtgggataaaacacgcatccaaccagatttcctgtgctctgggtgagcagacatggaaggactgccacatgctttccatgtggcccacgtgggtgcctggctgtgtgaagccacataatctcagctcgctgggggatggacaaggggcagccctaagtaccatattctcagccttgggcatcccatgctaaataccaccgaagagctaagaacagaatgccctcccccccccccatgcagctcaggcagcttggtcagccccagggtaggagggaggagagggcaagaagagagggcactaggtggttcccacagacagtctttggtccggtccatggctgcaacacaggaaggccatctggtgggaggttagatgtggctcattaggagaaggcctatcccttctttcaagcaaggtggccttgataagcagagacagtctatgatttagagctttattgtggaaagtcagagaaaaagagagaagatagaaagagagagagaattcatcttggtagattttacctttgatgagtatgaagtgcccctttttgtctggaatgccagggtaaagaagtgggagtgggtgggtatgagtgcagggcgggggggagggtacagggaactttcaggatagcatttgaaatgtaaataaagaaaatatctaataaaaacctttagctagactcactagagggcacagggacaaaatcctaactaacaaaatcagaactgaaaagggagacataacaacagatcctgaagaaatccaaaacaccatcagatccttctacaaaaggctatactcaacaaaactggaaaannnnnnnnnnnnnnnnnnnngggggagtgggtggttaggggagtgggggtgggtgggtatgggggacttttggtataacattggaaatgtaaatgagctaaatacctaatagaaaaaaaaaggaaaaaaaaagaaagttactttcatacaataaaaaaaaattaaaaggaaaaaaaaaaagaaaaaaaaggtaaaaaaaaaaaaaggttaggctaaagaccttttttcctaccatgaaaatgtcataattatttgagaagataaatggttattctgatttaaatactatgtgtatgcatttatcaaaagtattcttgaaccctcaaatgtataccattcattgtttaatatattaattggtgcaaattcaactgaaactttcagacaaatataattttaaagtaatgtaaataaaaagtggagggaccagaaacaagagaaaaatgatgcataattaagcagagagaggctttttcacagttagctgtcttaagctccatgccagtcagtccctgtcatttcaggattatgatgggagaagacaggatggactgtttgacaatggttgtactttggtgaaatgacaccattttgaaacagacagatatgatgcatgtgaagattgtgactctactagataaccctgaacttattcctttgaaatagttcaaatttccccttcccaaagtaaagcacaaaataaaatacgtgtaaacattctattcagtaatgcattattcaagatttatttggtggaagtcataatttattgtccatatttcttcaacaatagagttatctttttggaaatattatgatttcattataccttgctaaagtggcaacaatagtgcgaattattacacattttccttgacacatttttatgtttttctaatatgcttttaattatcttttagtggattttattccacatttgtagatagatagtggatagaaagacagacacagagagacataaatatatgatagattaatagattatagatagatgatacatgatatgcatgatggatagatagacactgggcactattttagcttgaatattttgaatgttatttttctcttttctgttgctattttttcaatggttattcttatacagataacatacattcagtgagattagctctttatgtaacatgatttgcccagatcattctaagagcctctgaacagatgggatgggtttaaatataagaagcagtagcctcatatcacctccttgcagtgctacttggaagaaactcaagaaaaatcaatatctaaacacaaaatatatactcacacacattttgctgaataatgaaactcctcacatacatggttttatatatgtgcaaaatatatgtatttagatggnnnnnnnnnnnnnnnnnnnncagtagcctcatatcacctccttgcagtgctacttggaagaaactcaaggaaaaatcaatatctaaacacaaaatatatactcacacacattttgctgaataatgaaactcctcacatacatggttttatatatgtgcaaaatatatgtatttagatggagaaaaaaatttttagattcttaaaattttactagagagtatctttacttaattttgaggcaagattttctggccagtaaccagtgcaaaatatgatataaaaatatataatataatatataaaatatgcaaaatataatattaaatattcatatgaaatatgaatatttattgaaacatgaacattatattttttaaatttttaggatctctgacaagtggaggataccaggcaacatccctacacacatacaaacacacacacacacaaagtaacaaaacttgaatttgattagactagactccatatttttatctgtggataggtaccaggtatacatacattttcctactggctctatttccacgttttgcagatacttaaattatgcatcccataaaacaagtacctcaatgttcattacaatgcatcaaacttgcttttataccctgtacatagtatgacagacaagcagagtataatgaagtgtatctaacctggattacccagcattgggatgaataattttatgaaacacactgatctgtgggatcaaagatacaatgtattatgatgtaccattaatgatggttaattacaagtttaaactcttgattgttaaacagacatgttgggttattttattgtggaaagtggtatcactgtgatttctaatacatggtataatgtagactatgccaaaatatcctcatgcaaacttggatgattgttccaggtgtatagtactcactgtacaagcatgggaatctaaactcatatcctggactcatgtaagtcccatggtattgtgcacatggtaatccaatgtttgttaattgaaatgtgaggcaaattatagagaatccctggtagctgattggtcagcaggcctggcatatatagaaacaataaacaaatatccttgtttcaaacactgtgaaaggtaaggatcaacactgagattgccctctgacctacacatgagtgccatgatacatagactactgggtctgggttcagtcagagaagatgcacctaaccctcaagagtctggaggccccagggagtttagaggtctggtggtgtggagatgtggggtggggacatcctcttggagacagtggggcagggaacaggtatgggatgcagaaaagttggagggtggactgggaagggaatgaaacctggagtgaaaaaagaaagaaagaaagaaagaaaaagaaatgaattaaaaattttaaagagtagtttataaaaatccaaaagacttgtatctagtgtatatacaggattctatcaaaaattgaggaggagccaggaatgggggttcatgcctttaatcccagcactctggaggcagaggcaggtggatttctgagtttgacgccagcctggtctacaaagtgagttccaggacagccagggctatacagagaaaccctgtctcaaaaaaataaaacaaaacaaaataaagcaaaacaaaacaaaaacaaaaaccaaaacaaaaattgaggatggataaaattcgtttcttgtaaaaatattttaaaacagtactcaatgaaattgtatctaatacatatatacagaacactttcaattcaaaagcaaaatgttaaattaccaaatgcgtgtgtgtaggatctgtcagtttatagaatagagtaaatatgcatatataaataagtaaataaataaataaatatatatatatatatatatatatatatatatactatacatctattatatataaatccataaaatagattgtatatatatattatggatttatatataatctattttatggatatatatgtacatatatataaaacaagctaatacatatgtattatacataatgcatacatattacacctatatttcataatacatatatgtgagtatatgcatatataagcacactaaacaagatagccaaaatgtttgtgaaattagcaagcatttttatccatcatgtatgtacaaattacaattataaaatatactgttaatcacctaagagaatgaaatcattaaaaattaagacctgacattcagaagtatttatgagaatgctaaacaatgttaatagaaacacagatgttggccattttttaaaataagtggatcagtttattacagtatgaaatatctgctaacatcacatgtgaatatcagacatagttatttccagaaaagttttaatatgcaagtatagatttatgtaaagtatctgcttaaacctctcacacataaaaaatctaaaaaattaatctacagattaatggaaaaacaaattttattaaatcctacagtagataattttgtttcttaagtcttttcttacagtttctataatatggagtatttataagtaaaagaaacaagcatctactacatgcaataatgcaaatgaatttcaaaataattttgctgaaggaaaaccaccaaatataaaaggaactaagctttgcaatttcatgcatatggagttaacgaaaatgtaaattcattctccctgacaaacacagcaggccagtaattgcctagagccaaaatgagtaggtaatattctacaaaagtttgtgaaccttaggtatgcttgattgtttcatgagtttgaaaagcaatctgtatcttgattctgttaggcatcatgtgactatgtgtatctatcaaaccatggcaacctacacatacaaatgcttgtgttttagtgatgtaaacatcacgtcttgataaacctagtttaagtaatacaaatgtattagcatcaagtcaatgaagaaagaaaagacaatttttcattccttagtgaagcattttttttttgctagtaaaatacagtgactcaatttgaacagtgcctttaattttattaattggtatttgaaaaaaaaagaaacaaccaaannnnnnnnnnnnnnnnnnnnggagaaaaaaaattttagattcttaaaattttactagagagtatctttacttaattttgaggcaagattttttggccagtaaccagtgcaaaatatgatatacatatatataatataatatacaaaatatgcaaaatatgatattaaatattcatataaaatatgaatatttattgaaacatgaacattatatttttaaaatttttagggtctctgacaagtggaggataccaggcaacgtccctacacacatacaaacacacacacacacaaagtaacaaaacttaaatttgattagactagactccatatttttatctgtggataggtaccaggtatatatacattttcctactggctctatttccacgttttgcagatacttaaattatgtatcccataaaaaaagtacctcagtgttcattacaatgcatcaaacttgctcttataccctgtacatagtatgacagacaagcagagtataatgaattgtatctaacctggattacccagcattgggatgaataattttatgaaacacactgatatgtgggatcaaagatacaatgtattatgatgtaccattaatgatggttaattacaagtttaaactcttgattattaaacagacgtgttgggttattttattgtggaaagtggtatcactgtgatttctaatacatggtataatgtagactatgccaaaatatcctcatgcaaacttggatgattgttccaggtgtatagtgctcactgtacaagcatgggaatctaaactcatatcctggactcatgtaagtcccatggtattgtgtacatggtaatccaaagtttgttaaatgaaatgtgaggcaaattatagagaatccctggtagctgattggtcagcaggcctggcatatatagaaacaataaacaaatattcttgtttcaaacactgtgaaaggtaaggatcaacacggagattgccctctgaccttcacatgagtgacatgatacatagactactgggtctgggttcagtcagagaagatgcacctaaccctcaagaatctggaggccccagggagtttagaggtctggtggtgtggagatgtggggtggggaaatcctcttggagacagtggggcagggaacaggtatgggatgcagaaaagttggagggtggactgggaagggaatgaaacctggagtgaaaaaaaaaaaaaaaagaaagaaagaaagaaaaaaaaagaaatgaatttaaaattttaaagagtagtttaaaaaaaatccaaaagacttgtatctagtgtatatacaggattctatcaaaaattgaggaggagccaggtatgggggtgcatgcctttaatcccagcactctggaggcagaggcaggtggatttctgagtttgacgccagcctggtctacaaagtgagttccaggacagccagggctatacagagaaaccctgtctcgaaaaaataaaacaaaacaaaataaagcaaaacaaaacaaaaacaaaaaacagaacacaaattgaggagggataaaattggtttcttgtaaaaatattttaaaacagtactcaataaaattgtatctaatacatatatacagaacactttcaattcaaaagcaaaatgttaaattaccaaatgcgtgtgtgtaggatttgtcagtttatagaatagagtaaatatgcatatatatatatatatatatatatatatatatatatatgatacatctattatatataaatccataaaatagattatatatatataatgggtttatatgtaatctattttatggatacatatatgtacatatatatatatataaaacaagataatacatatgtattatacataatgcatacatattacacctatatttcataatacatatatgtgagtatatgcatatataagcacactaaacaagatagccaaaatgtttgtgaaattagcaagcatttttatccatcatgtatgtacaaattacaattataaaatatgctattaatcacctaagagaatgaaatcattaaaaattaagacctgacaatcagaagtatttatgagaatgctaaacaatgttaatagaaacacagatgttggccattttttaaaataagtggatcagtttattacagtatgaaatatctgctaacattacatgtgaatatcagacatacttatttccagaaaagatttaatatgcacgtatagatttatgtaaagtatctgcttaaacctctcacacataaaaaactaaaaaattaatccacagattaatggaaaaacaaattttattaagtcctacagtagatagttttgtttcttaagtcttttcttacagtttctataatatggagtatttatcagtaaaagaaacaagcatctactacatgcaataatgcaaatgaatttcaaaataattttgctgaaggaaaaccaccaaatataaaaggaactaagccttgcaatttcatgcatatggagttaaagaaaatgtaaattcattctccctggcaaacacagcaggccagtaattgcctagagccaaaatgagtaggtaatattctacaaaagtttgtgaaccttaggtatgcttgattgtttcatgagtttgaaaaaccatctgtatcttgattctgttaggcatcatgggactatgtgtatctatcaaaccatggcaacctacacatacaaatgcttgtgttttagtgatgtaaacatcacgtctcgataaacctagtttaagtaatacaaatgtattagcatcaagtcaatgaagaaagaaaagacaatttttcattccttagtgaagcattttttttttgctagtaaaatacagtgactcaatttgaacagtgcctttaattttattaattgttatttgaaaaaaaaagaaacaaccaaaagattcttttccttagaatagactactagtagagaacatttcttttttttattagatattttcttcatttacattttaaatgctatcccctttcctattttcctctctgaaagtcccctataccctccccctaacctgctccccaacccacccactcctgcttcctggccctggcattccactgtactggggtatataatctttgcaaagccatgggtctctcctccaattgatggctgactaggccatcttttgctatatatgcaactagagacaaaagctctggggggtactggttagttcatattgttgttcctcctatagggttgcagacccctttttagctccttgggtactttctgctccttcattgggggcccaagacaaaagtttgttcatcaagaacatttttaaatcattttttaaattctccagtgatggctgtagaatagaatgaagtagaagcaacatagttgtctgactgtcccatctcttaatcatgtctttgttagctccgtattctacacaatacaaaaacggtgtctgggatatatctgcttgctacactgagtaagcagacagtcaacatcagtagaaggaataatgtccttgtaattcatttgcacaagttaaaccaaattgatgtaattttgtggactttgtccaggaactcaatattgtggattagatctctcaggtttgctgtattactgtgacatccaggtttattctttctgaaacaaacactgcaggaaagcgatggtttatacttacaaaggtttatgttacagctagtctattagattgtttttacccaatgcagagcattgtgggcatgctgtaaagtatgagaacataccattggtaacaagtatcagggaaagtttcgacagagtaggattatatgttcatttctttccccttcctataactgcataaagaataggtaaactcaaaataatgccctgaaaagtgtcctagagtacatttaatccagaaactcctagtgagtgtccactcctgttactctgaccaccataatctcctaagtaccttattgtacatacctaagactgtaatgaagttgtcagatatcaatagcagatcaaaaatagcacatttcagacttcaaggaccccctggtccttcaataccattttttttttttttttttttttttttttttggttttggttttggttttggtttttcgagacagggtttctctgtgtagccctggctgtcctggaactcactttgtagaccaggctggcctcaaagtcattaatccacctgcccctgtctccctagtgctgggattacaggcatgtgccaccatgcctggctgagaattctaattcttaatccacaaaagattatttcaatgtgaaactgtgtcagtgagaaatactatgaaaaataaaaacatgatattattttatgatacttcaccttgaaatgttacagctgacaggctatcatgcacacagaaatttaaaatgttcactagaatcaggctgtgatgaaaatgtaacaaatttctacatggaaaataactagtgagttcttctgcatgccaactcaataccttatgtctctaagacgctctgtaaaatctgatcagtttgctgtttagatattgagatctagagctgtagtttcttttagaagttcacgtgtaaccaatttcaatatggattttggcatcctgcttcagtcacaggaaggctgatgctacatgtgagatatccgacacagcctcttcatatgtcataggagaaaactggtcacccagctttctcagtgtgaagcatctaaccataagcttgttatgctgcagcaagtacagcaaataattactatgcatttaatcgtacaaaaatggggatactgtctctattatctctgcatttttaaagaagacaataaaagtgttagatcataacatatgttgccatgcacacatcaaatttagaccaggggcttcctgctatagaaaatttgggtagaagagacattttaaaaaatttcccctcctggaccaccatttgattgttacacatcccattcctggtccccactttctccacaaggatatcaccattccccactccccaaactgccccactccctggggcttcagtctcttgagggttaggtgtaccttctttgactgaacccagattaggcagtcctcatataacatattgttgcccacatggcctatgaattctattgagtttttgttacaaaatatccccctctcatcctgattatttctatcacttttggcatgatgaatgacatgaataactcaaaatagtaaatgacacaaaaaatagtcttcagtagctctgatatttattacattaagcagtaatacatttttaagctccagttaatgatactaaaattaattgttctataagaaaaatatggcttatgacttcagcaagccagtaaactttgctttgttaaagcaccaatcaatatttagagggattaatatggtgtctgtgtcaactatagttcctccattattgactgttcatagaaataagcagttacagaaattctgtggatccctgcgtgcatgtgcctcccattcccctccccccactataatgaaagctattttccattatctgtaaaattgaagtgtcctaagtgtttcacattcagggaatatgttttctttcagttttagcaatcattagtaaaatgagcaaacaaaaatagtttacaggttttacaaatcaggtagcaccttataattcatgcgtgtgttcctgacagctatgattatggcaagcaaaacaacttagagaatcccaagaaaagacttcattaactctttttaattttttttattgcttattttgtttatttacatttcaaatgttatctcccttcccgatttactctctgaaaaccccctatcatatcccttcttccacaagagtacttccccacccaattgcccactcctgccccactgccctagtattcctctacactggggcatcaagccttcacaggatcaaagtcctctcctgtctttgatgccaaacaaggccattatctgctacatatgcagctagagccatgggtcactccatgtatattctttggttggtggtttagtacctggaagctctggggtgtctggttggttgatttgttcttcctaagggattgcaaaaccctttacctccttcagttattcccccaactcctccagtggagtccccctgctcagtccaatggttggctgcaagcatttgcatctgttttagtaaggctcttgcagagcctctcagaagacatccatatcagactcctgtcagcaagcacttcttgacatcagcaatggtgactgtatatgggatggatctccagatggggcagtctctggatggcctttccttcagattctgctccaatctttgtccctgtatgtcctttagacaggaacagttctgggatagaattttgagaagagtgggtgaacccatccctcaaccgggacagcgccttacctctggatatggcatatccagtttctctctcccctttgttgggtattttagctaatgtcacctcgttgggtcctgggagactcttgcttttctggtgtctagtacttcctgaaggcttcctttttatcaatgaatcacttgaagtatgagacttcatagtcacttactctctacatgactacacttgaatctatgcgagactttccatcttttgcagaaagaagctgacttaatgttgaataagatattcttatctatgatggatagataaatatttatgaacacaaatttatattcctataggaaaattgcagaacttaattcccctttagggtctatgacctctcttgccaagatagtgtgataggtttacaaaactctcatatgagttacctactatggagcatatcttacttccaattggacagctattgtgacaagactgaagttctactatcatattttgaagatattttgccctgtcaatcattgtggttcattggtttgctgctgagtaatattctttactgcttttactccaggtcaagttgaatggcaccttctgaaaaaactcaatggtacctattggctcaagatttcaaaaagccaaaccacagaaactaaaaataagcagagttacccaaatgttgtggcaggctcagtttgagttttccttctacaatatttattctctgttctctgtgtctcattctattgactcgtccacagaatcctcataactattttacttttcttccatcagctgttttattacatcatagagagccaccacactcttttaaagcaggccagggcttctcacagcaagtgcactatttaaaaatatcactcactaatatattagtccaagtaaaacaacaacaaatcagaaaaaaaacatcaggcttttcttttcttctttggctttttatttttgtgttttaaattatataacctatttctccagtaaatgaaggtattaatttccctaaagccctaaatcaaaaatctaattgttacagaccataattgctatccaaatggcaagactataagacctcaagtaatcccttgatttgttaatgtataaatctagagactctcaaagacttggagtcattgataaggtcaaccattggtagcagacataatttttaaaagccagtaactcaatagaacatagctccttggaggcaaggatattgtgtaatttatcttccgctccagcacatcttagcatagtatagaatagaaatgatgcccaggaaatagtgaatgatgctggctatctcacttcacagtagcagtttgtaggaaatatattctcctacataaacctcggaaacatcccagcattaaaacagaattcattgtcattctccagatgtcattgtcagtgctcaatgcatccctactctcagaggactgaggtataaaacatttaatgcttcagagtgcggaaaacagcaacaacaaaaatatagcagtggatgttttatcctctagaaagcagatatttctgtcttcagcttctgaacctagtagctctcacgtggaatgttgtgatcagttgatgttctacaggtgtggtattatcattctgaaaggaataattctttggagcagtttttcagattacaggatattcagtatcctttgaccctattttccagtggttataagatctcctgtcaggcaattgtgaaaaactaaccaaaagtttggtgtgaaacaaaagaaaatatctatcagaaaaacatagccatcttgaaaaaaagaagcaagagttatggacgccaatgcaagcatacacacacacacacacacacacgcacacacacaatcaatcaatttgactcagctgtctaatttgagcagcataaagaaaatagaaaaataaatagccacggaaaaatatcttagcattttcctttatttgccacaggaaatatatcagttgcataaacaacaaatatcactttttgttttggagaaatttgttagtttgtcttcagacttttcagtagtaactcctgaaaaaaaaaagggtctctgtgttaggaatgaatcagtggtatttgcaaatgcattcctaaggcaagtacatggcagaaagaatctaagggaagaatcattaatgttggctcatagtttgaaaacactcagtccacaatggcagtgaagatatgacaggtcatggaggagatgaagcagaatgaggaggaagctgatattcccctggtttcctcctttctctctcctttttattgtgtccagagtctacagctaatggaatgatgttacccatactcacaataaggttttgaccctcttttaactcactcttgatgtatcttcgctaacattctcagagcctatctttctaaagtcctatgtaatgcttacttccgctaagttgacaataaacaatagcatgcttgttaactcaaagcatactaaatgagagatagtatgaaaaagtgtatccacctattttccactctgattcctaaatatttgccaagaagacatgaaacagttttaaggaaaaggagacaaaatagtggtgttcacttttattttattattattatttttttttagctctgactctagctaaggcattaagttagccataacactttaaaaggaacaacttcaaatagcactaggtagaacaaaatgagtgaaagaaaacagctatatcttgtttcgttgacatgagagggaagagagaaagagtgcatatgtgcaaagttcatgagttcatcatttatacaaacaaaaagaaatagtcactacattttaacaacgaaagatatcacatgagacaatttccactgttgcgattcaactgcaatggactcttaaactaagatggaaacctttacagagtcatgtaaaataacagacagaagacatggccaggaagacaggtgagatagtttgtgttcattcatgtgcaaattgtttgcgtgggaaaaggtgattttattttatgttgaggaatgatgctgatgaaaatgtatttaagatagtgcatcacaaaggggtttcactacttagccaaaaaacaaagccaacactttccttttaaaaatataaggcagactatttatcagaagcccactgcagaagtattaactataacaaacacatgaggtagtaaggtagcatataccaggtagagcctctaaaactaatgattttctacttatccaagagctcatgaatatggtatttgtaaattctccctctgcaagagcagctactaggatattggttctgaagatttttttggaaacctgacatacagagtttactgtagattgtactccaatattcagttaaggtaacaaaatgtttcattgtagctgtactaaagggtatgcttttgccaaagaactgttttaattagcatagcaatagactctctgaaagaatagtatagtaagtgtggctggttcttgaatataatacatacccttatgtatatattcatttctgaaaatggtactgtaatattctccagaaaataagcctttaaataccaagaaggtagtatttttgtcacaatactggacctggaagtccaggtcccagtagccattctctaaataacagaaggtctctctgctttatctacaaatattttcttcttatctgtaaaccactaagattgtatttgaaaaaccactgtaatggctgttttttttttttacattatttagttctatactagatctatcttcagtcacttttttaaatgcttggttggaactaaaacacagggactggtgatggttgcaatttacttttgggatagcattggaaatgtggttgaggaaaataggtaataaaaatattaaaaaaacaaattatttttaaattgttcctggtttgttggtttttttaaaattttgcatggccatcactagcctcaatgtaacagtttcctcattgaaactatgcacactgagggtagagaggtctgtgttatcaggagctcttgtctgttgtatagagtctcgaggcttgtactcagtgaaagtcagttgtggtccacatatttctacttgaaaatgcccattgatattgaaaaatattcccaaataatagcctcataagttagggggtaatttatgttgaattagtgagtgtgttgagaatggagttgatcatgattctgtttattaaaaacctatgatctttagccataggctgtgtgtattttgcatcctgcctctatcattgtattgttctgaacaggcttcttcccctttgtgtgacttgcttttaataccttaaaaatgtcatcactttcttaaatatttaataggtaaacaaagcttgattcagtagacctttattggtgagagacctttctttttatagcaaaggcattagccataatgcttataattaaaattctaaaattgttgataaagtttttctgatagtaagaggttataaagatttattgtggtaaagagctgagttgaattcctccctgcaaattcaaaatgatcattgagcacaatgctttaatggaattgatgtcaggatgggaaataaatttcctgaatcagttgacaactttttaagaataaataagcattcatactttcctaagaatcatagtttttaatcacgttcaccaagggactcataaaataccaaaaatagtagaagtaaaacttcacaaacattaaagaataagggaacacatgaatataaaatcccaaggcaagtctttggggggaaaatgtaagaatgataaactgtactaagaaaggaactaaagcacaaatatataaaataaacaaaaaaacaaggcaattaatataaaaggcaaggcaattaaaaactaactcctaagagattgctttattagcatatacattaataaatgtatgctaatcctatactgatcatgtgtaccaataaatcatataattatacactaataaaaatattgacaatcagagggaccatgatgctttttgttccccttcaccatacctctgacagtgttgggaaaactgacctattatcctgtgactgcagcctcgaagtccacataagataaaaacagaactacatcccttcaatgtaagatcttacagccactttatagattatgaccttgaagaagtaagttttaatgagccctagagttgaaatacttattaacatgaatgatcagcatgttcatctttttatccctatcttattaaatgtttatctttttaaagaaaacgcagtttatgaaggccttcctaaaacacacaaactgaataacagttaaagaaaacattatactttgcggaatggtgtagaataactgacatttaagtactaaggtcacaattaagtcagcatgccctttgtcacgaatggaatttagtgaagttttggaatgttagacaaaaacttagagaacaataacaatttatcaaaattggagagagataggtagtgaaattatatattaaatataagatattgtagaaccccaatgtgagacaactgacatattttgtaaatgataattcagtaattttacttatagtaagtgcccgggtcattttaaaataccaaatcatcacgtgattaataaaggaaaaaactttacaaggcatagtgacacctgcctattatcccagaacttggaagcttgatgcaggaagactctaagtttgagtggaaccagataaggataattagatactacccaaaaagtaaattagcaggatgaagttaaaaaataaagtatcaaacaaagcggtatgtacatataaacaaatatgtatttgtaacatattacttgaaggacatatagtatttttcttgataatagcttaggatgtggtaatgagactcatcaaattataccatgaataatttaaatttttatattatggacacatattatctttctttttaattacacattttgcaaattattattttgatcatgctctttaaccaccatattatcttataaagatatataattaaattttatttttaaatgattgtttttattaataacaatagcattttttacatcttgaattaaactcttcttccaggaacaataggtttaattaaaataattaaaactaattgtaaatctcatacaattcaaataggatgtgtgtaaacaatgttcataaatccccctagtaatatgcaaagcactttgcaaaggtataccctgaaacttaaaactgaattcttccattctgtgttgttcatattatcatctgcctccaaacagagcttatgtggactgtgtaaatcatagcaattatccctggttttaaagcagtcttcaacttctgctaagacttcctttgagtcacagaaaatttgaaagccatgtgttgacttccctctgtcccagtagaatccttgtgcttgggtagtttataataagagagtaatttgacttaaggttcagataactagggaatacaaatttgaggtttagaatttgaagaaaacaatcttactttggcatcctaacatggaaggttaaaaacacacggccggtcaaggtaccagccttgttgacttaagccctttataatatcactgatctattcaggagagtagagcctaaactcccaagaggcttcacattggatatgcttgaattggccattaatattctaccatattttgcagggcacgttgaaaccatagattgcagctcactcaagccaatataaataagcaaagaagtcctcaaattatacttttgattttctgttacattttctttagggagctgtctttgaggactactcaatatctatttggggcggcgggtgggggtgaggggaggggtgaatgtgctctatttctgtttcatccaagcattgagattaagaaactttcatttttgaggaaatgatttctcttataggggtttgaagtgaaaaataatgctgtgatgtgtttcatataaataaaacaccttgtctgtaaaattttaatcaagttgtacatatttgagtagtgctaactcttactcaatccttgtgcagtatgttggcagcaacagcaactgcatagggcctacatgcttactgtttaatatggtatcacctttaccaaaatccaagatggttagcaatttcaacgtattacaaaagaataaaaacgtctaatttatgcctctgtttatgcaagagactattgtaattattaattagttgttatggagtttattattatctcaagccagaaagttgacttcatatagcaataagaacattagcaaagaacacgattaactggtcaagaaggcaaaggttgttgttcaataatctcggcttcatggctcggcttacttgttgtttggctatatggcaaaattcagcactgtaactgtctgtttccttgtagaaagataacaatcataacacccagtgaaggtctgattatgccttaactctaaaaatagtgatgcatttggggctggggactgagtgtaggaaggagcataagaaaaattgtaagtcgaaatagagaaggctttgctttctgaacttaaatctgtctaagaaatcatgattttaaattgatgataatattagtttaaagaaaatataatttacttaattacccaacttcttgctcttcaccccccatagtctcccttgcactccatcttacattcatggctttttattctttaattattattgttaataaatcaaggtataaatgctacctgctgagtcccattgttgttcttgtatgtatttacaggtatagttgtaggtgtagatagagatagagatagagatagagagagagagagagagatacagatacagatacagatacagatacagatacagatacagatacagatacagatacagatacagatacagatattgacctgaccatttgaggttgaatagtcatttagggttctcatgtctatgcacaattaattctccttttcttggcagtgtttttttgtttttgttttgttgttttgttttgttttaggtattttctttatttacatttccaatgctatcccaaaagtcctaaaacttaaccaagtaaaaaattacagcaaagtaaagttctggtgccaattacatttgatttccactcctgtccttgacagttcctttagtatggaatgtttttctcttcaatatctacatgcatcatttctttcccattcttttttcttcaaataatgtttattgacagaattctttcttaccccctgcatttaacatttcttccacaagtacccttcctgtattctggtttatttttctaaaagcatttgatcttcttgacatattgaataccattttattaaggagcatctgtctcttaccaacaggaagtaagctttatgaaaggcatggctgaacacaatgaaatcatgctgcttcttagctaaagccttcacccctactttttatggtactggaaggtactcctactagagaaaagtaaacagcaatccagctacaagctgtgctctacactgtgtcttctagacacaatggcagtatgcaactgcaatgagcttgtacaggttcaagggcgacagagtcccagaactgaggaacactagacataaggttcccttcctaaccaagaagctatttctaacaacgttttgcaaggaaaaaatagttttctcaaatggattttcactgggtatataaaatatagttagattatatccaataacaagatccccaaaccatctgtattatggtttctagttctgtgttgttatggtatatgtgtgtgtgtgtgtgtgtgtgtgtgtgtgtgtgtgtgtgtgtctgtgcctgtacattgcatgcatgcacatctatgtgtactttatctttaatttagtttgctctttaacacacattcatttttttatactggaaactaaattcaaatatttttaataggttctcaattatagaacctatagaccttagttaatctaaaatcatggctttcacatccctatcaattttagatttgaaaaagcaatatagaatgtaaaaagtgtaagagtcattttttctcaccctagttctgggtgtccaaagtatgtgtctggtttacacatcagataggggcttatacataccatagatcagcccattgtgattggctttgtggggagcagtgtcaactctttgtctagaactcactaaataggctatgtaggctgagattataatctcatacaatcatgcctggctttttttttttttttaatgtgactttcggcattgatttcaggacctcatgattttgtagtaaaaacgtatccaatttagtcttacatcccctattttaaagactgaatttgtcctactaaaccctgttgttaagggcaggaatataggaggaagtgagtttgccaggctacgatcacacattaaaatttaatctgcaatacatgtcccacaaatcaactactgttctatcaaatgtgtaccagcctatcaggaattaaaatataggctactgaaatggagtgaagtagaaaatctcagatgccatgttcaaaagactgaaatgtacaaagagcaaactgtatgttttctttaatacaaaattaaaactatttgctgtaaagctatttaggagcacatgatgacaaatattgcttccttcattttgtggaatccctcaaacagctcagactattattaatatgtaccatctagctgctattcaacctctctctctctctctctctctctctctctctctctctctctctctctctctgtgtgtgtatgtgtgtgtgtgtgtgtgtgtgtgtgtgtgtgtgtttgagacactagctgatagctgcaataattatttaacagatcttagtatgtaaaatgtttagtgaataagggtccattgagagctttgaaggaagaatctcccttaattagcgaggccatgtgctttaattaggaagtagtaaatttgaagcaggaaaaaaaaaataattcaagacatcctacctgtcatgttttacatccctcatgaaatggaatgaactaatcttgtttttcataggagtcttctatataccacccccccaaaaaaaatctcaatcatgcctcaaagacaactttgaaaaccactcagtacagcagccattctgatgtgatttcaaagctgcagagatgcattatcatggaaacaagatcctggctgatttgaatttcatctgctcctgcagctcatcccctccttgtgaagtgataatatccctttatgatgacttctttttttccctcgctttactaaaatgcattgtcaggaataaaatatggtgattctagccagcattaacaaagattgatggaatcctggactaggaagttaagattctgtggtcctagatgataaaaactcttttatttcattagaaatttctcagttgttcagttcctgaaaattactaacaccaacatttatactgagaggaaaaaaaatcattttataaagccccagttgacaatcaacagtgttttaaaatgataataagatcattctaaactctgacaagacaacaaaaccattttatttgattaataaaattgtcttgtaaaaagtattcgcattgaaaatttcaattctatgcatatcattatatgttggtagacttccaagccagtgtttattctgttcaagtaaatgtcctaggttcctgagccatgatgttagaggattactgggtatggctaagttaagaaaacctgtatatctttctccatcctacatggattgggtacagagaagcttaaaataattacatctccatagatttattcaaagtccctgtgttgtgatttagttggtctatataaataaagtactcctattcaggcagttagtgtgtttctaggataagactgtagaatccaggtttcaactcttgatgtgcttaaatagtgtgttagcaaaagaagttctgggtgggacatagggaattctctcgcccttgcctcttctgttagaatgtaggtcttgatggtgttgggttgtggttgttaacacacagtattcagttccccaacagagtaaatacagaatcttaatcttggtttttttctttcttttctcttccttccttccttccttccttccttccttccttccttccctcctttctttctttctttctttctttctttctttctttctttctttcttcctttctttctttctttctccttttcgttttcttttttgtttattttttaagaaacatgttttaattactcttgaaattgcatggaacaaccttccataattcttctacctgaacttatcctacagtcagagaagtcagcaagcaaaatcattgaaaatgatggtaagattcaaatttagctaatctcataatatactattaatatttgtagtaatcaaaacattaagctactagattaaaagttgtcatacagattaatgggacaatatataaaacagaaataaatccacattggcttttgtcactgatattaatttagttgaagatatgattaaactctgtgaccaagtctggtttgcaattcccagtgtaaaccaggctgaattcaaactaacaatctactttcctcaacctccacagtgttgaaagaatagctgtgggtccccattcctccaaaaatgtacacttctttagtctactagttactggaaaatatttcaaatctatataataaaggacaaatagtttctaaaataaatgacaattaagataaggtatgtccacaggcaaaataaaattagattattttttattttacaacaaataaaaaattccaacacaaattggattgagaacttacatgggatgaaatcttaaaattactacatgaaaatatgcaaggaaagattattgactttgatcttttatttatgacccttaaaacgtagataacaaaggcaaaaaggaaaacttcaaacacccccccacacagagagagaaagagacagagagacagagagggacagagacagacggacagagggacagagaaacagagatagatagagagatagagactgagaaagacacaaagagagacagaaagagagagaaagggaaagagggaagagaactcttgtgtgtaacaaagaaaccaaccatgagagggaaagacatattcaaacgtgagaaaatatttgctaaccacattccttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacaaacacatatagacattcatacacacacacacacacacacacacacatacacacacacacacacacacacacacacacacacacacacacacactcacaccatgctccaaatcctgatgtaacaaagaccctggacagcaaaatgacctacccagtagtaacatggccatggagatctttcaagaagaccaaatccagaaaatgaaccattctccatctagaacatcctgccattgctcaaagccaggacaatcatgcagatgggcagcgcatttttggggcagagcttgtgaggagttccaggctgtggttgcatactaccctgcctgtccaattcagtaactaactgtatgcctcctagtctactgaatcctcctcatttccacacctattattgctatctcatgtctagttttacttttcttctctattttgttgcatcatgattcttaactctctacattgattaatcaaagtggcattgcaaactgcattgtgtcacacaatatattttacccaaatagctttacatgcaaatactaatagcaaagaatcattggtttggttcagagtctctggtttaggaagcactataaatactgaactatctgtgagacttgtcttgcataatcctgttgttggccagagtcgaggtgatcttgaagctgtgcagggagtcagaggcaggatttgagagagctacaggcttctctgcatacccctctgccttcagtgactgtagtaccactggcataccagtaagactatgatacttatcacctgaggtagcacctcagccttgtgttctcctctgctagcagagtaagtagctggggttgcagcagctgaggcttcatgctggctgaggctgtgaggactggtcctacacaggtatgtcattttactttgtctgctgtggccttgttcccataaggctcccaaactcatctccaccatgtgtggctctgctgtgtcaattatcctaccaatttcattagaccactttctaaaaccataagaccagcatttttttttgttgtactggagatgctatgggttctgcagactcagcaggctccacctcagtcactgtgtctacaattagaaccacctagcatctctcagacttctttgtgctgctcctagctcctgatgctaaacatattcttaataagaagataatatttaaataacttatataatataacatagcatttacagtggtcagcaaattatatgatttaaatatatttgcctttagcatttacttatggtatatgtgcagacgtgtgtgtatatgtgtatatatgtatgtgttgggggagttgtttacatttgtgtgtgcatatggaagtccagaagtgcatattcaatgttgtcttgggaactgcccattttgatttttgaagcaagatctctttcagggacttggatttcattaagtgatatagaatggttggctagtgagttctgggcctctgtctatctatagttccccagcatgtgacacattcaaatttttatgtgaatctaggggcttaaagtcacagaaaacactttaagtcacagatgggtctttctttcttggccttattatatatccatagtttgtttaaaaagcatacaaataaataacatacatattcaaatgttcaacttcactaattatcaaataattcatggactcggagatgactcagtagttataagcactgactgctcttccagtggtcctaagtttaattcccagcaaccagcaaccacatggtggctcacaactatctgtaatgggctctgatgccctcttctaatgtgcatgaagataaaatactcatatctatctatctatctatctatctatctatctatctatatgagtacatatgtatatacatatatatattcatataaataaaataaccttcaatttaaaaaaagaagattcaaagaaaatccacattttactattatcaaacacttgtcaacatgttgcttatcagtgacacatgggtggctttctgtagtgatataaaaaaagataatactatgctataaacacttatatttgatccaaatataaatcctacaactactccatgattcaacagtcccacttctgtgtacacatccaaaggaaagtaactcagtatttcgggcagttatgtgtactctgttgcagcccaaggttcacagaattcatagtagtcaatacgtggcatgaaccaataggacagcaatgacttctaaagagtgaagctttggcttctgtatactgaagggttgcatacaaagtgaggctagtcacacaaaaaaaggcaaatacttgaggatggcaactgtaggcattattttaaaagtccatcttcaagaagaatgctgatttctagggttggaaatgagaataatgagtggtagtccacggggatcaaatccagttataaagagtgaatttattctggagatctattgcataatgtgactgaaatttacaataatgaattctatctcaatttgtgaatagaaaaatccactctaacaactgatcttaaatattcctacatatgcacaggactgcaaatattttgtgagaaaatgctatattgtttgtgttagggcagtgaggagagagtaggtggatggatggggccctcatagaacctggagagatgggataggaggtctgtggaggggaaactgagaaggaggataacatttgaagtgtaaataaataaaataaccaaaaaaaaaaaaaaaaaaaaaaaaaggaacctacttctacagtttcctacatggaatgaaaacttgcagctatctaggacctacctgggtctctagcaccaaaatgagactgctgagatattcaggctatgaactgagcaactaccatatccttgacctttccaccaagatataaccccatttagaaatttctcataatatggagagatttctgaaatacaagttcaactatagttattaaggttatctcctgctggtatgggaggatcagcagagatgaaggacagctttaccatctgctcttggaagactttcaggaaattgctgagcagattttccacaggctaagtcatatgtatgtggttaaggttgtctgtaatgatattataaaggctctgctcactcacttctgtgacctaaaagtggctaatgccaggcataagaacatctaagccatttgtgttgcaccatgcttgaaagtctcacattatgatgtaagattcttctgtacatgttttcaggttctagtgttttcccttctcccttcaaaggttacccagtctcttagtttatgtataatactctctgaaattttcacaacaaaattctttaagtcagaaagggatttactgagaaaattacattacatttagacataagactaatctatggggttatattaatcaaatgttttttgcccagtacaaaaacagagaggaagtacagagaggaaaaaaatgaacatcacaagagatactacatatatgttcatttttatgaagagtttatcaagattatcaacaacatctatgatgcggagttctgaaatcagctaagaatgtcatatgtaaaaatttataggagaatcttgagattttgaagcaaagctttaccatcatctgaaaacaatgatactccttttgagagacagctctttgtcttggcagtaattgaacacttgataatggatcaccaagttaccatggtaaatgagcttcccatcctgggttgcatattatctgatccacacagacataaaggaggatgtgaatggcagcagcgcattgtcaaatggaaattgtataaacttggttgggccaaatcatgttacataaagaagttcctaaaacacctatggtttctgcctctgttgcactgtatctgtactaagcaggtacctgtagattcatggggtcattcttatcatcagtagtttgaggaagagaaaattaatgaatgttatgcagataccacacagaagtgaacagttctggtattacaacctctttctgtggcagaaagacttgaagagaaatctttagagatggcaaaactttgagcagcatacacaggagtacagtttgcttgacaagagagatggccatgtatgcaattagctactgattcaaggagtgtacttggttgtcaacttgacaataagtgcaattaactgaaacccaaacagctgggctcacccgtgatgaatttttcttctttggattatttgaggcagagccactcaccctaaatctgggtcatgtgaggacagaatagccactcaaaatctgggttacccgttctggtagcagcccacctgaaatgatgtgcaaaaaggatgtgtttgcttttactgcttgccctcactatcgcaggaaagtttgctagtgttagtacctacagttttgaaacttttaatgtggattagagactggcagttctctgggacttcatttgcaatccagcacaatattaggactactattgagacactgagtcttgtgtactaaacaactacccaactaccatgatatttccattaaaacacagtcattgttggattacagcctgtaagccaatctctttctgtctctgtctctctgtctctctgtctctctgtctctctgtctctctgtctctctctctctctctctctctctctctctctctctctctgtgtgtgtgtgtgtatgtgttctacatacattatactatcatttatatttctttagaagaccctaactaatgaagagagggaaatatacatagaatgaaaatatgaaccaatgtctagttagagtagaaatgttgaaagatctgtaactgaagcttgtgatagggatgagcacaagacaaataccagttaatattagctcagcattaatgaaaccacccatccatccttagcttgtaaacacagattagtcttgtgtctaaatgcttttcagagaacatttacttgttgtctaataatatcccctagtttggtattctcaaactctttttctctggggtgtattgtgatctgtatttcctacattcttctacaagtaagcttcataaactgtattctttatccatattctctgtttctatttgttcttttttgaaagattatataaaccagtttttttattttaaagctctcttgacttttctgttgttattcctaactaaccttgtgatatatttctcacattaattatatattcaaactcttttctaactgaaacttttactaataagaaagtgttagagtctagttctcttaaattcttacaggcagtttttccagttaccgaaaggacactacaatgtatgttcttcattgtcaagtataagttcatattattattactatttttataattttatttaagtattggtatcttcattattttccagtcctccttctgacttttatttccaccatctcctctcaaattcatgtcgtcttacaatttagttattattttaatatatatgatagtcctaaaaataaaatatctattaataaacataaaaagaggtaaaatatatttaaatgaatacaaaaattctatataaaaatttgaggaagcagctagaagatgcaaacatcacacagactcatgaactggtagaagtactcatgtctcttccaacaaaacaatttatagattaaattcaatccttatcaaaagctctctggtattctttaaagaaaaaaaaaaactaaattcatatggacccacaaaaaaaaaaagcaacaaaccaagaaaactatatcagtatttaacaaaaggtgtactgctgagggattatctttcaacaatttaaacctagccatgtgaacaaacccagcatggttctgatgcagaactgaacaggtaaaccattggaacaaaatagaaaccataaatataattccacctaaccacaaccatctgaagtttcacaaagactccaaaaatatactctagacaaaagacatttccaagaaataatgctgagaaatatgtgactgtatacttgttaattcacttgggttaaagattttgggtataaggagaagaaaggtggagaaagaattttgatgtcaatattactataggtaattactaaaggtaagatgactcattagaattaatttggctactctgctttggacagccagtaaagaggcttctccctggggatggctacttcttctccagaccctttagtcctttatccagggttgagatcctatgaaactcccccccccccccattaaacttaccatatccactgacattgccattgactgtttcacagtacagttctggtattctggctcatgaattatttccactctcttccagatgttccttgaagtacgaatgcaatcattgtaatgtagatgtatctgttaggactgagttcccatgatttattgctcttcgcattgcatcagttgtatttctccgtgatggtctatatttgtggggggccttgataagagtatgagagagcatacaatgagcaaccaaaacaactgaagcttactggggtaagttggacaggagataagtaacatcaggctccttgagagtctggcatcacttcagttagtctgctatagcacatatgcatacatagtcacatgcacactgtcatagggtggatgatttcaacagactcttgcaaatttcagtctgagatctggtgagttctaaatgaagatggatgtccaggatctggtaggtcttcttgtgaagttgcagacagctcagttttccttgattctgaaatggcaggcaggaaagagtaaatcagtcttatcatctcccttctaacctgaatcctgatctcaaaaggatgacactgtcttcatggtttaactatctcaaagtggctctccttcaacataacagtgttagtatttgattagaaacatacatttattgagggacaccaataacaaatatataacactgacaagacaaataccattcttcttatacatgtctgaatcatacctttaaaatgtatataagcacagacactattgcacatgccagcaagattttgctgaaaggaccatgatatagctgtctcttgtgagggtatgccagtgcctggcaaatacagaagtggatgctcacagtcagctattggatggagcacagggcttccaatggaggagctagagaaagtacccaaggagctaaagggttctgcaaccctataggtggaacaacaatatgaattaaccagtacccccagagcttgtgtctctagcagcatatgtagcagaagatggcctagttggccatcattgggaagagaggccccatttgtcttgcaaactttatatgcccagtacaggggaacaccagggccaagagtgggagtgggtggttaggggagcaggtgggggggagggtatgggggactttcaggatagcatttgaaatgtaaataaagaaaatatttaataaaaaattggaaaaaagatgtatataaaatactgggcatagtggtgtgtgcctttaatctcagcactagagaggcagaggcaggagattctctgtgagtagcatgctagtcttgtatacatagagttcctgaacagttaggattacaaaaagagaccttaactcacaaccaaaccaaatcaaacaaaaacagaaaaccaccactaccacctcaacaacaaacaaaacaaacaaataagccaacaagcaaacaaaagaacaaaacaagataaaaatccaaccaagtcaaatactggtgtagtagttcaggtctgcaatattagcatttgggctaagataggagaaatgacatgaagctgaggctaccgtgagttctggagtgttaaaacaatttctttggaagacagcaatccattacttcatgactgtaaccacagagaaatgacatcctttctatgaagtcaaataacctcctcttccaattaatcatctcatcccattaatggcttccaagcgaagctttcaagcagcaggagctgcagatgtgaatgctttcattttatttcaactgaaacgaatccctcgcatcacttcagagctcactggtgaaaatgtaattatgctcttttgcccatgaatagcacctatacatcacagtagtatacatcactgagattttattttatgaattaaccatgaggcttatctttcatgattgagatactacttggaaaaaaagtgaaaaaaatagtgatatactgttctaagatatctatcgattgaaacaaaattgtccctcatttagctataaaaaaaaaaattctgaccaatttccagttaactgaaagatgaagatatagtgctttcttgtcgccacatgccacaccttctgaggtttgattcccagatttatgaaaccatttttttctattgaccttttaatcattctatttttcagctgccaactttttcatgagcatatatttcttaaataactgagaagcaaagaacaagtccactaattttgaaatattttcagaagatagtgatgattaattaagaggaatcctaccagtatgcttttgattttgtcattctttgatctcctccatacttttgggaagtcaccatgattcattgtcatttctgattgtttgaagttgatttcctaaaaatgacataaagatgactatgtttgaaaatgtcaattggaggttatctttataattggagaacaatggaaagagcctggttttattattcagatacataatcttttataaaattaggagataggacagctttgcatttaattagaagattagatagaaaaggatttataataagaggaaccagtagggagaagaaataaattcttgtgatatttggtgtagtagagtaactatggctgacagaagttgatgtcataattcactgaagtgtggaacatgtagaatgttctctgcacaggcacatgatgtatgtctgagatgacggctgtgacagttaccctgatcttagtattgtacactgaaaatacatcttcaggtgccacactgatattgctgatatatagagttgctatttatcaattaaaatatatataaaggaaaacattagaagaaaagggagtccttgagcttgggacccaaacagaaaaatcaaagataaggataagtagatctgaatgtttaagagcaggactgaaagcaaggttgggcattcagaagaaaaaaaaacctgctttccaggagatgttagaccctttaaaaatgggttgaattaagattggttgttctattataattaaaggaagtcaagtacaatcattttcactaagaaaattttatctctttcatagtgtaaatgtaatggcacagtcttcactattttaggaacatattttaatagccagggtagccatgatcctctaccactgacaccaataattgtgttttaaaaggtacaaatgaatctcaaatgaggatatataaataaaatgtctcattccaaatgttactttataattctttctgtggtgtgtggagaacagtatggcctcatggtattgcagagataaccacagttcactcgctgcaattattgtccccagtccaggagtatcctcagaagtattttcaccacaccaaggaaactgacttctaatctggacaaatggaattagattgttcgtgttctgtctctttggagcactgcaaccctgctatgaaagcaggtaactataactgcaagatctatcaggcacaaaagtttacttgaaaaaaaatcctagagttatgatagtaacttttcgcacttgagcccactttgattttagttgactttcaccattttctggttcagagagattggcctttatcctttttcccttagaacactagaattaaaaatatttatggtttgaagtaatgcattcacttctatggcaaaatgctgccaatgggtgtttttctcctctatttcagaagatgattacatgttcacaatttacaaggtattgtacacatttcagtggggaattgtaagcctttatcttttgacagcaagaaggaattgctgcccttttttaaatagcctccctattttgtccaaataaatgattcatgctggagacttcatgatgtcttttgttggtttctgtgaatttcaacacaagcagtcaaaagggaaagaagtaatgcatttctgaaattttcagcaaattataggttttatatggaaagaaagatgcattcaaatatctctcgttctggtctcgtcttccttctatgctttattaatgcaaagcctgaatcaaggaaaggaaaataaatgatagggtaggaaatggatattttcccttatttatttatttatttatttatttatttatttatttatttatttattttctgcagtgcatgctccaggtccagataattccttctttatacttacagcagcaacaaaaacagtaaggaatgtctggctatacttaaccacgattctcagaaaactctttgtttaataacatcacatttttgtgagtgtaatctatttctgacatttcttaaaagtataaagtttaaataatgatcaaagacgctttggagagccttctgtgtataattaaagaagtgcttgttgctttgagactataaatacttgaaaaaaatttgtgattgacatccaaatcttatcactttgtctaagggccctacaattgttaatgcttgaacaagtctaaagcagactaaatcccagagttaagggggaggtaggcacattgtcccacccttagatgtggagtgatagataactagctgttggaaagacaagggtcggttttctctgaaagcatagcacctgacagtagataaggctcccttggaaaaccacacatccatgaatactatgaacagcacaaggaatctttaaaggctcttaaaacataaacagagatcagtagataggaagtggagagtcttggaagagtttgaattaatggaaaatttcaaaatatgacttacaaaattctcaaagaattggtttttaaaatgtcaaaagtcatgtgatcaccttcaaactcttcttaacttgaagaagtaaaattcaaactttaaattctaggaatttctgaagcactgaaaaaatgaaaagccatgaaatttttattataataaatgatccaaaaacatacacagaataatattccactatgtcttagaatgcaagggaattggtaaggcttgtaaagccaaaaggaaagagaattgactgttaggagcaatcaaaataaaatgttagtaagatgtgctggaatcttctatggtcatgataatgctaacaaaggggccatctgcagaaagagttcagtacagtggtttgtttcttccagttattggtagcaagattccaatgtgaaatgcagagtcaggtccttgctttcctgtatgcacactctagttcctgaaactgtatccttgcgaagatctccttgtgttctactgtaaaattcagtctccatcaggcaatcatagatccctccttaattcttccagatctgtcacagagctacccctttggataaaaagtctagtgggtttgactaagtcttagaaagatgtgatattgaagcatttgtaaagtgggatgctgataatttcaggaatctgtgatttcttagacagagaacttaactgcctttctttatgtgctgactttaatacctcttccaccataggaccaatgccataagctctgctcttggcaaccattcaatgtcctttcatctcatggcaaacatctatgcctccctgccctgcttagaggcacaaatgtgaaacaagtgcatgtatgtgtttgtgtatgtgtgtgtgtgtgtgtgtgtgtgtgtgtgtgtgtgtgtttgtcctgcaggaagtattgaaaattgcttcattgatattcactccaaatatgaaacatatggcaggagatttttctaattgaacattgttctttaacatcaatcaaactaatatgaaaatatttatagtgtagaggtgatgcatgatgatattatataaatatatgtatttatcatgttatccagaaagaatttgcttgtaggattattccttttcattctcataaagataattcctccattaaaatttaattttcttcactttttgaggatattattgcagttatttggatgctgtttgaactcttgaaagattttacagttttaaaatttgatataaactatatgatttaaaaatatgttattattggtttaacaaaatgttctttaaagtgatccatcgtgatgtaattcacttgtattccctgtacccctgtactgttctatggtattttccctacttgttactacagattgtactcagaaacattcttttcaaggtcaccgagggaagtcacacaggaagacttctctagggcaagtggttagcattgcaaaaaataagattatagagaagagagtgaaatcggcaatgttttttatgtaattctaaaattttggaacagaagtgagattatttgttagtctgaatcacatttaaatcattgccttcctacatactttcaattttatttaaagcttaagatagtgacaaggtgtcacatatacacgaatgatcaattgtcttagtaacttttattgaagttttcaactttccccattaaaaattccaaagataataaatcatgttccctcccacacttttctctttttagtgttaatattctcttccacggctcaaattttatatcattttattgatacaacaactccttactcataattgtattgtagtaatgatcttagtcctctaagttttttacccaattttggcagtgttcagtaattttagagtaactgacctacaaagctttgaaggtcaacctgacaaactacatatggtgaaacatcagcaaagattatacatagtgcagaatgtgtatgcttataagcagtgaaaatgataaggttacaaaacaaattgttccattggacatgaagtatctctatcaatctcttcccatccccgtttcaagaagcgcctctgaaggaggaggaaggaatgcatgagctggcccatggggtagaaagctacagaatgctgacttgtgggcagagcactacagcttcacaagcttacagcagctgcagttacttgtgcacgatctccacaagccagtcaaaagtccagcacgaactgcatgtagaatggtccctaaggtcccacctgtgactgagatgttggcagttcacatcttctgagggaaacaacaccgatttccttttatagatatggcctctggtaggttatacttatacctatgagaatgggtctatacccataaacatgtgacaacacaataggcctcaagtggttattaataacaatgaaaaaagaaaacatgaagttgagagggaggcaggttagggaaactttctgaagtaagagcaaataagtaatgcataaatatgatcaaaatgtatttcataaatgcataaaagtagaaacaaatatattattttaagagtagatatcattaactttatttgtataactaataatttcaaattcatttatactaatgaaacatgttttgttttttgttttgttttgttttgttttgttttgttttatttttgtttttggttttggttttggtttttgttttttagtttttgattttttgagacaggcttttttctgtatagcgctggctgtcctggaacccactttgtagaccaggttggcctcgaactcagaaatccacctggctatgtctcccaagtgttgggattaaaggtttgtgccaccacgcctgactgaaacatagctttaacttgcgttcccccaaggcttccaattgtattggggttactgaaattctcgacaattcaggctgttgtcaggatagttaagatgtgctttatatacatgtataaaatataaatacacacattcgtatgtataagaatcagggttaaatttttcttttatgacattatcaaataaaaaataataaatgtttattgaaggaatgtgttcttaagtagacaattctaatcaatcattaaaattcaaccagttgtttgaaatgtgagcagatgaaacgagaatgtctttgcatgctaatgtacttcttttgcacattctatgagctatttgttttcttggaagtatatgggatcagaagtcatatataatgtctttcaatgtgtgtaaaatgagtaatagatctggcacaagatgagctatgtattgggatatatgtggtccagaggaaaggttcactaattgggaagatagacacctgagtgttcattcctgtatcttggggatgggaaaagtagagtaatcctggctgctggcacccaagttctgcctcccaaggacctttacatagaatgttatgactttcttcccaatgagctatttgtcttcttttgaattaatccaagaaacaccaagatgaaagcatcaacacgttgtatgtatgactcttgaattaatactgtggttgcttctaaaatgtggacagctttatttatttatttgttgttgttgttacatcttcagtcttcaaattatatttagtcaccctgaaatgtattcactttgtttttttggattattattattattattattattattattattattattattgttattattgttattattttacttacattccagtcattatccccctaatcttccccaaagttccttatcccattcatccatccacctggcctagaaaagggtgttccttcccctgcccaacaggcctcccctttccctgaagcctcaagtgcctccaggaataaatgtatctgctcccactgaggcctgaccaggtagatctcatctatatttgttctaggggcctctgacccacctggttggtatactcctggttggtacctcagtctgtggaagctccctgtggtctgagttagttgagactgctggtcttcctatgggctcatcctcccattcagcttcttcaatctttccgttaattcaaccatcatgatgcccggcaccagtccaatgatgaggtgtcggtatttgcttctgtctcagtcagctgctggtagggtcactcagaggacagccatgataggctcccacctgtaagcacatcatagcatcagtaatagtttcaagccttggattctccccaacacaacatcatcagaaatcaattccaagttggaccagtcactgaaccacctttcattcagtatcttctccgttttttgttgttgttgttgattttgttgttgttgttcctgaaagtcttctagacagaaacagttctgggtcaggtattttgactgtggattaggaatatggtccttctgcttgagtcactgtctatctactggaggtggactcttcaagttccagctctccactgttgggcattttggctaaggtcatcctcattgagtccttagactctctcaccttccatatctctggtactttccagagggtccaaacactttccaacctgccagtgttgcttatctccattcattctcttggcttctgggcttatttctcactttccactccaatatctgatcctgttcctcttttacactcccacacaggtccctccctcactctgcctcccttaattatttccatcccctcttgtaagtggaattgaagcatccacacttggcccttttttattgttacacttcttatggtctctgtgttgtaactattctgtactttttgaataatatccactaatcagtgactacataccatgcatgtctgttggtgacctagttacctcactaagtgtgatattttctagttccatctatttgcctgcaaaactcatgatgtactatattttaatagccattatgtaaattaaccacactttctgtatccattctttgattgaggaacatctgttttttttttttttccagcttcttgttattacaaataaggaccatgtgaacatagtgggccatgtgtctttgtggtatcattggacttctttttggtatatgcccaagagtggtatagctgggtctttaggtagaaccattttcaactttctgaggagcctacatattgatttccagagtagttgaccagtttgcaacctcactatccatggaggagtgattgttcctctttctccacatccgcaccagcatgtgttgtgacttgacttttttttttatcttagacattgtgattggagtaagatggaatctcagggtccttttgatttgcatttctctgataactaaggacattgaatatttctttaagagcttcttgaccattcaaggttcttctgttttgaattccccttttagctctgtaccctatttttaattgggttacttggatttttggaggttaacttcttgcgtcctttatatgttttggatgtaagccctatgtcaaatgtagggttactggagatttttttccaatctgtagattaatgacttgtcctattgacatgactttccccttacagaagctttttagtttcatgaaatgtcatttatcatttgtttatcttagagtcagagccattggagttctgttcaggagattttcctctttgccagtgttcaaggctctttcccattttctgttctattaaattcaatgcatttagttttatgttgaggtccttgatctacttggacttgagctttgtgcagtgtgataaacatggatctattttcattcttttgcatactgactgccagttagacccatacaatttattaaagatgttttcttttttcccccaatgtatgtttttggcttttttttcaaagatctattgtccataagtgtataggtttacttctgaatatttgattccatttcattgattgacctgtctttttctgtatcgatatcatgcaggctttatcactattattttgtagtatagcttaatgccagagatggtgattcccccagaagtttttttttattgttgggaattgttttggctaacctgggcattttgtttttccagatgaatttgagaatttctctttccatgtctttgaagaattttgttagaattttgatgggaaatgcattgaatctatagattgctttaggtaaaatggccatttttcactatgttaatcctactaatccatgagcatgggtgatcttttcatgttctaatgtctccttagatttctttttcagagatttgaagttattgtcatatagatctttcacttgcttagaattgcaccaagatattttatactatttatgactattgtgagtggtattgtttccataatttctttttcagcctatttataatttgtgtaaagaaagactactgattttttgagttaattttatatcctgccacctagctgaagttgattttcagctgcagtacttctttggtggaatgttgagaggtgctaatgtctactatcatatcatctgaaaatagtgatattttgagttcttcctttccaatatggatcctgttggtccctgtttggtgtctagttgctctatctagaactttgagtaatatgttgagtagatttggagagagtggttaaccttgtcttgtcctggattttagtgggatcacttctagtttccctccatttaatttgatgttggctgctggctttctatataatcatttattgcatttaggtatgtagcatgaattcctgctctgtctaagacttcaaacatgcaggggttttgtattttgccaaaaagatttttcaccatgtaatgatatgataatgtggcatttttccttgaatttgttcatacaatgcacaattttgatggatttttgtatattgaacatccctgaatccctgggatgaggcttacttgatcatggtgaatgatggttttgatgtgttcttggatttgctttgtgagaaatatattgagtatctttgcagatagtcaatagcgagattgttctgaagaccttgtctttctttgttgggtctttgtgtggttttggtatcagcccaactgtagctttatagaatagaatagggagtgttccttctgttttagttcatggaatagtttaaggaatattggtattaggtcttctttgaaggtctgatagaattctgcactaaaaaccatctggtccttggctgtttttgttaggaaattttggatgactttttctatttccttagaggttatgagaatggttagatagtttacctgatcttgatttaacttcagtatgtagtatttgtctataaaatcatccatttcatttatattttccagttttttagagtatagactttgaagtagtttctgattgatttttttaaaaatttcctcagtttctgttgttatgtttccctttcctttctgagtttgttaatttgatattttctctatgccaatagttagtttggctaaaggttcatctattgtgttgattgtctcaaagaaccagctcttgttttgttcattctttgtatagttcttttttaatctaactggttgatttcattcctgagtttgactatttcctctttggtgtgttttcctcattctgttctagacttttcaggtgtgctattaagttgctagtataggatccctctactttctttatgaagatacccattgctattaattttcctcttagcactgctttcattgtttcccatatggttgggtatcatgcatcttcattttcattgaactctataaagtccttgatttctttctttatttcttccctgaccaagttaacattgagtagggagttgtttagtttccatgcatatgtggtatttctattgtatttgttgttattgaagtctagccatggttatctaatagaatgcatgggattatttcaatcttcttgtatctgttgaggcttggtttatattcaattatatggtcaattttggataagtttccatgaggtgctgagaaaaaaagtacattttcctgttttggagtgaaatattctgcacatatctgttaaattcatttggttcataacttctgttagttttactatggctccattgagtttctgtttcaatgacctgcccaatggtgagagtggacagttgaagtctcctaatattattggttgaggtccaatgtatgttttgagctttagtaaagtttcttttacaaatgtgggtgctctttcacttagggcatagaattgaaacttgcatgctcagaattgagacttcttcttggtagatttttcctttggtgaatataaaagacagctcttttctgtaggaaaattgatataaaaatatggcaatgaatgagaaagaaagttattgacagtctgttttctctagtctttttcttggcttgaaaattgaatttcagtaacttcatagttttacaaactagaaactttcatattaaaatatatacatgttatattttatatatatatatataatattttatattaatatatatatataacatgtatgtgtgtatatcttaataaggaggaaggaaaacatctcacacatatttgcaaatgtctcattaaaaatgtcattttaatactgtctctatcttcacatgttctaaaaagtattgatattcttaagtcataatattcaggcaacatcataaaatttattaagcatcatcgtgtcagagatgggtttgtaacttgggtacaaaagtcttcaaaatacctgttctttccagggaaacatttcatgatacctttgtgaaagagtatgttagcatctgtagatagaacagggttatatgtcaggaccaatgattctagcattcattcttgctttctttctcaatattttgaataaacggcagtataaatttatgtggttaagagtacagtcctttcattaaaattatcagagcaaataatttagatagtatactaaatagcaaagaatccattgaaatggatatgtgagaatataatgcttttttgtttatataattcatctagctttgtggattatggtgccactgaatatctctgttaaacatgagaccatgagacacagtaattttatcatcttcttccatcattttgttgttgttctctccttctcctcctcctcctcctcctcctcctcctcctcctcctcctcctcctcctcctcctccacctcctcctcctcatcatcatcatccttttcataaataaatctaggtacagaagctcaggtcaaatcgtattttataataacttcaatgtatccatttttagcatctagctctttaaaatagtctttcatttgagattgagtactctggatggtaatggccatatgtcttggaaaaaggctgaacaattcagcacctggtgctatgttattcttagtttaatatcattattagtgaaagtaaaagatccttaagattctatttcaagttttccagtttttttttttttcatttgccctcttgggacaaagatatattgatgaactatgacatatacccataaaagagcattgccaaaaagccctagaacaaattaatttatataagattctttatctcttaagtaatcatttctagtatatattgttgagtgattgaaaataataaaagtattcccaatgtgctaataatatatgcaaatatatttttgactggtccttttcaagcatcatatatatgcttatgtacttataaatagtggtatatggatatccaacattgtgtgatatgataattacaatatgtatttgaaaataaatatataaaatatcctatatcttgggtatctaaatatggaatatattttgcttttttatttttacctataataattatttacattttgtggttaaatatacacatagcctcatggtgaacttaaatttacaagttaatgaatttacagctaggtagagagacatgtatttgtaattccagcattcagcagatggaatgattgtggaatgagggttagcctttggtacatactggaaaaatatgctggttacattacatattagggatatagtaactataaagttttctacataaaaacaaaacaaaacaaaagaaatcatttgaaacaaaataaatacatattataccctacaacttaatgtatgtacctgaagaaatattagccagggtttgaaatataagacctttccaaaaatgtctattaagtaacacaagacaagggtataacatttgtcctggatgtcatgagcaaactttaattaagtcactaacttaatcaatcttcccaaaaaacatataagtagttgcaagtggccacaattaattcttctctgttgttctcttgaattagtagatgtggttatttctatatgttcaccacattattttacaaagaaatctgaactatagttttagggtttttaacttttattgcaaatgttaatgtaacattaaaattcagcactatgttcccaggagcaggaaaatgcaaagggcatggttttcctaatgtgattaatttgttattgtgtcttaggcttctcattaggacacacatttaagtttctaacctataaattaaaaaaaaaaaaactaagcttggaaattctttcatgttttttctcaaaggactgaaaactcaggagtttattttttttctattttataaatcaatgtgtcgttttctttcttaaatctacaaacaggttatattctattactattcagagatcaccttggtcttttggcatatgtttgtgtatgccgtgttgcatgtgtaggaggcaaaggacaatctagggtggctgtaatcaacatctaccttttctcattattgtttccccccatctgtgctacatatgccaagcaatctggtccctgagctccttgggttctcttatctctgtattcccatctcatggctagagtactggatggcaggtgtatagtactggcctggactttatgtggtttatgtggatttgaaattaagtcttcacactccgttggcatgcacttaatgtctaaactgtaacttcaaacttgtgtgcatggaagtgcacataaatacctgccctgattctttttcaagtaatgtctgcataaatgtattcagtgttattctgaacgatacaccaaattacaaattagtccagaagaaaaataaatcaagaagaatctcactatagtgttgttaagataattaaatactaacttgtatttcctatgcataaaaaggggagaatagtaatgagacaaggtagatgctgcttaagaaaactcttgattgtcctttgtctcctacatatacaacatagcatatacaaacatatgccaaaagaccaaggtgatctctgagtagtaatggaatatacctgtttgtagatttatttatcagactttcacaaactatttatataaaatattttctatcattatcaatatattttatttattagatgttgtctttatttacattttaaatgttatcccctttcctagttttctctccaaaaatcccccataccctttcccctccctctgctccccaacccacacatttccaattcctggccctggcattcccctaaactggggtctagaatcttctcaagaccaagggcttcttctcccacaaatggtcaactaggacatcctctgctacatatgcaactagagacatgagctctgggggtattggttagttcatattgttgtttctcctataggaatgcagacccttcagctccttgggtactttctctagctccttcttcaggtaccctgtgttccatccaacagatgactatgaacgtccacttctgtatttgccaggcactcgcatagtctcacaggatacagctatatcagggtcctgtcagcaaaatattattggtatatgcaatactgtctgggtttggtgattgtatatgggatggatccccgggtggggcagtctctggatggtccttccttcagtctcagctttgaactttgtctgtgttactccttccatgggtattttgttcccccttctaagaaggaatgaaatatccacactttgatcttccttcttgagtttcatgtgttttgcaaattatatttgggtattctaagtttctgggctaatatccacttatccttcttcatccgggactccgcagaacttaggaaattagtctgcacaggtgagagtctgcaccacagaagctgacagcttctgagacctgccaaagcaacacagcttctgagaaaggtcctgttttgggccttcttcttcttcggccaggaggaggtccaaacacaagatatctgcacacctaccctgtaagagagcttgccagcagagagtgctctgagcactaaaactcagaggagagaatctgtctcccaggtctgctgacagatggtaacagaatcaccagaagaacaatctctaaacaatgtcaactataactactaactccagagattaccagatggcgaaaggtaaacataggaatcttactaacaggaaccaagaccactcaccatcatcagaacacagcactcccacttcgcccagtccagggcatcctaacacacctgaaaaggtagacctggatttaaaagcatttctcatgatgatggtagaggacataaagaaggaatttaataactcacttaaagaaatacaggagaacactgctaaagagttacaagtccttaaagaaaaacaggaaaacacaaccaaacaggtagaagtccttatagaaaaacaggaaaaaacatacaaacaggtgatggaaatgaacaaaaccatactagacctaaaaagggaagtagacacaataaacaaaactcaaagtgaggcaacactggagatagcaaccctaggaaagaaatctggaaccatagatttgagcatcagcaacagaatacaagagatggaagagagaatctcaggtgcagaagattccatagaatctgtgctggttctttgagaaaatcaacaagatagacaaacaattagccagactcactagagggcacagggaaagcattctaattaacaaaatcagaaatgaaaagggaggcataacaacagatcccgaagaaatccaaaacaccatcagatccttctacaaaaggctatactcaacaaaactggagaacctggatgaaatggagaagtttctagacagataccaggtaccaaagttgaatcaagatcaggttaatggtctaaacagtccgatatcccccaatgaaatagaagcagtcattaatagtctcccaaccaaaaaaagcccaggaccagatgggtttagtgcagagttctatcagaccttcaaagaagatctaatcccagttcttcacaaactattccacaaaatggaaacagaaggtactctacccaactcattctatgaagccacaattactctgatacctaaaccacaaaaagaacccacaaagatagagaacttcagaccaatatcccttatgaatattgatgcaaaaatcctcaataaagttcttggtaaccgaatccaagaacacatcaaaacaatcatccatcctgaccaagtaggtttcatcccagggatgcagggatggttcaatatatggaaatccatcaacataatccagtatataaacaaactcaaagacaaaaaccacatgatcatcttgttagatgccaagaaagcatttgacaaaatccaacacccattcatgataaaagtcttggaaagatcaggaattcaaggcccatacctaaacatgataaaagcaatctacagcaaaccagtagccagcatcaaattaaatggtgagaagcttaaagcaatcccactaaaatcagggactagacaaggcttttcactctctccctacctattcaacattgtacttgaagtcctagccagagcaattcgacaactaaaggagatcaaggggatacaaattggaaaggaagaagtcaaatcactttttgcagatgatatgatagtatatataagtgaccctaaaaattccaccagagaactcctaagcctgataaacagcttcagtgaagtagctggatataaaattaactcaaacaagtcaatggcctttctctacacaaaggacaaacaggctgagaaagaaattagggaaacaacacccttctcaatagccacaaataatataaaatacctaggcgtgactctaactaaggaagtgaaagatctctatgacaagaacttcaagtctctgaagaaagaaattaaagaagatctaagaagatggaaagatctcccatgctcatggatcggcagggtcaatatagtaaaaatggctatcttgccaaaagcattctacagattcaatgcaatccccatcaaaattccaactcaattattcaacgaaatagaaagggcaatcagcagattcatctggaataacaaaaaacctaggatagcaaaaactcttctcaagggtaaaagaacctctggtggaatcaccatgcccaaactaaagatgtactacagagcaattgtgataaaaactgcatggtactggtatagtgacagacaagctgaccaatggaacagaattgaagacccagagatgaacccacacacctatggtcacttgatctttgacaagggagctaaaaccatccagtggaaaaaagacagcattttcaacaaatggtgctggcacaactggctgttatcatgtagaagatttcaaattgatccagtagtatctccttgtactaaggtcaaatctaagtggattaaggatctccacataaaaccagagacactgaaacttatagaggagaaagtagggaaaagcctcgaagatatgggtacaggggaaaaattccggaatagaacagcaatggcttgtgctgtaagatcgagaatcgataaatgggacctcataaaattgcaaagcttctgcaaggcaaaagacaccgtaaataagacaaaaaaaaaaaaaaaaaaaaaacacacaccaacagattgggaaaggatctttacctatcccaaatcggaaaggggactaatatccaataaatataaagaactcaagaaggtggacttcagaaaatcaaataaccccattaaaaaatggggctcagaactgaacaaagatttctcacccgaggaataccgaatggcagagaagcacctgaaaaatgttcaacatctttaatcatcagggaaatgcaaatcaaaacaaccctgagattccacctcacaccagtcagaatggctaagatgaaaaattcaggtgacagcagatggtcgcgaggatgtggagaaagaggaacactcctccattgttggtgggattgcaagcttgtacaaccactctggaaatcagtctggtggttcctcagaaaattggacatagtactaccggaagatccagcaataccacttctgggcatatatccagaagatgcccaaaccgataagaaggacacatgctccactatgttcatagcagccttatttataatagccagaagctggaaagaacccagatgcccctcaacagaggaatggatacaaaaaatgtggtgcatttacacaatggagtactactcagccattaaaaagaatgaatttatgaaattcctaggcaaatggatggacctggagggcatcatcctgagtgaggtaacccaatcacaaaggaactctcacaatatgcactcactgataagtggatattagcccagaaacttaggatacccaagatataagatataatttgctaaaaacatttaactcaagagaatgaagaccaaagtgtggacactttgtcccttcttagaataggaaacaagacacccatggaagaagttacagagacaaaatttggaagtgtgatgaaaggatggaccatctactgattgccatatccagggatccatcccgtgatcagcttccaaacgctgacaccattgcatacactagcaagattttattgaaaggacccagatatagctgtctgttgtgagactatgccaggccctagcaaacacagaagtggatgctcacagtcagctattgaatggaccacagggcccccaatggaggaactagagaaagcacccaaggaactaaagggaactgcaaccctataggtggagcaacaatatgaactaagcagtaccccggagctcttgtctctagctgcatatgtatctaaagatggcctagtcggccatcactgcaaagagaggcccattggacttgcaaactttatatgccctagtacaggggaatgccagggccaaaaagggggagtgggtggataggggagttggggggggggtatggggacttttggtatagcattggaaatgtaaatgagctaaatacctaataaaaatggaaaaaaaaaagaaaatagaaaggtaggaagcttaggggaaatgagagatggagaaagagagaaagtctgattgaggaaggaagagaaaaataattttgcagtttccttcttcttagatgtgaaaatacaatcacttagtttttaaatatcatgtgtgtgtgtgtgtaatcactagtggttcattctttttattaagctgatagcaattaggaaacaaatatttaacatatttgaataagtggaatatgtcaataaacaagaataattgggaaccttatgtactgtttattaatgtagtaattgctgctcaaattagactcctccacattgaagaaacattcattctaagtcataatgatgaagggaggacttgcttataccttgcctgattgttaaatagtaactcaccctaaatcacgtgatttgtttcttaattagttaaattctatgattttctaagcctcttcccaagaagcaaagattgtaaagctcacaatattcaatgaaagacttagattcttttccttcttctactcgcttttttcttctctatttacctgaatgttacatcttcttaccaaagttattttcttagattatcttatttctgtatgagtattttcttttattaattttatgtactatatttgaaaagaaagaagaagatgacagaaaagtaatagatgaaaatattttatcatttaatttcttacaagaattctagatcataaaatatttgaacacaacaattctggacatatactacttcattatttattattcattttgctttgctttatgactaacattaaactgggtatgagtctttctaacttgatcagtgccttgaacccattcacccttttctctgagaaattgcaatgtgatcagacatattttaaaatgtctttagtcactgtcaacatccttgattctcatttcttgagttgtgaaaacacaaatgtcaccaagcattgacaattacataattatagttattgataaaccatgaattggactcttctttttctgatttttatactttaaaaatcaatccatactttaaccagatgggtctgtaagattattgaatcttagtgttgataacactaacacaagaaatgactagaatatgttgttcccaatctcttactattttaaaatgaagtgggtttttttttgtttgttttttgttttttgtttttttttgttttgttttgttttgttttttggttataggttacttagtttgatttgatttgatgagacagagtttctctgtgtatcccttactcttttagaactcactctgtagaccagactggcctcaaactcagaaatctacctatgtaccaccactgacaagcttaaaataaaggttttaaaaatccttccttagagattcaagggtatgtcccaaagatgataagctcaatgcctactactttttatagaaatcctatcagtggaaacaccaatagacttatacagagacagagctcaacctaggagagatctacagtaaacatgcagaatagtaagtagcattgcaggagtccttgaaggcattaactgcatgaaccaattgaaggaaattgtcattaaaagagagcagcatccagaagtccaactacagaaaagttcagagttagaagacatgaacagcaccatatttaggattctataggataaaaactacagtatcagtgttcacatatattaatttataacctccctgtgagcacatggtctctgttctataaattatatccctattcaagtatctctgtatgcattcccctatctctttcattgcatcttttagaaaatggtaaaatacatgaagtcttgaccccagcttcctttttcagatcctaacaatagtaccagctggctttgctgccttgaatggattacccaatcatttattttcaggttcttgcactactgaatagagattaaataagagacacaagtgaaatgccaatcttctactgagagtaaatatttttactctcatattttattttgcttctgtttaatacttttatttgtggtggtgagggcttggatgcttaaaaaccccacttactcgattaaaaattatttccaaaataagcacaataataaaaatatctaaatacaatgaaagcagatagtaaatacaataattggactacataattacatagtgaccaatctacatgttaaatgtatgggctgtcaattggggtctatcaggtggaattaagactttagaacatgagttcaagaaatacaaaatatttttgttgttgttgggctacagtactaaggagtggggcatcgaaacaactactgacaaatggtatgtttacatcgtgggctggacggggaaagaatggtgtttgtgaaggacaatcaccaacttctacacatttaagttatttgctactgaaagaccaaattcacacaagccacagttttgccgaatgaaagcagtgttcacaaaatataggtgtgctaccaaatagagaaaatttttataattcaaaaataaagagcagcaaaaatcacagcaagagaaaacaattttctagtttcttcttttctcctctaagaattttttatgtagcctcaacttattcccttttacttttttttatgtgcatgtgtgtttattgttgtattagataatgtatattcctggaaatgaacatgtaaatgatacttttataagtccaattctactgtagagacatatggacatgtaaagagtttaataattagagaaatttcatattgttgaaaaaaacctcactcgttctttttaattttgtattttctttcttattagatattttctttatttacatttcagatgctatcccgaaagttccctgtaccctcccctcgccctgctccactacccacccacttttagttttcatgtctttcaattttaactttgaaatttagactcaccatatgtttgaaaccatgttattttgctatggtttatttcacttaatgagacctcgagtttctatacacttttctttagaaaggagcattattctgttctttgtggctgaatgaaactcaaaagggtatacatgtgacattgtctttatccattcatctgttgatggacacataggctgatttcatgccttggatattatgaacaatactatgatgaatattaatgaacaagtatcttcatggtacctgatttgagagtgtcttgagcataccagaattgacacaactggatcctagtttaattttagatatttttgagaaacttcacaattatttccacagtggctctactaggcattttttttcttctccaaattaacagtgtgtgaggtttctatttctatctaaattcttagtattatttgttcgtgcattacttcatggttggccatctgccctcttacaaaagagaatatcagtgtagctttactttgcatttctcggatggctaagattattaagtattcttttctcactaagtattttgatagttattggatcaattcatttgctcatttagtacctgaatgatattggtaatttgattttcaaatttttgaaattttctttattattattaattattattatattttttatttacaatactaccattgccccttcaaggtctcccctcccatagttcctcatcctattcttcctccccactgcctccctccttggaacctcaagtctctcattgcatcttctaccacagaggccataccaggcagtcctctgttatatatagagttctggggcagctgcttgtgttatgctgcctggttggtggctcattgtctgggaggtccctggatccacttcttccatccatcccctaattcaaatacagggtttcctgacctcagtccagtgattgggtgtaagtatctgcgtctgtcatatactgtagataacaatccagttgttgatggacacataggatgatttcatgctttggatattacaaaagtacaatgatgaacattaatgaacaaatgtcatcatgatgccctgatttgggagtcagcaacaataagtggacaacaagggtttacctaatctgttggctgtgtctctggtggtagtttgctttgatgggcagaagcttctgatataactgcctactcatgtcctgcttccattttttatttatttatttatttatttatttatttatttatttatttatttatttaggtttttcaagacagggtttctctgcatagtcctgggtgtcctggaactcactttgtagaccagagtggtcttgaactcaaaaatctgcctgcctctgcctccagagcgctgggattaaaggcatgtgccaccatgcccggcttgtcttgcttccattcttgatcagtcacagaagttctgtgcttatgcttacaacttgagtgacttccactcattttcttttagtactgtcaaattttcaagacttccattgtcatttttgctctgctttcagcttattttagttcagtgtgagatagagagttctagtgctctagttctacatgtggattttctcctgttttctagcactgccagtttttgaagagaatatttttcttacattatcttttcgagtttagtaaactatcatgtggctgtagctaggtgattttatttctggccttgtattatattccgttaatctgtatttctgactgtgatgttgccaaactcttttatttattatttctatagcaaagcagtataattggatagaaagcatcgtgacacctccaatattgtttttgctcctatttggagtatattatgctctatatgacctttagcatcactgaaaactttataggagttatcatgaagctatggatcattttggtcatagacctatattaacaaagttatgaatgcttggcaatgatcatggggcatctctctattttctaatgccttctacagtttctctgtaacataaaattttgtattgtgagatatgttttcagactgttcatactgatataacgaatttcatctgtttccttttacaacattctattttatttgtacatattgtattcttcaggtctttcctcattttattatgtaatgatttataatcttttatctttccaaagaactagttatttggttattaattcccagtgaaacaatcttactctcattgacttctatctttgcatttattatatttctacttgttggctttgaacatgatttttcttgttgtcataagtttacacatgcatactttggttctttatttgatttatttctgacatttaatgaaagcacttgagacttaaaattgcatttgttagaccacaaaggatcgaaaagttttcatattaatataaattccatctctttttaaaaaaattactctcttatttaagattataatataattacattatttctccttccttttcacaccttccctatattctttcttgctttttaaaaataaatgcccccattccaaaaattaatgtttaattctactctttatttgtttcgtgccccactgaacaatcaagagcatgttttccattcaatatgtgattgtgttttatattttttattgctcctgacttctagctacatttgattatgacttattttttttaattttttttccattttttattaggtatttagctcatttacatttccaatgctataccaaaagtcccccatatccacccacccccactcccccgcccacccactccccctttttggccctggtgttcccctgtactggggcatataaagtttgcaagtccaatgggcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttgatttcggttagcgagaattttattgaggatttttgcatcgttattcataagagaaattggtttgaagttctctatctttgttggatctttctgtggtttaggtaccagagtaatagtggcttcataaaatgagttgggtagagtaccttctacttctattttgtgaaatagtttgtgcagaaccggaattagatcttctttgaaggtctgatagaactctgcactaaacccatctggtcctgggctttttttgtttgggagactattaataactgcttctatttctttaggtgatatgggactgtttagatgatcaacttgatcctgattcaactttggtacctggtatctgtccagaaatttgtccattttgtccaggttgtccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgtgtgaatttgcttcctttttttctagggcttttggatgtgttgtcaagctgctagtatgtgctctctcccgtttcttcttggaggcactcagagctatgagtttccctcttagaaatgctttcattgtgtcccataggtttgggtacgttgtggcttcattttcattaaactctaaaaagtctttaatttctttatttattccttccatgaccaaggtatcattgaggagagtgttattcagtttccacgtgaatgttcgctttccattatttatgttgttattgaaggtcagttttaggccatggtggtctgataggatacatgggacaatttcaatatttttgtatctattgaggcctgttttgttaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtccattgaagaaagtggtgtgttgaagtctactactattattgtgtgaggtgcaacgtgtgctttgagctttactaaagtgtctttaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattcttttccagcctttcactctgaggtagtnnnnnnnnnnnnnnnnnnnntgtttttgtcgtggaaatactttggtttctccatctatggtaattgagagtttggccgggtaaagtagcctgggctggcatttgtgttctcttagtgtctgtataacatctgtccaggctcttctggctttcatagtctctggtgaaaagtctggtgtaattctgataggccttcctttatatgttacttgacctttctccattactgcttttaatattctatctttatttagtgcatttgttgttctgattattatgtgtcgggaggaatttcttttctggtccaatctatttggagttctgtaggcttcttgtatgatcatgggcatctctatttttatgtttgggaagttttcttgtattattttgttgaagatattagctgtggacagccgacagtgctggggaagagggtggtgaggctccggaggagccccagagctgaagcagccgacaaccaccccggctcgccttgccctccagtccccagcctgcagagaggactaaaacggagtgggactctgcccttcccaaaccctgaatgttcagccacaccttggaaggctccttcgaagggggcgcagccaagctgaagccaccagagcagggaatctcactctttcgtgtagctgtctggtgggtgttcccaacccatcccacccctgctctctgcaccccctccccacttcctccccctgagcctccctcgggcacctgtcggctgtccacaacctgaggctctggacagccgacagtgctggggaagagggtggtgaggctccggaggagccccagagctgaagcagccgacaaccagtgactctgttagcctctataagcagacctggagggtagcactctccttagtttcagtgggcagagtattctctgcaggcaagatctcttcttgcagggcaggtacccagatatctggtgttcgaaccagactcctggcagaagttgtgttccactcactagaggtcttaggatctcgtgtggaatcctgtgtgggcccttgcgggtgtcaggcgactccgctggcaaagtagcccggggctcgagtggagcggaaggggtttgtgccccagatcaagcccgggtagcctgcttccctatgtaccgcagtctcaggttccgtgcgattggattggggcaggtgctgtgttccactcaccagaggtcttaggatcccgtgggcagtcccgtgtgggcccttgcgggtgttgggcaagactctgctggcaaggtagcccagggctcaagtcgagcggaagttacttgtgccccagatcaggcccgggtagcctgcttccctatgtacctcagtctcaggttctgcgcgattggattggggcaggcgctgtgttccactcaccagaggtcttaggatcccgtggggaatcctgtgtgggcccttgcgggtgttgggcgagactctgctggcaaggaagcccggggctcctgattatgacttattgataataacaacatataacataaattttctatctgttaaaacattccttctgtttcaacaactaatcctttttcactaataatcaagtacaaattcaaaaaaactatttaatttctaccaaatgaactatattgcattgatattgctgtacccaaatggctaactttttcttgttgatacaatcaaatatatcaaatatacatgcaactatttttaaaatataatttgtataatgtatattgtacttgtataatgtaaaatgtatatttagaaagaaaaaatacattttaaatctttatatctaaatatgtaaagcaatatctattttacaattcatgctgatatttttattatgttacgttggaacatatatatatatatatatatatatatatatatatatatgcatgtatatatatatgtatgtatgtatgtatatatatatgctgtgtatatatgtgtgtgtgtgtgtgtgtgtgtgtgtgtgtgtgtgtgtgtatacacacaactttattttctactgttttggatatgctacccaatagaaaattaaaatataatataaaatgtgagttataaggctggtgagattgctcagtagattaagtatcttctgagcctgctgatgggcttttgatgctcatgactcacatagtaggagaggattcactcacaaggactgtcttttgatttcctcacacagctgtcacatgcatgtcttcactctacactaattgaataaatgggaaagtaattagatgcctctgtctaataataaaaagtcattaatttaaatataattctattaatttaaagataaattacccattaatttaataaagtaaccacattagaaatataattctgttctttgctttttggtttttcaccccacttgcagttttgtcttcatatatttatctataccttaccgacaataatttcatattttcaggatagtgaaagtgaaaagaataaaatcataacatcctttaaacatagaaagaagtacctgtgatacaaagtaagcaaaatgcatcatgtacactatatgataacacacacaactttgcagtcacacaaatacagactcccagtggtccaggacaaacagaattaaaatttgttttccctgtgttcctaaggcacactgttctttattgcatatttttcatgctgctaaacattaacatttattgagaaaaattttaaaataaagtagtgcatctttgagtctcatttgagcttttctttcacacggtgtgtcacattaatgctaccctacagggaaataatcaaagaactttaatgtaatactgtgcttcagaaaggaaacatgacagcagtacattactgcaaattgaatttaatgagcttcttagcactaggaaagtgactctttgaaactgaagctattcaatcgagagcattttgattataattaaatcattttacatttaccacagggacaagtttaatcttaattagacacttttatgggaaggtgaagccacatgatttatattttcttgatcacataaggagagattcataatgtaaagaataaaaaacaatatggttgtccttttaagagaaaatgaatgtacacattctcatggtggcttcctaggaagagcttggcaagacaatggcagtgattgcgccattcatacgtgcatatgcatcagcagatggagaaatgacacctgtattcatcttattgtccatcctgtgatgattttaaaatatggaaatcacatgaagtgtcattacattgagtgacacagtcctttctgaaaaccaccagtaccatcttgtttcagcggaaagtgctttataattggagtctcaagatgattcacacactaattatggcatttggaagcttttccatcttgtgtaaataatttaatctcttgggatgatatttcattgcctctttggtaagaataatacactctgctcttcatgaaattatgtcagtttatggaagatatgattatcaagttacattataaactttagaaggattcttagttgttgcatattaataaaaatactgtaattatgatatttccggaatttgtgatacacagagctaagaagatcttaatttgctcagtacacatgtatatgtaagtgcatatcacaagccaaggtagtcctataattgatgtattcctaatatccaaatcctctctcactcttaagctaaattgcatggtaatagagtaggattctccacgggtttcttgaggattaatgttttctgttaaacaaaagtaagatttttttcctagtttaccttcattcacccatgatattcaatcatttctaaattgaaacacacagaagcgatctcccccccaactccactcaggaatatctgttaagttcaaaaatctaaagttccatcaggaaaagttgtactggacatttaacaagtgttctgcttttcataaaagttgtcattaaagaaaataaaatgtcattcataataaattaacaagaattctctgtgtgtatatatataactgattcttcctttggtaatttggcaagataattcttgtaataattgtatgaagtcagttacatgttcagttttgattaacaatggaatggcattgaaaatgaaacgtttgaatgagttgggggtaaaaccccatcattttcctagcatgagctcctgcttttctgactttatattgaaacatgttggacatgctgaactttgagtcttctgtttgtttgtttttgtttttatttttatttttgttcttgtttttaatttattagttattttcttcatttacatttcccatgctatcccaaatgtccctaacagcttctgggacaggtggaagccacacaactttcgagtcttttaaaaatttatttaattcatagtaagaaatgaattgatgggctttttgcatttctcattgacaacattcaccctgccaggatatttggtaatttatttagttttttttttttcttacgaaaatgatttgatacatttgactactaattcacttctaagaaaattttgacagctccatggttttagagaggaggatggttcagtccatattttctagtcttaagtgagtgattctcttgacattgcttcaggattctcctaaattaatgctttacatgaacgagaataggaataggaagaataccaggacactgattttattgtctatgccatggtctaagtgtggaggtaatgaggatcaggaagggacctatgtaaacctgcctttgataccctcttaactactttccttgtaaccactcacctgtgttccctttcatctcgccagtgatttctttcttttcacccctttttgtccttcaatttcttcctaaaaataaagtctagagaaaatatcttaatcaaggagaattgattctcccttaaagcctccaaaaaacaaacacagttcctgagaacactttgaccttggtcttgcaagaaccatttaatgttctgccctcctgaaagtatgattttaattgaatgtatgattactaaagaaactatatggtttcaggtttcactcaggttggtgagtttctataaagatgtgagattcctgcctttctgaagcttccatcctggaaaaagatttcatgaccaccacagggagatgagcattgtggacaaaggaaaagtgattgaatgagactgaatacaacattgggatggataaactgagttcatggaatcaattgatataaattccctttcataggatgcatcatgagaatatccctgattatcaaaaaaaaaaaaaaaaaaaaaaaagagttcattttgccttctgtgcttgcattagatagtctatgaggtgttcatatacagaaaatgaaggcattatttcttttgtattctgtaactaaaacacaatgtttgaactgttaacatttaaaaagaagactgcctaggtcagaaagtagagtaaataaaatttaaagatagagatcttgggctcctaggacactgttggctactagtatgttcaaagagcatgaatgggtataggtggctccagccatcttggacttaaggactgtgaaaacaagttccatctgtgactgccctgcctgttaagggcagcaagcactgccatctcttgaccataatacaggcccttaaagcagcttagctctcccagcactccctgcaacctacctggcattgactctgaggaagaggaggagaattaacgagaggagagaggaggaggaagaggatggggaggaggtagaaaggaggaaaagaaacctccaaaggccctcatttgtcaaaatttcaaaggaagtaggagagaaaagaaaaagagaaatgtcaaaaaacagacctaatctctcactgacactgaagaaaggaagaaggaaggaactgacacagacaaggtcctcttggtgggatttctgctgaaggagaaaaagtaaagaggaaatgccagaaatagtcctcctatttacacccagcccagcccctcgaccgtgttgaccaaagagttcagaaattgaggatgaggacaagtactgctacagctgacccacccaaactaagctgtgagtccatgtcacctaactctgcacaccctctgaactgtaaacagtggcagaacaggtagaagaataagcacagacagaggaacaaatgtatgccacttcagataccagaccaggttcattccaaggcttccatagaagagactgaagtgcctctggctacaaagtcagacagtagagactagaacttgagtcctgtgatcacacatgacccaatggctggatggggccttttttcactaccttaataaacagttgttctcggggcctagcagtgctgcccaacatctattccaggaaatacctaaatcttttcgcctatgtttatcattgtggttttccaagacaagtgaagaatacatccagtggactgtattgccaaagatctgtgccagaaacgtccatccttggtggtaactttggctgtggagaatgcaacctagcttcaagtgtcaggaaccctgttcactgctttgatttggcttctctgggcccagggtcattgtatgtgacaaggcccatgtgactctggaggatgaatctgtggctgtgactgtgttttgtctttcactaatgggaagtaacattagggacttctgtgaggaagcaaatccagcactaaagccagggcactttacaaagtggctgaagtcagcaggcactttgaggatagcagaccttttcaagaactgtgaccaaactcagctttaaagtcatctacaagacccaaccgacagtcacttcttgtttgactgaaaggattgagcctcccagagtagcacccagagctatttcaggccttataccttagccttgtctctactggcacatctaatggacatcagttgaaagggagaactcagactccaatctcagagctctaaagactgtaactacccagactatgatccaaaatctggtactatcctccttctgtaccaagaacatgtgataaaggctccagctcagctcttctcaagtggagccttcttggctatagaaagcatgaaatttcttggacagtctcaagaatgaagagtttattgtgagggtatggatgtatatgggacttgtgggtcacttcaggtatcatggaatgtgattagctggcaactgttggatctttggtttggtttctaccatctctctgaaggcaaattggcattccactgcgctgttttctgacctgcattgtccagcctctgcccatccatagtttctgagtcaagactacagacaggtggtttggattaatgccaggtcccaaagctagtttgccacttggggctgggaatatttaatttctttcttagagctgagaatcatttgatttttgtttgttgttgttgttgttgttgttagtagtgggatatgttgttgttgttgttgtgagacagcatctcacgctgctccaggctgatctcaaacaaaacaaatggcaatcctcctgctttcacatcctgattattggtattataggcttcatccactttatccagttaaagaaatcatataatttctaaatattcatttctcatttgaaaagtgaaaaattcttgtcttacattatgttggaaggattaactgaggaaatcaacagctaaggctaggaacattaagaggcaaacaagctatggctataaaatattaaaactaaatagaagacaatagaaagagttatgaagactaaagattgagagaagaaggccacaaaggtgctgattgagtaaaattacaaagtccaagttttaagaacaaagttttgtcataaatttgatctattttatttccatagtctagccaaccaaagtatggcaatcatgcattaatcctatatgctgcaatgtcaggtacaatgttggatatgctttaatggctcttggggccatattgtctcattaaaatagaatctcctcaatagataaagatgctttgtcattgcctagtagcacttagaaatttaattgtaagatgtctctgaatagtcatcaagtaggtaaaggaaaacaacaaacaccaacataaaggagtgttagctgggccatttgatttatcatatgtggcctctgattttctgaattattcttattgatggactgcaaatgattgctgctctcaaagtatttatttcatcaaactgaataaaataatgtgataaaaatgtgctggataatgttcacagaaaataagaatcaaaaacttagggaaataaactacctcagttagtatccaactcatgctgattcaaataatatcaccagtatggatactattcaagtctcctcagctattctaatcagaaagtcgaattctcctgacattctgtttacctaatttttcttttatttcctttgatgaagacctataggtattagagattacagggctctattttacactgagctcctagttctgttacctctgtttacatcagtgcagagcagatgagagctgaacagggcaatagccctagcgtgcattgccttctatctcccaggtagtaaatacaattgttttgtttttcgaggtctaaaatgactagatatcagcagctcacatcctgcagggcaaatcaggatgtgacataaagtgttcagaattgctatgttggcatcgctaacagaactgtaatagcggagtatttgggggcacaagagggttgttggcaatgtcaactgctcatagtgtggtggagaacagacagggtcattgtttttgctcagctcccgatttattttccctcctttttctttgcctggggaattttttaaagatgaattagctcctcctccaatgccatggatgtattgtgattctggagtttcctctcttcgtgtatctctttccaagttgtttaaaggtcgttttctcttatcaactctttttctcagaaagtttttaggtttacctggcttggttgtcctttaagtaatcatgataacttaaatgatctatttagtagaaaacaaactcagtagactgcatatatttaagactgcaaatgagaagatataaacaagcaaaaagtgttaatatgtaactgtggctttggagaaaccctccttcaataaatacatatatttgctttcatttgtcactgcatgtattgttatgttgacattaccataattttctaagaaatgtctacccttgaaagctcagtgtatgtttgtttttccaaaattgttcaaagatgatgctaattatattatgtatctatctaattttaaaatatcctctctccccaaatatcatttttgtgaaagcaagtttatctcattatttagattttatttacttataaattatttctcatatctataaaacatatatatatgtatatatataaatatatatatatatatataatatgtatgaatcactagcttttttctattgtcctacaataatattctctaaaccctatgttgtttgtacatacatatatttaggactgcaaatttattgcatacttacctgtactgctacagatgttaaatgcacatggtctaatgaggacactgagtatctatctccctttataattcttaagttcattcctttgtgataggatctctcattgattgaggagctcactgacttggggctatgctggcagcaagcaacgctctgcaaatcttctgtatctgtctctcacacagagctagagtcaaaggcaaatcctggcatttgccctgggttttgtgaattgaatctagtgctcgtattagcgaagtgagggctcctaccaactgagccatcacccacaaccatctgtgtccccttcagtgaagaggacaagtacttgcagaaatctactccctctgtcctctacagaaaataacatcaaccatgacagattccatgaaaatctgtaaaatagcagagatggcattcagctattccattacttatgctctcatagactgctagtttcttttttctttcacttgtggtttatatatgatgttcaagaaagttcctatgagctaggaggaaattaatgtggtatagcaggcttttctgcaggaattatacaaagcaaatattctgaaaattatcaacccatcgtagaaaaagaaattctggtatacctactatttagagctccttaatgctttttagaggtttttctttaaatcctggattcactaacaaattttcaagtgtctccaactttcttggccgctcttccacatcttaatccttaattgttcctgttttaagtatgttgaactgtgccctgaatgtcttggaaaaagtaagaaagaaacagaaagctagagaactgcaacgatcttactttcaaagcagtgtgaccttttgttagaaattgcttatttttctgtccatgggaaaatggagaagaaacaaagaaagcagagccatgcttactatgtccctccccttccttctatagcccttctgcctgacaactgacaattgaacacttcaactgacactgtcaacaaagctattattccacccattggtcagtacatgttcattttctgtcagatgcttagggaactgaagcattatatgctgatctgtctcttaggttatcagggacactagcagttaatctgcattattcacaaccttgatgatcaaagacttaaatcatcattcacctccatgaaagcccagagacaaaagaccatatagaaatgactggcagttattttctggaggaagaaagatagttcaatctcaaaaaaaaaaaaaaaaaaaaaaaaaaaaaaaaaaaaaaaaaaaaagtaaacctgcagcttttatttatgagaaataatatctccgtcttcccacagagacagggccacagcaaaactcactgtaggcaccacatctctgtgtaaaattataccccatggacagtcacgaaagttctcttaagtaggtatttagtagccccttgattggttttttaaaggttatttgaaatatttgaacacttgggaggagactttgagagtgcaattaattttttctcaaatgttagtgcttgatcttaatatattaaatttactattgtgtataaactatattataaaatgtgttttagttttcttcagactagtaaccaatagaaacccttaagcgttctatttgtcaccacatttttctgaatgtcttcacctgagttcaacacctttgggatgattaacctcactgcacactgattaccttactccacagcatattagtgtgtagttgtttttgtaccctcttgtgcaattgctctgcattttgtttctagttttcctgaaagcctgaaggtgcataactcactgagttgctgcgggttttatggagaacatatgttgcgtcctactcaaaatggtctccttacagttctagagctgcacagaaaaatgaacatttggaagagggaaaagcttgagtgacatacttagcccaggggcagtaaataagacatcggctctgagtcctgaaagccctctgcagcactgctccaatgctgactcatggcagtagacaatggacattatgagatccaatacatggtttctttagttattctcaagttttaatattgctctgtttgcctctgacataatttatcttgtaatgaaattaacaatctgcaatcttgtgagactgcagtctagtgaggaaactgatttcgataaatatcctgcagtttatggttccaaaaggggtttcttccattttgctttgttaattagtgatatctacttagcctcttgaatcatttgaatgtgaagttcttttatagaatctctatgtttcaaaagtttcatagttagaatattaggctactagaaactcacttgaacacccacatttttcttttaagctctttctagaactatttattttcccctaagttaaaatatatgcacaaagaaaataattttcaattgtcttacttgaacttttattatcatgttgtggttatctctgtaattttatgatgtcatgttttgggttaagagtaacttgaacaagtattcttctatgaagcgttttatttaacgagtatgtttgaagtgaaaacttcatcccaagactggtgttgagtataccagtttgtgttagtaatctttctatcattataaaagaaatcctggcagagcaatggtggtgcatgcctttaatcccagcacttgggaggcagaggcaggcagatttctgagttcaaggccagcctggtctacagagtgggttccgggacagccagggctacagagagaaactctgtctggaaaacaaaaacaaaaacaaaaactcccaaaacaaaacaatgacaacaaaaaagacatcctgagctaatcaacttctaaagataaagaggcttcgttaggttcacaggtttataggctccaatatgtacccagctgactttgatgacaaggcaaaatcatggaggaaatgaatagtgaattatacctgctcatgtttaaaaaaagaaagaagacaactggccactcatcccccaagtaagattgcacagtgatctaaggagtgtatactaaggtgtcctccctaaaaagtctatatatcccccaaagcatcatccagaatcctaaactctaacacataggcctttctgagacattcagtattcaaactacagagactggtgtaatgacaagatatacaggggaagaaaacagaatcacaaacaacagcagcagcccaagaagccagtccacaaacttatagtagcaggcaccatttgggaaatgatatttgtcccttccagctcagtgctaatcacagaacaccaaacatgctctatttgccaacactatcaaaattctggtaattctatatctaggttctccatttcaatatccacaatcagaacagattgaaacctttccattttttgttcctatacaaagatttctaatccttcctaatgactttgagcatctgtcaaattcaagtaatggtgagtgattctcttcctttagtaagttttgcataaacagactgtacctagtcccatttgggaagtttccattaacattaacagcccaaatatcattgtctattgcatgttgtatcattttggatatatttcttagctttggagattcatttatttattgaaaatagagattataatagtgcccataacataattaatggtcagacccaaccccctccagtaaacatgtggcttattgtcaatacttatgagttctaagtttgactcgttactctgtagtttgataggatacaagaagaggttgaaataacaatagattaaaattcaaagagaatcattatatgagttctgtgcagatttttccctatgtccaagtcccttgctacctttccctacattaagtatccattcctctacatacagagtacaatctgaaattttttaaatgaatacacaaaagaataagtaaattagtgaagagacaaagttattgtataagttgcagatgcaactatggttacatagagaaatcaatctgtcaaccataaagtgcatgtatctccagatctgagttaaactgtataaggaggcagatgatttcagaacaagaatgtatattaatgaccacttaatccaatgattttcataaacttttgaactacacagtaatagaaattcaaaacagaaaatttcaacagtgatacctattaggaacaaacaaacttagactaaattataataataggtgctcttatttaccaaggaaagagaaacattcaattcttggttccatctctttctaccaaagaagattgtggagaatattatacattaactatagtttccagaggatggataaaccaaggacacatttgagaacctactacagctctttaacaaaacttttatgtttggatcctgactaaaatggtcaccgaaaacagaagttttgtacaacatttttaagtgtgtgtgaggaacagtcccatacaatatgcaggttagctgaaaaatacctaaagagaactaagagaaaatgtattgataaatacattagtgctgtgagcaaggaggatataattaagctgaggacactttagaatagtgtgcagactattctcattgaggcacaacttgaagaatggcaacgtctggacagatttttttaaagggtacagatactttgatgacaagagaatatccctactcaaagaaagtccggaagtcatatggattcctgacaactcctgacaggtctcctccagtgaaaggcaaaaggtgagccgcgctgaacataaaggctccatagaggctaaacttagagacaggtagtttaggatcttcccttcaaatttaagttcttgctcaaaataatggtattctaaaggccaatatgtagttaaaaatgttattttatttcacttttacatttattataagtaagagaggaggttaatactatgtggctaatatgtaagctgataaaagtcataacattaatgggattgctgtgttaattccactaataatataagaaaaaaatcagttcttaatatttgtaccttcattttccagatggagttagggggacttttatataatgttggtgggtatgtcttgttgaaaactatttccttctctgtgtcatggattttcatgattttttttactgtacttgatttacttgtctattttgaaaatatatactaagtaaacatacgtgtttattttcagtatccataacattttcaaacagtccacagtcctcctagaatttgatatcaatacttttaaaggccacatgtaaatacttggcaaggacttttaaacatcatgcaatgttaattttatttcaaagacaacagtcccacccaaaacatgcaatcccatatgatgacaaacaagaatcttatgttaaagtaccttgtttttaagcactgggaactgaacttagggctatacatatgctaaataaattgtaggtaccactgagctaatgccagccttcctatgtctaagcaattctaagatattaacttattcacacttctcaagggctgtattgcatatttttcttgttatccttattcgtttaactctcaaacttcttactttttatttttaatgtatttttaaaatttgctgtacatctggatcatatctttccatccttcttttccttcaaatccttccctctttttctactccttcttcctcccgttctccctttcttctcagaaaagcataggactcccattgatatcaaccagccttgtcatatcacgctgcaaaggaacaacggatatcttctcctactgtggctagacaaggcatcctagtaggggaaagggatccaaaggcagacaacagactcagttacaacccatgctccttctgttaggagttccatatgaataccttccgatagtcttcataaccgttacatatgtgcctagggcctacacctgacacatgcatgatctctgtttggtggttgattctctaacggccgctatagacccaagtttgttgattctgtagattttcttttagtgtccttgactcctctggttccttcaattcttcttctaccgcttcagtgggatttcccaagttctgccttatgtttggctgtgggtttccattggatgctgtgtaaagcctctcacatgacagttatgctagacaagtctctgcaagaatagcagaatatcattaataatgccatgaataggtcctctctgatggaatgggtctcaagatgagcctttttcactgatgagttgcctgagaccaacagcaccccagttcagtacactgcccagggatacagagctagtaaatagtgagattaagatttataaccaggcaaagtgagtgcagagcctgcaaagccttcaatcactcctgaataacttttcataatatgcttctgaaaggttgtattaaagctgtatcactgcgaggccctgggcagcagaaggagcccataattcttttgatgcatcaatctctgccatttggtccctccttctcatcacattgacccttgctgctccattgcgtggaatccagcaagtgttacttgggtaccaggatttctatggtcatgaattttttacaaatgtactcatttagggtttaactcaaaattattgtaaaacataaacaatctagtagtcactgaacagagaacgtcagcactaaacaagctttgttatcaatgatcatatgtaagagttattttaatgccattattattaataggtttagcatgatttgttatatttgagttaaatacacatattcttgcatgccattgttaaaacacacggtacagatactacactcttttttgtttgtttgttttaaaaataaaagaattaaaacagctaagactattaaaactcttaagattgaccaggacgaataataagaaaaataatcaggcagacctaaacttcaatctcacattgtttcttatttggtaagtttaggcaaagtatgtagtttttctaaattctcatttgaaaaagtaaaatatctacattatttatttattattattaactactgttattattactatggagacagggtccctctacataaccctggctgtcatggaacttattaattagaccaggtttgcctaaaactcagagatttctatctgcctctattgcgattaaaggaatgtaccatcatacctggtacacaattttattactgagaaaattaattttggggtcctttgtttacttattcactagggtatggtagcaatgtctttagaagttttcaacttgtcatttttttaaatgatttgttgtttgtttgtttgtttgtttgtttcctattttagttttgtagccaaatcagaaacaccacagtaagactaaccaacagagggtttgaccttgttatctcctaggcagcaaaccatcctgcgtttcatgccaagctttccagagaaaacatccaccatactgtttaatgtgtctagagtgtgtaatccagaacatatcttcttgagtttgataccactgctgcttgagcctgatacacttgttctttgtctttctctgcatccaaggatgtttagcagaatccttgccttaacaaatcctttttcatggaaaaaacaccccataccttgctgtgacattaagcattgccaggttccccagggaagcatcagttgtttagagagattcatacacttttgtcagtcagcaaagtagaatacaaacaggttttccttgccggctcataaacagctcaactaagtaaaaggagagatagaacaagagcatagtttctataagtttgaactgctaaaacacagcaccatagataatggtggcttataaatagaatgaagtgatttctcacagcattggaggttggaagcaagagatcattgtggtagcaggtatcacttctgattagatttcctccttcactcatatcttatgtctttccacaaggaaagaacagagggagctagtcttctgatgtcttctacaaaaataatggtcccatcatggtgactcttcatgcatacaataattatgtagcaaatcggctccttatatgtaaaatcttagcaaggttcagatccaggaattggggagaaaaacattttatttgaagtattgctgttttatcttgttggttttaatctgggagcctttttagctttctgaattactaaaagacctcatattagaaacagaaagttatattttagaatatgaatctacatacaaagttatatatctgttctatcaaaagagatcatggatttgaaagggagtgagaactaatattgggaagggcttggagataaaaagtgaagggagaaacgtttttaattaatacagtcacaaacacaattaaacaaaataatattctctacttttaaattgaaatgagaaagactgactgaagaggaaaaccccagctgaagtatcattttatttctttgtattgccagcacctctgtaaagaggtactggaacctctgccaccttgcagtcatcaggaggtgaaggttttcttttcccaccacctcgagggcaagtttaaattgcttttgcttatttggttccttatggaaatagttgaaagtcattgtggttcattatgtgaagctgtaaattgacctctttctagtcagacacatctcctaaggatctgcactatgcagactggccttctctggaacactctgtgtcctcttgcagaagattgtcacagatttttactcccctcccctctaacctggaagaggttcttcctgtcacagagcatccattcctgtggctattgcaaactgagctgttggccacctctgtcactgctatcttcctgggtgactcatggtctgctttgtagacttcttgaacatcctaatccaaggctctcaacatttaatgtcttcccgaagtcttaactttaataaataacagttggaatggatgaatggttgagcaaaccaaagcttcctaatcacagattataaagggagaaggattctttttcttaggcagggggcagttgaagtctgcacatggggtcctctatattctcaggtaagcataattaggaaagatcttgaaatgcctctgtcaaaaccagttgcatttccatatgatagtatttccatattcagttctgcttccctctgaaggttatgtgagtgatagggtctaccctttgccccttagcatggtctccttttcccacccagcactacggttttctatttccttttatgaaatgagaaaaatctatgaatttctattcctacacaaaatctactgctgaatgactgacaaaaaataattcaaattcttttcataaagtgcaattccattcattgccatgcattataatggaacaatagtgattacattatcagcagggaaaaattctgtaaagctggactgttcttatttaaattttgtttatccaggtatttattataataagataatatttcactgtgaattagcaatcgagcgagatgttccagttgtttgtaaagtttaattctatagcaaataataataataataataataataataataataataataataataatctcaggatgtagcgactgtgacagctaatgaataaataggaagcttattttcaactcatttacgcattaggaaatgtaggttttagccttcattattgtatcacattcaataaaattatagacaggctttgtcctgataagtgaaatcatttgcatgcatcaatcacagcaagaaaaagtaagtttcacgtttctcatatattaatactgatgggcaatttgcatttagcttgacagggtaaaggagtgcttcacagcacaattagtcagatcataatgcttgaaaagagttggatgtttaatcaaacaattttcattttagcaacaatatttacttatcacagtgctgaacactggagctttggagagcaaaatattttggaatttggggacatcagaggaattatcctctcaatgacaagtggagatcatctgtacactaaacatcaggtcttgacattttcatttgaataacaagaattcttgaattgaagagacctgtgtcatgaagtcaacatgtaaagacagtagtatggatttggagtcctaatctgaatgaatctccactccattgtctatcagccgtgtgacaatatccatgttttacaaaatctctaacccggtgatacattttcctccgaatgctgctcctgaggtagcttttaatatggccaatgcccttgctgaaatgcctgacaatggggatatggaacctgaagagacaacctcaagtaaatagacagagcccccagtggagggatgtagtcaccaacttacctgtctaaaataaatgttcctgtctaaaataaatgaatggagaaaattagagcagagattgaaggaaagcccattcagtgactggcccaacttgggatcaatcccaagagtggtaccatgatacaattattgataccttgatgtgtttgcagatgagattgtatcatggctgtcctctagaggctctactagcagctgactaagacagatgcagatacttaaagccaaccattggactaagttcagggttccctatgaaggagttaggggaattaaggagttgacctggatggcaactgcataggaagaccaacagtatcaactaccctggaaccctgagagctcacatagtctaagccaccaaccaaagctcatacacaggctggtccaaggcctaagacccctggcacattatgtagtggaggatgccttgtctggcctacatgggagaagatatacctaatcctgtagagagctgataccccagagaaggggaatatgtatgtgtttgtgggggaaggtgttgatgtgggattgggtgggtgaggtgggtgggtgggttgatgaggtcagtgggtggagggatggaggataattagtggggaactgggggtagggatgggcatgtagaaaagtggggggatggtgttgcatgctatcagaggcaaagggaagggggagagggtgaagagctcttggaggggggaccagaaaagtgggcaacatttggaaagtaaataattaaaacaagtaaaataaaatgccaatgtctaggcataatgtatctcagtacaaaatgtcacttgctctgaaactggacaactcctattcagtccctgggacctatgctgtaggagagaatagacaggtctacaaactctcttttgaactctacaagaacacagtgcaacacaaacacacatacacagagagagagagagagagagagagagagagagagagagagagagagagagagagagagagaagacagagactccaaagtagttgaaaataaaacctcatttgtcctggcactagatgatttatgggttaccttcagggtgatttcagtaagcacataagatttgtagttattagtatagttcgctgttttgcaatgataaggtggatactaattgcctggttagccaggacaagtctatattcttacacaagaagtctgcttatggattggactttctacttacttaacaggtatccaagagatgacaatgtcaacattttggggtgttagttgcatttttattttttatttttttttctccatccattctttttttttttaattttttttaattaggtatttagctcatttacatttccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcattctttttaatagctgagtagtactccattatgtagatgtaccacattttctgtatccattcctctgttgaggggcatctgggttctttccagcttctggctattataaataaggctgctatgaacatagtggagcatgtgtccttcttaccggttggggcatcttctggatatatgcacaggagaggtattgctggatcctccggtagtactatgtccaattttctgaggaaccgccagacagatttccagagtggttgtacaagcctgcaatcccaccaacaatggaggagtgttcctctttctccacatcctcgccagcatctgctgtcacctgaatttttgatcttagccattctgactggtgtgaggtggaatctcagggttgttttgatttgcattttcctgatgattaaggatgttgaacattttttcaggtgcttctctgccattcggtattcctcaggtgagaattctttgttcagttctgagccccatttttaatggggttatttgcttttctgaagtccgccttcttgagttcttctttatatatatagttgcaattttataaatattgcaatttctcctaaaccagctagctcccaaataattaacacaggactactgtatttatttaacagctttaaggtagaacagctgagcaatattttttaaacaacatttttattagatatgttcttcatttacatttcaaatgctatcccaaaagtcccctatacactccccgtgccctgcttcccaacccacccactagcacttcctggccctgtcattcccctgtacagggtgcctaatctctgtaagaccaagggcctctctttccaatgatggccaactaggccatcttcagccaaaatcttccagatactttcatgtgatagcattctctgctctagcatgctcatggtatccactggaccctattcttgtggccgatttcccacttattctttctccttctctctcctctggcaggaataagtccagtcctttcctcttccctactcagtcattggctctttattgaccggtcatagaataattgggtagcaatgtttattcaacactaagataagagattctcagaatatggactgcaaccgaatatggggttacagaaatcagcctttgaataatataaggataatctgtacacagtacacaataatattatgcctatatttggggccacagtttcagttgcaagatttcagtttctgtaatgcttctgtaaatgctggatgtcagaaatgaaaacattcatataaaaattcatttatttttaccccttgttttttttttattagagaaagggtttctctgtatagccctggctgtcttgaaactcattctgtagaccaggctggcctcgaaatcagaattctgcttgcatctgcctcccaagtgctggtattaaaggtgtgtgccaccagtgcccaagcatttattttttattagtttttaagcttatttttattaggtatttatttaatttatatctccaatgctatccaaaacgtccccccatggtcccccaccccactcccccaactacccactccccctttttggccctggcattcccctgtactgaggcatataaaatttgcactacaaatgggcctctctttccactggcggtctactaggccatcttctgatacatatgcaggtagagacataagctcctgggagtactggttagttcatattgttgttccacctatagggttgcagatcccccccaactccttgggtactgtctctagctccttcattgggagccctgtgatccatcaaatacctgactgtgagcatctacttctgtattgctaggccctggcatagtctcacaagagacagctatatcacggtcctttcagcaaaatcttgctagtgtatgcaatggtttcagcgtttggaagctgattatgggagggatcccatatatggcagtgtctagatggtccatcctttcgtctcagcttcaaactttgtctctgcaaatccttccatgggtgttttcttcccaatttcaagaaggggcaaagtgtccacactttggtctgtgttcttcttgagtttcatgtgtttcacaaattctatcttatatcttgggtattctaagtttctgggctaatatccacttatcagtgagtacataccttgtgagttcttttgtaattgggttacctcactcaggatgatgccctccaagtccatccatttgcctaggaatttcataaattcattttttaatagctgagtagtactccattgtgtaaatgtatcacattttctgtatccattcttctgttgaggggcatctgggttctttccagcttctggatattataaataaggctgctatgaacatagtggagcatgtgtccttcttaacagctggaacatcttctgaatatgcccaggtgaggtattatgggatcctccagtagtactatgttcaattttctgaggtactgccagactgatttccagagtggttgtacaagcttgcaatggaggagtgttcctctttctagacatccttgtcagcatctgctgtcaactgaagttttgatcttagtcattctaactggtgtgagatggaatctcagggttgttttgatttgcatttcactgatgattaaggatgttgaacattttttcaggtgcttctcagccattcggtattctcaggtgagaattctttgtttagctttgagccccatttttaatggggttatttgattttctggagtccaccttcttgagttctttatatatattggatattagtcccctatctgatttaggataggtaaagatcctttcccaatctgtgagtggcctttttgtcttattgacagtgtcttttttcttgcagaagctttgcaattttatgaggtctcatttgtcgattctagatcttacagcacaagccattgcttttctattcaggaattttccccctgtgcccatgtctttgaggcttttccctactttctactctgtaagtttcagagtctctggttttatgtggagttccttaatccacttagatttgaccttagtacaaggagataggaatggatcaactcacattcttctacatggtaatcaccagttgtgccagcacagtttgttgaagatgctgtcttttttccactggatggttttacctcccttgtcaaatatcaattgagcatatgtgtgtgggttcatttctaggtcttcaattctattccattggtccaattgtctgtcactataccagtaccatgcagtttttatcacaattgctctgtagtacagctttaggtcaacaaacctaaaagaagacagaaacaagaacaaaatgccaacattaacaacaaaataataggaaccaacaattacttttccttaatatctcttaatatcaatgaactcaactccctaataaaagacatagacaaacagactggctacacaaacaagaccccacattttgctgcttacagcaaacccatctcaggggaaaagacagacactacctcagaatgaaaggctggaaaacaattttccaagcaaacggtctgaagaaacaagctagagtagccattctaatatcaaataaaatcgacttccaacccaaagtcatcaaaaaagacaaggaggggcacttcatactcatcaaagataaactcctccaagaggaactctcaattctaaatatctatgttccaaatgcaagggcagccacattcattaaagacactttagtaaagctcaaagcacacattgcatctcacacaataatagtgggagacttcaacacaccactttcatcaatggacagatcatggaaacagaaactaaacagggacaaagtgaaactaacagaaattatgaaacaaatggatcaaacagttttctacagaaccttttattctaaaacacaatgatataccttcttctcagcacctcatggtatcttctccaaaattgaccatataattggtcacaaaacaggcctcaacagatacaaaaatattgaaattgtcccatgcatcttatcagatcaccttggactaaggctgatcttcaaaaccatagccaacattcacgtggaaactgaacaacactcatctcaatgataccttgttcaaggaaggaataaagaaagaaattaaggactttttagagtttaatgaaaatgaagccacaacgaacccaaatttatgggacacaatgacagcatttttaagaggaaaactcatagctctgattgcctccaaaaagaaacaagagagagcacacactagcagcttgacaacacaccgaaaagctctagaacaaaaggaaacaaattcacccaagaggagtaaacagcaggaaataatcaaactcaggggcaaaatcaaccaagtttaaacaagaagaactatttaaaaaattaaccaaatgaagagctggttctttaagaaaatcaacaagataaataacccttagccagactcactagagggcacagggacagcatcctaattaacaaaatcagaaatgaaatgggagacataacaacagatcctcaagaaatccacagtgccatcagatccttctacaacaggctatactcaacaaaactggagaatctggatgaaatggacaagtttctagcagataccaggtaccaaatttaaatcaggatcaggttaatgatctaaatagtcctatataccctcacttgataccctgtcttcctgctggatgtgggctctataagttccctcttcctactattaggcatttcatctaaggtccctccctttgagtcccggggatctctcaacttccaggtgtcatatggagagtcccctcaatctcctacttcctgagtggtctgtttccattctttatgctggccctcagagcttcagtccttttccctcacctaataccagatcaggttcctctcttccacctatcctgtccactttccctcccaggtctctccttccctccctacttgtaactgttttcctctcccacccaagtgagactgtggtgtcctcacttggacccttcagcatattgaacatttttaattctctggactgtaccttggctatgctataccttatttggttaacatccacatatttatgagtactttccctgcatgtacttttgagtctgagttacctcactcatcatgatactgtctagttgcattcatttgcctgtaaatctcaagatgtccttgttcttgatacctgagtaatatatcgttgtgtaagtgaaccacatttttgtatccattcttctgatgtgcaacatctgcattgttcaaaaacaaaaaacaaaaaaaataaatagaagcagtcattaatagtctcccaaccaaaaaaggcccaggaccagatgggtttagtgcagagatctatcagaccttcaaagaagatctaattccagtttttcacaaacaattccacaaaatagaagtagagggaactctacccaactcattctatgaagccacaattactctgatacctaaaccacagaaagacccaacaaagatagagtacttcagaccaatttcccttatgaatatcaatgcaaaaatactcaataaaattctcgctaaccgaatccaagaacacatcaaacaatcatccatcctgaccaagtaggtttcatttcagggatgcagggatggtttaatataaggaaattcctccattgtttccagcttctggctatcacaaataaggctactatgaacttggtggaccacatgccactgtggcatggtgaggcatcttttgggtatattaccaagagtagtattgctggatcttgaggtagatttatttccaattttctgagtgcttttatcagcttgcaatcccaccagcaatggaggagtgttactctttctccacatcaacaccaacatgtgttgtcacctgaggctttgatcttagccattctgattggtgtaaggtagaatatcagggtcattttgatttgcatttctctgatcactaaggactttgtacatttctttaagtgcttcttagccatgtgagattcctatgttgtgaattctcagtttaattgtatactctattttttattgagttgtttgattttatggtggttagcttcttaagttctttttttatattttggatattagccctctattggatgtggggttaataaagattttttaccaatctgtaggttgctgatttgtcctattgactatgtcctttgccttacaggagctttccagtttcacgaggtttcatttattaattctttatcttaagagcatgagccactgcagttctgttgaggaaatttccccctgtgccattgagttcaaggctctttcctactttctcttctattagatttaatgtatcaggttttatgttgagttccttgatccagttgaacttcagctttgtgcaaggtgacaaatatggatctattttcatttttctacatagagacagccagttagaccagcaccatttattgaagatgctttctttttttcaattgtatatgtttggcttgtttgtcaaagatcaagtgtctgtaagtgtagttttatttcagggtcttcaatttcattccattgatcaatgtgtctgtctctgtaccaataccatgaagtttttaatcactattgctttgtagtaaagcttgaggtgagggaagatgatttcctcagcctttcttttattgttaagaattttttttactattgtggattttttgcttttccagatgaatttgataattgctttttccatgtctttgaagagttgtgatgggattttgatggggattgcattaaatttgtagattgcctttggtaggatggccatttttaccatgtcaattctgccaacccatgagcatggaagaactgtccattttctgaaatcttctatttatgtcttgagagacttgaatttattgtcatgcaggtgtttcacttgtttgattagagttagcccaaaatattttacattatttgtggctactctgtagggagttgtttctctaatttttttctcagcttgtttatcatttggataaaggaaggctacagatttatttgagttaattttatatctggccactttctgaagttgtttatcagctagagaagttctctggtgaaaattttggatcacttatttatactatcatatcatctgcatatagtgatacctttaatacttctttgccaatttgtatcccccttgaactcttcttgttgtcttattgttgtagctagcacatcaaatactatagtgaatggggagagtgggtatccttgtcttatccctgatttcagtgggattacttcaaatatgcctccatttaactagatattggctttaggcttgcagtaaattgcttttattatgtttaggtacggtacttgaattcctgatctctccagtacttttaacataaaagggtgttatatttttctcaaatgatttttctgcatctaaggagatgatcatgtgattttttttcctttaagtttgtttatatagtgaattagggattttcgtatattgaaccaaccttgcatcccttggatgaagcctacttgaccatggtgactgatggttttgttgtgttcttggattcagtttgaaagaattttattgtgcattttgcataaatatttatgaggaagattggtctgaagttcttggtgggtctttgtatcatttaggtatcagagtaattatggcttcatagaattagttaggtagtgttccttctgtctttattttatggaatagttttagaaatattggtatcagatatgagaagagaggttagttaatttaacagaatctaatttttaaagtgtctaagaaattgaagtttgttatatgatgtgaaagtagtttacagaccatgagtatatgaagtaatatactgagatatgaagtaagatacatacaacacaattttattaataaatttgtgcatgagtatacgggtatatatgtttcaatgtgtatatacatgtgtatgtgtgagagtgtgaagtgtgtgtgtgtgtgtgtattaaatatgtaaaattcagacaaaaatcttgagtgctcatcatcactctcaaccttgtttaagacaaggtttcttgttctctactgcatatattggactagccttccagaaattctatcactatgtatcatttctctctacgagtgctggaattgcaagcatgtgtgctaccatttctgggtctataagtgttatgaggatcataactcaagtactcatgtttgatcagcaagtattttattctgagaattatgtctctatttccctacaaagaagtggatttttaaaactaatgttatttatttacttaacatatctatcacagcttcagctctctcctcttctcacagtcccctttgttcacctcccatcccctgtcaatcacaactccaccccttatttctattcttcagaaaagcgaggcctctcatggatatcaaacagtactgttatatcaagttgcaataagactaggcacatcttcatctatttagggaagagaaagccgcccagttagaagaaaggaatccaaatgcaggtagtgtagtcagagacagctccagttccagttccagttttaggaatcccacatgaatatccagctgcaaagctgtacatatgtgcagagagcctaagtccacctcttgcatgctctctggttggcagttcagcctcaattggcccaggttagtggattctgttggttttcttgtgctgttttaaaaccccctttcacctcaaatcctcaaatactcctttttctcttccatggaattcccaatactctacttaaagtttgtccatgggtcattgcatcaatttccataagttactgggtgaaggtactctgatgacaattatgctaggcacctgtctacaggtattgcagaatatcattaatagtctcatcagtagtctccctctcatggcatcagtctcaggctagggcagttattaattgcccttccctcaaattctgctccattttttttaactctggacaacttgtaggcctgaaaaattgtgtgtctaagttttgtggccaggttggtatctcaattccactatcagaattctggatccctatccccatatgtttacgtcttatctaatgtcattttcataaatttctgagaattcccattgtccgaggtttctagctccaatatatttattactatatgcaaccattcagccacttattaagcagttttaatacatttcaaatttattgaaattttactctactttaaaactaaaaatcatttttacatgtatgttgtatagcaaaagtgaaatctcaaaattttctttctccctaccaaattgccacctcaaatatatcttaatatagaaaatcttatacaagtattccacattctatatcatttactctactagcgattgaaatttaaatatgcagggccactttaccacaagaaaagaagatactgggtacacaagactttaaaacattaattatcaagcctgcaatcccaccaacaatggaggagtgttcctctttctccacatccacgccagcatctgctgtcacctgaattttggatcttagccattctgactggtgtgaggtggaatctcagggttgttttgatttgcatttccctgatgattaaggatgttgaacatttttttcaggtgcttcactgccattcagtattcctcaggtgagaattctttgttcagttctgagccccatttttttaatggggttatttgattttctgaagtccaccttcttgagttctttatatatgttggatattagtcccctatctgatttaggataggtaaagatcctttcccaatctgttgttggtctttttgtcttattgactgtgtcttttgccttgcagaaactttggagtttcattaggtcccatttgtcaattctcgatcttacagcacaagccattgctgttctgttcaggaatttttcccctgtgcccatatcttcaaggcttttccccactttcccctctataagtttcagtgtctctggttttatgtgaagttccttgatccacttagatttgaccttagtacaaggagataagtatggatcgatgcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctatactagtaccatgcagtttttatcacaattgctctgtagtaaagctttaggtcaggcatggtgattccaccagaggttcttttatccttgagaagactatttgctatcctaggttttttgttattccagatgaatttgcaaattgctccttctaattcgttgaagaattgacttggaattttgatggggattgcattgaatctgtagattgtttttggcaagatagccatttttacaatgttgatcctgccaatccatgagcatgggagatctttccatcttctgagaacttctttaatttctttcttcagagatttgaagtttttatcatatagatctttcacttccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgattataaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaacacttttatcatgaatgggtgttggatcttgtcaaatgctttttctgcaactaaggagatgatcatgtggtttttgtctttgagtttgtttatataatggattacattgatggattttcgtatacaaccactctggaaatcagtctggcggttcctcaggaaattggacatagtactaccggaggatccagcaatacctcttctgggcatatatccagaagatgcccaactggtaagaaggacacatgctccactatgttcatagcagccttatttataatagccagaagctggaaagaacccagatgcccctcaacagaggaatggatacagaaaatatggtatatctacacaatggagtactactcagctattaaaaaaatgaatttatgaaattcctagccaaatggatggacctggagggcatcatcctgagtgaggtaacacattcacaaaggaactcacacaatatgtactcactgataagtggatattagcccaaaacctaggatacccaagatataagatacaaattcctaaacacacgaaactcaagaaaaatgaagactgaagtgtggacactatgcccctctttagaagtgggaacaaaacacccttggaaggagttacagagacaaagtttggagctgagatgaaaggatggaccatgtagagactgccatatccagtgatccaccccataatcagcatccaaacgctgacaccattgcatacactagcaagattttatcgaaaggacccagatgtagctgtctcttgtgagactatgccggggcctagtaaacacagaagtggatgctcacagtcagctaatggatggatcacagggctcccaatggaggagctagagaaagtagccaaggagctaaagggatctgcaaccctataggcggaacaacattatgatctaaccagtaccccggagctcttgactctagctgcatatgtatcaatagatggcctagtcggccatcactagaaagagaggccctttggacttgcaaactttatatgccccagtacagggaaacgccagggccaaaaagtgggagtgggtggttaggggattgggggtgggtgggtatgggggacttttggtatagcattggaaatgtaaatgagctaaatacctaataaaaaattggaaaaaaaacattaattatcattattttttatcattagtttctgaaaagcatgcctagaaatggagtatgttggcatgtgttcacatgcttatgaatgttctaataagacttcaatcaatttttatatttttgtgcccaagttgtactatatgttgaatgtttattatatattttatgatcctctggaagcctagacaagtatcacaatatttatatccacttctttaaaatctgtccactggattaaaaaaaagagagttatatctttcataggtgtacagtttctagttgtgttagcattgcagtttctattatagtagccaccatcttcaagtgaacataaaacccttgaaatgtactttagcaaagtgagatggaaatgtcttagaagtatgtatttatttatcatgtgtttacatggtatgattctgggtatgtggcttaaaacttaacactgttcaggattgcttttaaagtaactcctcagaaggttagcacacaaataaaaaactatatatacaaatagtaaaggtctaaagatgtaaaatcttaagtatcttgtgagggtcaagttgaaaaggtctaagaaagcaatttaaggtacaagaatatgagaaatgtttcagatttcttttcttctctatgctattattatattaggatatcaaaagttcagagtcttactattaatcagtggaatttacataaaatattaatctggcccttgtaaagcactgactactattagagtctcaagctcaaaatttaaattttctttggtaaccttccaagtatagatttaaaagtgcttcggatagacctctggacagaggaaagaaagagtgttaatgcttttgacacaaagtcatttttgggatccccaaacttgctatgactcaaaaatatcttcctcagcatttttgcagacacttggtaacttcttattctacaatgaggattttaatgcaaatgacagacagtattaatgctaataaatataaaacttttatgaatgtgaacctaaaaaaatacatcatgtaagcttcatagatttttagagtcctattatagaccaggatatacctatcacaagacaaatggactcccccaatacacatataggagaggactgcagggtctatgttcattcagagatgatgcacataaatctccagagactggaggccccagggagtttagaagtcaggtggggtggggggtggggacatttatatggagacagtaagattagtagaaggtatgggatatggagcaatcaggggatggacaggagggaataaaatgaggaatgtacaaacaaacatacaaacaaacaaacaaacaagaacaaaacaacccaaaaacctcctgtcaatcaatagcttaaggtctctgtcctactgcatgtccctaatggtgggttcacactttctgtggttttggaactcctcctgtccacacaactaccagtactatgggtctacgagtttaaagtatacattgaaaatacagatttttttttccctaagctcctaaactttatcttttgtccctgtatctgtttcagaaattttccaatcaactatacggcttgaaaattgcctgtaatgggcaggggccaattggtcttcagaatcagctttctagactgctccaaagtggtttgcactcccattaccccttgttgatcaagcagaatctgaaagctcaccaagcaaaagtccctagcctgcattctcttgcttcccagcctttcccaacattcttgtctttctgaactctgacaatgatataccaatttcagctaaggatcagttacaaaagagatttttgttgtccttatagtcaacaaaaaggctagaatgtcagctcccctaaaagtcaggaaaatcaggttaactctagtgcctatcaccataccatgttgcatgctggcaaccaagttgtctcagtattacaaatacctgttacagagtccatgttgttatcttagctcctctcaattcttcttagtatgccctctgatctaacttcttcagctcttctcgtagcttctcgtttctgcataaccctgcaatttcagctatgtactttcttggtctgcttgtcctttctttctcttagttctctcttgcttcctcattaaattctattctgctggtcatgttaaatctagtactttcactctcttttctagactattccagatgtccctggctacactcattctaatttctattgtaaaatcatttaccttttccattaaaaaataaatcaaataactaaacattatgaagccacatctcttaataatagatcatcaaatacctttacaattaaaaaaaatagacacaaatacttaaagtaacttacaacagtcttttccactcaatttagaaaacataattttctagtataaaaggctattttattcctatgaaaaaacaaactacaaaaaaacttaacacatagctactacacaagtctgttaatataccaagaaaaaattaactagtttgaaattttagattattgaaaactcccagttcaattataagtataatttacaatgtaacacatatgatgaataggacacaagatttttctttcatgattttgtgcaaatatttttccttctctttttaattaggtattttcttcatttacatttccaatgctatcccaaaagcccccccgtgctctccccccactctcccccctcnnnnnnnnnnnnnnnnnnnntctccccccactctcccccctccactcccacttcttggcccttgcattcccctctactgaggcatataaagattgcaagaccaatgggcctctctttccactgatggtctactaggccatcttctgatacatatgcagctagagacaggagctccagggggtactggttagttcatattgttgttccacctataaggttgaagatcactttagctccttgagtacttaatctagctcctctattggggggtcctgtgatccatccaatagcttgctgtgagcatccacttctgtgtttgctaggcccaagaatagcctcataagagacagctatatcagggtcctttcagcaaaatcttgctagtgtatgaaatggtgtcacagtttggaggctgattacgggatggatccctgggtatggcagtctctagatggtccatcctttcgtctcagctccaaacttttaaacttctttcatgggtgttttgttcccaattctaagaaggggcaaagtgtccacactttggtcttcattcttcttgagtttcatgcgtttagcaaattgtatcttatatcttgggtatcctaagtttctgcgctaatatccacttatcagtgagtacatatcatttgagttcttttgtgattgggttacctcactcaggatgatatcctccagacacatccatctgtccaagaatttcataaattcattctttttaatagctgagtagtactccattgtgtaaatgtaccacattttctgtatccaatcctctgttgaggggcatctggtttctttccagcttctggctattataaataaggctgctatgaacatagtggagcatgtgtccttcttactggctggaacttcttcaggatatatgcccaggagaggtattgtgggatcctctggtagtcctatgtccaattttctgaggaactaccagactgatttccagagtggttgtacaagcttgcaatcccaccaacaatggaggagtgttgctgtttctccacatcctcgccagcatctgctgtcacctgaatgtttgatcttagccattctgactggtgtgagatggaatctcagggtagttttgatttgcatttccctgatgattaaggatgttgaacatttttttcaggtgcttctcagccatttgttattcctcaggtgagaattctttatttaggtctgagccccattttttaatggggttatttgatttttctggagtccaccttcttgagttctttatatatattggatattagtcccctatctgatttaggataggtaaagatccttttccaatctgttggtggtgtttttttcttattgacggtgtcttttgccttacagaagctctgcagtgaaatctatattcttgtcccatagccacccatcactaagtacatggactcttatgtatgtttcctgcttaaatttaatttataaaaatattaaacctgttagtaagatatatgtaaaaatttaaaatatatattttaaaattaagtaggataagattacatatcttattttatacaacatttaaaagtcaataatggcttcaatgtcgtcaaatcaatacccctcaagaactatgaaaggttgtactgataattgagtagtattctgtaaggatggtagtgtgaaactcagaaatgtgtgtattttttacacaaaagtaatccactattgtcctaaaatctctaatgtcatgaagggtacagacgctcccaatcctgccctactattcctcagctatgcattgtgatctcctagtccaagataatagacaaaaacctagattttatgactaagaagaaagtgagacaatatatgaaaatagataattaaaataaatgtgtcctttcaatcccctaaaacaatttcactccctcagaccacagttcaaccatgtagacatttttcattatataggcaagctagaacatgggctgtccatttgattgttatagacctatttattttttaaaattcattttctacctagtatgaaaaacatctttgagggtttaaggatataatataactacagagtgtaggccatatatgtattaggctgtgagtttaattcccagcatcagataaactggacatgacattacatagctgtaattctatcactcaggaaatacaggcaggaggattagaacttcagcgtcatcatacttgaggccacacagagatacatataatcatgtaaaaaataaataactaaatatagaaatataaaaaataaacactctgatgtacattgatgttggtaataagaaatgtgtgaaaataaatattaacatagttagtgatccatagatttactcttaaatgtgtgtgttcaacaggaatctgtagattttctagtcactatctataaaaaggctaagcactgtgtatgggcatttagattagtagtattagctatcagattcttacacatctaatatctaaaaagtcaagaaaaaagaaaactaaaaattgtcatttcaggaaaatacaaaaacaaaaatgtgaaacacctgaattagtcatagactaattctagtgattaaatatgctgggctgagatagatctgccactaatatttgagactaagtgcagattgccaaatgatgcttgtttgaggtgttgttcactgtgttttcttttcagataatataaatctttcagttttcagggtatttgttataccttttgttgagaattgaaagaccagagtatatatatgtttaggatcaggagttgaaggtttaatattggtttgataaaacactttctctggatattgttaatgatcatatcacttggttccctgcccatgtgcaagtaaccacaccccccaccaaaaaaaaaaaaacttgtcaaaaggtattaagccaagttggtcaggctaattacaaaaatcatgcaaggtctttacaaaactgagtgagtatggcctaaagaacagaataaacagagatatgatactgtcatatgttaataatctcttaggcaaggagaaattgtattctttgtcaaggatgtgaactataggaacattctaagaaaatttcattactatatgatatttaaagaaacagtggttttaaaaattatttgatagaaatataatagaaagttattttcatttcagtatcatgataatctatacataattttacttgataaaaatagatttacaatctttgagatttgtttgcatatgtatttaataatttctgccatattgatttattatatttttatgcaagaccaaacctagtgaatgtatgacattatatatatttaaggattggaaggatcccatagatacttaataaatctaatcaggagcccctgagatgatacagcaaataaaggtgcttgttggaaaaaaaagaaagaaagaaagaaagaaagaaagaaagaaagaaagaaagaaagagagaaagagaaaacaggaaaaaagaaagaaaaagagaaagcaagagaaactgaacaaataccttttctgataactgtagctagctcaattcaaaaaaaacaaaaaaaacaaaaaaaacctctccccctagtaacatagtatttcttcactagttttcaaagttgttaaagggacaagttctccagcatggtagattaaagcaggcaaaatcctgagctccttttagtcatgatttctatgtttctatgattctatgaagtcatagagaagattggacaggtattgattcacaagaacccagagagtcacgaagcagctacagaaacatatcaagctgtcttgcaagctgccacagaagatttatgctgctcccttaagagcagccaaaaaatgaggagtcttccatctctattttctagtcgcccttttgatcatctactggaagtcctgactcaggtttagcaagttgtcgttagacaaaaggtctttatgaactgtattttgttgttccgaaaagttatttatcggtagtagatttatttttagtaactattgcattattaatgatgtttaatgtgaattttgatgggcatcatgaggactcactcaattgtatttatatccaattcaggctactataaatatattttgtgtttccactttattaaatgttcacatgagcaaagtctcagtttcagttatgatttttcttcaaatttaggtatgttgattgatttatttagtgaaaatgattattccatttcaaatctcattacttttcagcaatatgtgggcatttaaaaactataattgtatccaagggtataaggacatatcttaccattccttaaatattagtcatgacattacatacctaccatgtgagatattgaattttcattgaagacaaaaattgctaaaacagagtcaaaactagaaagaagtgagagtcttgtggttcaatagctactttcatgatatggaagactttgatattagagagatcacatagagaaaaattcaactagactagctacagtagaaatagatgagatattgattcctgaactgtaggaggatgtgataagtataacgtatattttctgaacttcatttccagcatctctgtttgcttgtttgtttattttgttttttttttttttgttttttgttttttatttgtttcatcttttgttattcctcattatccattcctcaggcttatccaagttttctgtacattaaaggccttaaaatgtttaggtccttcaggaaaaaataaaggaaaattgtacttatgaaacccaaagtgtaaatatgtgcacaagcgaatactattcaactagtattagtatcaaaagcattctctgtcttttacaacaatgtaaattaagctgaaatacattgtgttaagtgatataacccagacacataaaaatagatgttataacacatgcaattacttacatgtggaatataaaaataataaacccctggtcaaagaatgtagaactgtgactataaaggtgggaataggagtgatggagactgggaagctgttagtcagtcagttagtaaaatttttagttagataagaaaaatgtgcttaaatgctttgtgtttcatggaaattatagttaataacaataagctatatttctttatgttcctaaaagtgttggttgattaaatatttgtgtgtgtgtctgtgtgtgtgtgtgtgtgtgtgtgtgtgtgtgtgtgtgtgtgtgtatgtatgtatgtatgttcatttgttcagttctgtgttcctgtagaatgcatgtggagaccagaggaaaagcttaagtgttagtccttacctcatgtataacaattttgtctagatatttttgaataggccaacaggcttagcactaaagcttttggaggactgttttgctccacctccaatctttctcagaagctctgttatcacttctcactttatacggcttttgagaatatgaactagacttctcatactggtgtggctcatgcttcatttactgagctacctgtggaacttaagtgttcttactacaaaaggaaatgtggacttagtacagagtgtgtataaaattttgtggcataattgtaagacattgctgtccttattatctgggtgtagatattccaaaatatataccaaaatagcttgctgtatcaaaaaagacatgccatttaattttttaattaagaggttataatatttaaaataatgcattataattaggtgggaaatcatgaatgtatttcaagtgataaagccaagcaatcatcggaagattctataatgtgattcttcaccttaaattaggttagggcagcatgtcaaagagacacacaaagaactactcttaggctatatcctaaatatatttccccaccttgaacactacagttctaggttagttctaactctgtcttggtctagagcaataaagtttcaatacatatgccataaacatacctagttagagaagcaaatttaaaagtaatataaataaaaccttctgctttttctatgctgtagatctgaaagataacacaatttttttatgtaaaaactgtaagtccttgagccaagtgaagcagtcaatggcttcaacattttgggttttaattttgaccctgctggcaattatcttctcatgctggtgcttgtggatctctattggacttatcgtgtccaaaacatatgtgattgtacaagccctttagcaacaaacaaacaaacaacaacagaaaaaatttataaatagcagatattacctttatacttctccttctcatcctcattgttagtattttttttttaaccacagacttgataactatataaaagtgcacaggatttaaacattttaacaatacacacatacattatctagaagtccctcaactagtagagtgccttagatcatcacatatgctgtcaccgttcttccagcaggacttttgtacatatggaagcctctaaccatttcttcttcatatccatactgtggcaacttgtccttgccatactggctgttgaatattttgaaaatctttcatcagtaaagaataagcttctacaggtacatttctttaacaatctgtggctcaattgaaaagaatggtacttctttcagatttcaatggttacaaaaataagtaaagaaaactagtagaaatgaactgtttctctgcaaaatccacatgacttttaggataaggaattcctatcagaattactctaatgttctatcatgaaattggagactgaaatttaaagtaaaaaaagtttggatgaccacatagatattcctagaagagaacaatactgttcctttttctttggggggaaggggaggaatcaccaatgagatttgagttttttctagaattcagagcaaacagaccaacagaagtctgtgtggttagagtgagaatatgctgagattatgctttatggataaaaattgataagtgagattaggaaggagaaacccattgacttacatttttagcagttatgattcacaagcatatacttaatgcacaaaatctgcgaacaaccatagtatagtcactaatgccaattgttaatttgacagaatctagattcccccaggaaacatgcctttgggtatggctgataaatggtatcttggtcagcaaagttgagttgggccactgtgcaaaaagcatcactccttgactgggatccttaattaaatgaatagagggatttgagccacttcatacattcatcactttctggatcaggccatggatgcagatgtgaagagtagtgtcattcttctgctacatggtccaatgttatatcttgttactataatatcaaccgtgttatgcttgatccccatccattacaatagacttaactagaatataagtatttttaaggttgagaatcagtaactgtgcctattcaggtgtagatggaatatctatagcactcctgcctcagagtgcagggaacatcacaggatgtaagacctagaggatagtgaggggtactttgaaaagttgccctccagatatgacatgattattataaacataagctcacagaagctatggttaactgcataagatctccataagaccaaaaaaaaaaaaatccagcatagagtacagaagggttctggatccctcacccatagctaaggagtgaagaagagaaaactgtttggtgtcagggggatacttggtatgccgttcacaccttaatggattatatcacacatttatcaatgaataatctaattggattcagtggcttatctaaaaacaacatggtcagaagacaaatgagagatgacggcatgtagggatagaatgtgaaataaatatacccaagatacactatacacacatataataatatcaaaactatgttaggaaaacacatacatgttggttttatacacgcatatgtgtggataaatagatgatagattgatgatggatagatggatggatagatagatgatagatagatagatagatagatagatagatagatagatagatagatagacagatgatagatatagagagatagataggtagatagatagatagatagatagatagatagatagatagatagatagatagacagacagacagacagacagacagacagacagacagacagacagacagacagacagatagatagatagatagatagatgatagatatctcaggtgattgtctctgagcatctaagagctagtgaagtgatcagtgtacaaatagacttgttcccaaagcctgaccatctgaatttgactcctgaaatacagatgagacagaactgactcctgcaaggtgttctcaaatttccatgtgtgcaccatggtagcaggatagccaatcagaatttggaatagtaggtctcagtttattttaaagtcatcaggaagagaacacaatcaaaatagaattctagaaacgttattgaagaagggtgatataaaagcaagtaaacaggaagaaatagaagcctatgaggttgtaagcccaggaaaatgggttaaaatccaaaaacattcttgaaattctttgttgaaaaccacaaggtaaaattatctctcctgtcttttattttttataaaaatacatgttaaatatttttgctttactaaaggcaaagccaactcaaatttctatcaagtgtttctgtaccaagttcattcattatgacttagggcaggcataatgcatttcacgaatcctgtatgggaatgcagtttaagtaaagaagagaatggctccattcattagtttcctcattcactgtttgttcaggcatccattctttcattcactcattgtttacagtaatgtaataggtcagtttatgggaacactgccaagaccttggcttgacctcatttgaaaagagggcaacacagaatgaaaagcctatacaggatttatatttacctttgaaaacatacacacatatgctcttaaataaggctatgaaggttacagcaccaaaccaagtatcaaagtgaggtgcatgctcttgtaagttgcagttgatattctctgtgtcccttttccatgaagatgttaaaaaaaaagctcccaaatcaattcacccagccatgcctctctatataatctttccacagcactttggctttgggataaatataaattagaagtgaatgctgtgagaaagatctctctagctagtccattgggtcattattttttaaacataaataaaatcgaactgtaatttatagctggaagttctctgaggtttacatcctcttcttcttacctatattttcttctctcattataaattaatgacagtgagcaacagagctttgctggggattggtgtaaaaaaatgtcagtagaaattaagagtctttgtctagaaggatttgaaataaaagaaaagttctgcatatgagtttgttagaaggcaccacatcatagcctcttcacttgctattcatttatgggtcatttaaaatatatcttttcttccatttccaaaatttcatactaatatgaaataccttactaatatgtggatactaatatgtggataccttagtttagatataagcaaaaatacttacagctctgctttaaaagtttacctttgaagctagaacaaatataatgtgtgatttactatttgtggaaaaaaagaggcaggtatatcaatcttgggtataacatatatttatatctacaaaggaactgagttatcacataggtcctcagtcacaccttcacatcttttaaaaataattccatttttaacctcaaaaattccaattaaccttccatctttccctctctcccttccttccttccttcctcccttcccctcccttctagtgagttatttaaatatagtagtagctgtcagaatgtacagttcattctgaggattaggaggagttcagggattggtttcctggttactctgcaccaaagtgcaaccaagaaattcacaaagccacactcttctttgagtttattcctatctatcctggttattgaaatataatgggaaccatatttctaactggccatcagccagtgatcaccctggacttctatatggtactgagcttctatgctaccagacttctctggactccttgctggcatttgactagactttttaataatatggtagcttgccttctcacttctagtgagagaatttattggtcttgtttaataatgtatagtaatatttaatagaggacagcttctatggagaaactgtctttttccttagatgggatctagtagttaattgcaagttatagatgcatatacacgttgtgtatatacatatgatccactcaagtaaagtggatcatacatgaatttgactcccactaggtcagttgatcactttaatttatgagtctactcaatgggacatagttttatcatattgaatattttttctttgactgagaacaaagttcagtgttactacacttgccaacattgttcaaagttccaagtacaattcccatccctggaaagtaaaaaaaaacaaacaaacaaaaatacaaaaagaaatcagtcattgtgctgaaatggtattttaatcaagctactaatagtatttcaaaagaaccaattatatgcatttatcaagatcctgttattgtttggataaagatatctgtatagtaataccatataatcaatttatgtgtaccctctggctctaacatacagaggtaatttggaaaatccctaacttctcttaacagagtaaatgcatttgaaatgaaaataccctcacgattgtgatggttaatattgattatcaatttgactggatataagagcacatgagaaataagctattttcacatatgtgcatctttgaggaagattatagttcagttacctgagataaaaaaattacatcttcaatggaattatttaaggaatcattccttggacagaggtctggattataaaggagagaaaacagggtgaacatcatcagtattatccctctcttctcttctgattgtcaactccatgtgccctcctcgagtccttattagcttagattcccttccatgatccctttattagtttgcatttatctgctctattgtctaattaatgtgaaaagtaactcaaacgtaactctttgtcacacaaagagcatttgatcttctatgttccctttattcagttaaataatacacttatttttgaaaattcttcatctaattttgtaattctattgaaaatatggaggtcgtgtgagaaaatgttcataaatttttgtaacaaggaatgaaatgaaatacagaatcacttagccacagcagttgctacttaccaggcatttcactctctagtcaaccactacatgaaagtattaagtggaaagccagaaatatttaattcacacagcttaaagttcacaacattctgtatattatgatgaaatctcagattactgtatttttttcttcactgaatcttaattaatccctttgttctatccatactaacataaccagagtatgtgtattacccactagagaatagcctttttcatcctgagatctatattttgctcaagtaattagttgaaagagaacctgtgctcatataacttttattacagtttgttgttataaatttcctgtttgatgattattttattagcctattcttttcttttttaatttaatcttttgtatatatatatatatataaacataatattccagattttattcccctcccagcctaccctccaactattccacatcccatacctcatctccacccttgtctccaggaggatgttcccaccacccaccatctaccccaccagacctctaaacatgctgtatcagttggtgtatgctacctggctgttgggccagtttctgagagatcttaggggtccaggttaattgagacttctggccctcctacagggtggccctcctcttcagcttcttccagctttttcctaattcaaccacagggttcagcagcttctgtccattggttgggtgtaaatatctacatctgtctctttcagctgcttgttgggtcttttggagtgaggtcacaataggttcatttttgtgagcactccatagcctcagtaatagtgtcaggccttgggatctccccttgagttggattccacttcaggcccatctctagaccttcttttcctcagacttctcttcatttccatccctgtaattctttcagacaggaacaattatgaatcagagttgtgactgtaggattgcaatcccctccctcactcaactaccctgtctttctgttggaggtgggctctataagttccctctttctattgtcaggtccctccctttgagtactgagaatctctcacatcccaggactctggttcattctggagggtccccccaacctcgtacctcccaacgttgcctatttccattctttatgctggtcctcagggcttcaatccttttccctcacccaataacagttctgattctcttcttaatccctcccgggtccctccttcccttccccttgtgattgctttctttcaaattaagctatcctaagtataaatttatatagagattgtggtaaaggggcttgtgaccagcctgggttgcagccatacctttgggatttcagatgtctcagaggaattgggcatctagcaggcaggagtgacaagtgtatctttctctgtgactcctttttctagtccagtcactataaaatatatcaagatttaagttgtaggtgctttttggatgaatgacttggttcctacaatttaattttttgagaattccttaagtggatactgaagttataccctctttctcccctttcctacccctcgtgtgtctgtcttacttatcaaacacatgattctttattatttaatgatgaatgtcagagctataattaagtacatatttatatataacactgtagtatgttttatatagtaaaaatctacacacttgagagatcagttagtgttgtatacatgactttaggctgacctcttagaattgggtaacttataagcaagcccatcccagcagaagaaataattctctatctctctgcaaccatcagttgcctgtagtttaatttgtggggggcgggggaaaacacctagttcaactccccccaagaataaatggaaaaagaacaaaagaaatatcaccattcttcatatatttcttgaatatatatttcactatattattttacttacaaaatattcctgagtgcctagtttttaatttttttaaccaatacacaaaacataagccctgtacacattcactggatatcagtgtttaatacatctctatagtatataagcaatggttagacaagattaaatgcatttatctccaacattagtcacttccttatggtaaaaattttcatctttgttcttgctgtttaaaatatctggtgtattattgttttccctctcttcatattggttgattgtttttgagctacttaaaactttgcgtgaatactttcatttgccaagcatcttgcaaagttaagggcaagtatgtgcaacacatagactggtaatctgtggactcacctagaaaatgttggttttttaaaaatcattcctttatttgatgatgtttaaatggaagtaactaaaatatgttttttttcttattgctataaaaattcttcttattgctggggatttggatttagggctttgtatttcaagaagacagcagagtggacacatagaaaggttcatatgtaatctcagaggattgttcattcaaatgttcgatgccagacagtttactatttcttacttagtgacattgaaaatatttattgttaaatgaaaagttacagtagcatcagcagatcactatggcctgtcagatataatactctgtttctcattaggcatttatttaatactaataacttagagtttagctaaatgacttattatcattctataaaatgtattaattaatgtttgagactccttactcaaggtgagaaagctagtcctggaaacatagttgtaacagaactgagtatagtgtaatatcttaagatcttcatgttgaacaagaagcctaaagctcacatgtggcgtagtttgtatgcttattggtatttttctaagaaaataaaacttgaattcctaccactaataacaaaactgtatttaaacttgatatttttgttttctcaaaatattatgaattaggatgtggatgaaatggaagcacggcatagagtagcatcagttcctattttgaaatcaatacactagcacattttttattgagttatacaagttacaaatgtttattatacttcagaatgatgatgccagatagaatactgtcattataaatatgataattctgttcttgattgtatgcttatgtcaaaagtccaattgagatgggaatgcttataacgcagatgtaataaaaaaatccctttattcacttatggccagtaaaacaatattagaagatgatatattccagactcctactggttagtgacttgggtctcattattctctattatatttattgtttgttgagatataatttccagacatcttatcttcaccattaatatctctgcaatggcctatattataaattatgtatccaaatccaagtagtaaagatatagatttatgaaaataataataatagtaagtgggcataaggcaactatcagatagaaaagggacaagacaaaacatactagggattctagtacttattgatagtaggagttgggtcttgtgtgagtgccactgtaccctggaccctcagagtcaggaggaattgcttctctaaatagatatatatgatctcaacataaatttatatttattacagagaataaagtagatggacatcaattgattttgtatttcaaatttttcttttctaggatataataaacctaatgaatgaacaggaaagtgaattaatagcacatacctcgatatgtgtttaggagcaaaatatctacctggggatagacttgattcttcccttagattgtaaccctaagacacacatgccttttataggaaggagatgagaagtgttacagttttgaatcagtgctcacaaacactaggataaaattcataatgaagatctttgaactcagagtcggctagatagaagtcctcagtgaagaatgttatgaagattcagataaagtctgtctactctggaacaacaattatgccttttctattgtttgcagaactcctacaaagaaaagttagtatctgttatgacatagtttatactacaagatgctttcttttgtttgatacttttcaaaataaagtattgactcttggttcatgtatgcatgaatgtatgcatttgacaaactcaccacatgtacatatgtttgaaagagttgacttcagccctgaatatgctttgttctagttctttgatttaaccagataaaattggtcaaactgctaaataaaagtcttttcatttctcttgaggaaacagtaatctcttgcaattatcttgttctagacaatatgcatttattcacagaaatatttgcacaaggaatagttgtaaaattagtcactgtttcttttatttatttgctttccatcccaatgtcagctcccccaacccagtccaccctcacacagatctttcccccattatctactcaaccttctcctctgagtggggcaggggaaggctctaccccctgtgtcattaaactctcacttattaagtcaccataggactaggagcatcctcttccattgaggctacacaaggcagccctgtcagcagaaatggacccataagcaggtgttaggtatagccctggctctagttgttgtggtacccacatgaaggctgcacttctgctaaatatgatggggcttgtcctagatccagcttaggctcactctttcattgatggttcagtctctgagagcacccaagttgagtttgttggtaatcctgatggaattctcatccctgtcctcttcaggtctgtctatcattccccaagacttccactagactcatgagctccatctaactcttggctgtgcgtctctgcctcttagaggaccatgaggataggctcatgtctccaagcataacagagaaccattaatagtgtcaggaattggttcttgtccatggaatatgtctcaatttaggacagtcatggttggtcgttgcctctgccttgctctacctttgtacctttacatcttgtaggcagacacattttatttcaaaggtttgatggctgggtttctaacctccactgggagatttgcctggctatagaagatggccacttcaggatccatttccccactgctaggagtctcagctagagtcactcccatagacaacctggaccttccctacatcccaaatcttaggcacattacacatcctgcctgcccacacacacacaccgattaaagcactaggcctgtgatgcaatagaaaaagaacatgaagactgatacaatgtctaggttttaatatttgtgagacaagatagaagctgtaatgtcttgttcatattatgcataataaaaagtacattagtttgtttctgtaacttattcaaggtagattccttttaaaatgtgttgtggattacacagtacattatgaaaaatatgtttatatacttattttggaaacagaggggtactacaattgagcctatacaatgaaaacaaatagaggaatatttaaaatgcacaaaggagtcagattatgattaattagaaagttaagtttctttagaatgttcctctgtcattcatattcagactcaaactacaattcaacagtgctccatcaccaggctctgcggggcattccattttcagggagaagcttgacacatttggacttttgtgatatatggactcatttctaacaatgagatcaacaaatagctcatccaaatacctttgactcaggagaaagctaaagacttttaggtaaaaacctgaaatattcttggccatctgcataatgactgaaattagcataggtttacacagtgcacatttcctttagaatttacatgtctttgaaaggaacagaaggctataaatttcctatggggaaaatctcttgagggcctgagggcttgaaaccaaaggagtctaatgtgagaggcctgtactgcatggttgagaggacaaaaatcattcttcgagagattactgtgttatgataacttttgaaaactgttccttctatgaacaaagcaggcttaccctttggggaacactggtaatgaatggcttctccgccctacttattgcaagatgatgtaagctaaaaactcaacattcgaccccataaccagagtttcctcatagaaatgtttccacacagaaagaggcaaaaagtcaggaaagtaaagaagaatgagggacaaatatagagaaaaaaagatgaggaaaagattgtagtagacacaaatggaaaggaaaatatgctatatctttgaattttaaggtttgtacttctgcttaagctggccttactatttctctactagaagactaacctatggacaggtagcttactcttccagaatgcgagccctgcctaagtgtcaggcatacctcaagagaaggaaaaaaatcctactcctatgagacacacaggcagggaaacttctgaacaaagtgcaaaggtatccagtatatctttatctgtagaggtcacaaatcttatgcaataattacatgacaatgtgattgattcccaagcctttcatctccaaagtcctcctactatttcctttcaatcataggaactgtgttcttttgatttctgtatgggtctactatagaatccatggttgtattgatatacgctgtgtgttccaaattttaatcagttaaaactatccttctaattttttgagaaggatagtagaaaacattgttctagcttgggataatttcaatctagccataaaacttttaatatagaattttttgatatctttttactggatattttctttttttctagtagatgttttctttatttacatttcaaatgttatcccctctcctgatttccctttggaaaaacccctttcccctttcccaccccctgctcaccaagggacccactcctgcttcctggccttggtgcattccccaacactggggcatagaaccttcacagggccaagggcctctcctcccattgatgaccgactaggccatcctctgctatatatgcagctggagtcatgggttcttccatatgtattctttggttggaggtttagtccctgggagctctggagtactggctagttcataatgttgttcctcctatgggactgcaaacttctcttcagctccttaggccctttctctagctcctccactggggaccctatgcttagtccaatggttggctgagagcatccacctctgtattagtcaggcactagtagagcctctcaggagacagccatatcaggctcctgtcagcaagcacttgttggcatccacaataatgtctgagttttgtgactgtaagtggaatggttccccaggtgggacagtctctggatactatttccttcagtatctgctccacacattgtctctgtaactccttccatcaatattttgttccccattctaaaaatgaccaaagtgtccacaccttggtctttgttcttcttgagtttcatatggtttgttttctttatttacatttcaaatgttttcccctcctcttcccccaaaataatccctattccattccccatccccctcattctatgaccttgttcacccaccaattaactcctgcctccctgtccccatgccctcatatccccctacactggggcatcgagctttcacaggactaagggactctccattgatgcccaacaaggacatcctctgctacatatgtggctggagtcatagcttcctccatgtgtactctttggttggtgttttggttcctgggacccctgggttgtctggttggttgatattgtactttctatgtggttgcaaaccccttcagctccttcagtcctttctctaaatgtatatttcatatatgaatccaatgtgtcttgatcatgttcccacacattatttctcactcttctcagattctctacatcacactcatgtccacttcatatattttctttcactctgaatcatgatagtcacattctttttaaaatatttaaatatctgcatgtcattgcttgaatatgagaatatttaacacataatattgaggtagaagaaaaaatgtagtcacacataaatcatcagactaggagattgtataaaactatttagggaaataaggctacagagagaatgtatgggcggctctttgcaactttatactctctgctttctcaatgacactgacagacgacacaagtgtgatttattctcctttgttactggtcccagttaaatagatagaggaaacaaattcgcaagcagaatatcgagaaccactgtttcttgctgagctcggttgccatctgtaaattcagatactgtgctatgagacagagttatctccttctaccataaagtggcatgtctttttttctaaacattactttctttaaggctcatttttctcatctaaaaatatggaagaatacccacttcaccaggtgacttttaggattaaaagatagcagacttctatctctgcttatacagatctatttggttttggttcctagatttacttagtaggagattgaagagtgatttcttataggaaagtgtagtatggtttaaatatatttgaattcaggacttcatgtaggaaatgattttgaaaaaaatcaagatttattttagagcccaggatatctgtggaagacacatgacttacagggaagatttgatctagtcctcttgaccttggatttaggaagttcctgtatctatcattcagccctaggtctagcatagtgtctaaaatgaagaagtaccccagaaatgctagcaaagacccccagtaaaaggaggacatgaagtctgaactagccatcttttgtaaccaggacatacaagcagtcctctaaatgactgaattacctctccagcctctggttaactatttcttttttttttaatatttttattacatattttcctcaattacatttccaatactatcccaaaagtcccccataccctcccccccacttccctacccacccattcccatttttttggccctggcgttcccctgcactggggcatataaagtttgcaagtccaatgggcctctctttccagtgatggctgactaggccatcttttgatacatatgcagctagaggcaagagctctgggctactggttagttcataatgttgttccacctatagggttgcagattcctttagctccttgggtactttctctagctcctccattgcgagccctgtgatccatccaatagctgactgtgagcatccacttctgtgtttgctaggccccagcatagtctcacaagagacagctacatctgggtcctttcgataaaatcttgctagtgtatgcaatggtgtcagcatttggaagctgattatggggtggatccctggatatggcagtctctacatggtccatccttttgtctcagctccaaactttgtctctgtaactccttccatgggtgttttgttcccaattctaaggatgggcatagtgtccacacttcagttttcattcttcttgagtttcatgtgtttagcaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtaaatgtaccacattttctgtatccattcttctgctgaggggcatggttagctatttcttaaacaagaaaagacagaagtgttttaattattttgctataatgatctttagaagtgaagaaaggaacaatacaatggttgacagaatctaataaaacagttaatacaagaacattaaaatttaaaaatacaatgattttaatcagcagttttcaacctgtgggtagtgaaccctttgaggattgattaaccctttcacgggagtttccaagtccattgaaaaacacagatgtttatattatgattcacaacagtagcaaccaattaattttatggttggggaactaccacaatatgagtaactttatgaaatgcttgaagcattaggaagtttgagaaccactgatttaagtgaatgtaattttttattgagtttactatataagtcctgtaaatctaaaatgtttgcagaatatttttatggttgaaacagagtaattcagaacctgaaaatgatatggtatctatccaagttagcattgattgtgaatttgagacagcctaaagtcatctgagagtaaattattttgactgaagaattgcctagttgtccaactggtttgactgacatatgggcatatctatgtgcaaccgacttgatttttagattatttaggaaggtccagtctacgttgaggtgttaccatcactattcagttggtaccagacagtataaaaaaatgtctatgaatgagcctgtgagagcaagtcattgagtaatctatcaataatatttcacaaaattcctatttgtagatttctgtcctgagttccatccttgggatgaacagttaaagttaggaactggatgaaagacaccctaagtcacttcttttccgcgatttatcacaacaggaaagtaaccacaatactgttgaagatgaaaattttaatgcattcagttcagatgaaatgtgctttgttttggtttccaaatatgtttaagaattggatagcattccattaaaatagaaagttcttctttaagcttggaaaaatagctggtttcagtgacatagcttgcgcaagcggagagaatagcacaaggtaaatttaagctggctggttatctgtgtagcattttgtcagttccctgcattaaactgaaagagaagggacattcattaccatacctcaaatgtcaagacctttttagattagatcgtatatctcctttacatttgtaaaaaacttgtctcttttagatttttttctgttttatttaattttaatatgactgtgtgatgcttaacctgagtgacctcttcttggtctcaccttctaaggtctatactcaactgaaatctatgatctcccattatttttatttaacagtaatataaatatctattaataaaagatacataattaattatgatataaatttcataggtttttttacttaatatttactaaagttctaatgcaaaagtgctttgtttatcttagatcaaaaactatttttattacttaagtaaagttataatctatgcttctattccttacatgagtaaagaaagagagccatagattttgataactgaaattaaactttatttcttttttctttatttgaatgatgagactaatagagatcccaactttggagagcagggagaacacattcttggaaaagtgtactcaatgacacaatacttagagaaataactgtcatagaatcaggtatggtaacgcttcaatgtcaaatgttcttcagaatataattgtatttcaatttcaaagcacatttaaatgaaatttgatacattgatcaataacttttatggatatcttatctttcattgatctagacagatttttaaatgtattattagtacagatgcaaaatcatgatgacatgtcatatacttattttgatacttctctgtatgattactcttagtgaaaagagcagcaatcaaattgcttctagtgaagtcacaggtaataaaaatgtacccttgactaagctgtaggtctaattatgcactttaattttacttgatataggaattaccgaaggaacgaagaataatgcatgtattttgacacaatggagacatcctgacacctcttctgaatctcagtaaattaactggattcaagcttggcaaacaggaaaactggtacaagacaacttgctacaggtatgtgagagctataatttacactgctaaaatccttcaaagatctattgacggtggggttgttaattacttttcagataattataatgtttctttggtacatctaacagcttctgttccctcccacatatacacatgtggatgtcagcatatggcgagaagtctggccatttcatcttgtttacttgggcctttagtcatctaaaaaaggatgaaacagaaaagtacccacctcataaaacttttactactggagatttatgcagaatgatgcggagtcaaactgttactcaaacagatgtttccacctgctgttctgggagtttaaagggtggtaaacaggcctgccagaattcagaatgaaaagagggacaaatggtgatgtgccacctttctgttgttttgaaaatggggcagcatttggatcattaatatggaacaaagcatttgggaaaggtaactgtctttattttccctttggaggcttgctgattggaaaacttgatgcattgacagtgtgaatgtatcttctgttggattattgggaaagctgttattgcttgaatgaaccaataaggaagaatgaaactgtgagtgacccaacacaaatggctctgtgtgggctaagagcacggttacagcctccatttttgttaaatcttgtactatttagagtcaaagcaagccagccacccagctgtgggaaatgcaagtagtctgcttgcctggctgcagttttcactgggatggaacacaacaaaaagctcatatggcttagacattctgaaccattcatgataagggagaagttggtagttgccattttaactaacaagtacttacttcaattcctgacagtgacagtgcttcaaaacgatgggaagagatgttatttggaaacctaaaaccttgtaggttttgctcaggaagtcttctgtcagtatttatctgtctctaagttgtattatagtgtcaaagaaaattgtttctatgtccttttcaaaatattttatagttgatatgctaaaagaaaatgaatgagttctcttgagataattttgatatcaaacttattcattttatgacctgtaatgtcatttgcttatttggaatagacatctattgtctttctgtattatgttatatttgaatctccctgaatgttactataacaacagtgtttttttgttacctacttagccactactgactcagtgaggaaggagccataagggtctttattgctaggtcatgctgaatcttagggagatgtgtacctttattcatttactttgtaaaatagatttctttcgtacaatatattctcatcagtgtttccctttcctcagttccttctagaatcttcttggttccacaccaactcaactacatgctttctttccttgttagaaaacaaacaataaaaaacaaaacaacaataaaaaaatctaaaatagaacaaatcaaataatagcatgatatttcttttctttctgatttcttttcattattttcatcattttttaaaattaacttctgtctatttgggttgttatattgtgaagatgtgtcatcttaagcaatggtataagggtggttcatatttttctttcatctgcttagaaaagaagaaagcaaggaaatgagtaacatttgaaatgtaaataaagaaaatatctaataaaaaagaaagaaaaccttttttctatgtggtcttctttaatgttactcttgtgtggagtttgaaggacattgctatatgtagcctgctgaagattagaatcttaatttcctattaagggtcttctgtctttataagagttgagttatggtcacattttttgtttcttatgaataattggataaaattatgtgaaagttttctgtctgtatttttaaatggatttagcatttatttatttggctgcttatttttttaatttctgtgtgtatctatgtatgctatgatatgtatagtatgatgaggggtgatctagataagaatttatgggagttggatctctacttatattttgtagacaacagggatttaacttctcaacctttagtgggaaagatttccctattgagccatcatgacaacttggatgtgctctttcttaataaccttccctttccttgtttagtaaaatcaaatatctttttctctctttttgtctggctctgtatttgtctctgtctctgcctgtgtctctgtctctgcttctgtccctctgttgttctgtctttctaacctatgtatgtgagtatgtgtgcatgtgtagcagtgtgtgtgtgtgtgtgtgtgtgtgtgtgtgtgtgtgtgtgtgtgtgtgtgtgtatgtgagtgtgtgtgggtctgtgtgtggaccagggatgagaaataaagaagacacaagcaatactggggtcagaaagtcttgcacaaactggtgacttatgccaaaaagtttattaagaagtatagcattttatatactatttgcatgggggtgagtgaaagggggactgccagtgttggaaaagagaatatgggataccccagaccaagttgtcaagaaggaaaaagaggggaagccgcaaacattactcctccccagaattagatagatattgctaagacacagtggaaacattccatttgtccttttatcagggcctctgagaaactcttggattggtctcactgtgcatgcatgcgtgtgcgtgtgtgtatgtgtgtgtgtgtgtgtgtgtgtgtgtgtgtgtgtgtgtgtgtgtgtgtgtaggatgtcttttagcccaggctacacatctcagacttatctacatagcagagacaggccataactcatgatccttgtgcttacacctgctaatttctagaattacagatgtatcatcatacttaatatgcacatatagcttttattgtcaaatgctcccatcttgttctcaactatcatcaaagagagtactaccatagtctcttgtttcacatttggattgtagcctgtctgtaggtcacatattgatgccagatatccatctcatacaatcctaaatgaaatatatacaatgaaaaaaattttaaagaacactgtgttgaaaagataatgtaggatgattattcattaaggcagcaattaattctacaactaaacatagttcaaagaggaattctaaattttattaacttataaagcccattaggttggggaatcatataaataatggctacagagttacttaaagcaagggctttatctaggaatcgaaaaaacttatgacacaaagaatcagagccagggttctccagtacttcattcctgagccagagaagcatctggcttgaacaaaccagcaagagccctgacggaaagcaacatgaatgtagttgtttggaattctgttgaaacagaaggcaagcctctgtcaatcaccaggaaaacttgccagcagcagaggcagtaggaacattgtgcttgagatcctttctgccctgtgttaggacccctgtggaaatcctccctacaattcataaatcaggatacacttagcgaattttcaaaataagaaatgttcttaggattatacaaggataaagatttctcatttctctttggtttcataataaaagacttactctttgaaagaaaagtttcccagggttaaccccgggctgcaaaataaacaaaaagaatatggttttaagacaggttatgaatactttatgtttatagcaacttcacatttaccaacaatattttagtaaaacaaaaattatgaggatattctactgctaataatcaaggagtatttatacatgacatgctttgtcttatgagaatagattttaacgtgtctttctgcataaaacaattagaaggaaaacaccaaacttaaaacattccagattttgggggtctagtgaaaatatcctgtatgttattgaatctgtagttgccaccaattttcataatagcaggacaaatactagttgagatatacaataatgcatataaacagaaaataaactcattttataagtaaaatttaaggctctgtgaagtatcagattaaaatgcatgttatatatatttacaatatctttaaaatatcattgattaaaaaccaaacgatctttataagacacattatagtattactgtaaaataaaacaacattcattgtctaaaacaataacagagaaagcattttattaggaaaaaaattgctatatgtaaaagctatttgaatattatttttaagaagaccacatagagaggttatgttttatctttatttctctatttattttatagctctttctctttgagtaataacactgaaatatgtttctcacagtagagcagaacaaggcagagcagcagtgaagactttaaacgaattcactgggatacagagaatctttcacaaagtactttgttgatttgcaaaggtaaacatagaatatataaaaatttaaatgaatcaaaaaataaaagaacagtatcttgttccaccatcattttgatttgtaagggagttttgcagtgatgttgttcatgactagcccacactcacagtgtttagctgaagtctgagaagtgagagattgatggctctgagacatatcagaaaaacatgtatctccttgccacactttagtttatgcatcctaatttcagaagttcctacatatatacaaatcataattaaaataaaaataagtgtgtatagtggaggttcccatcttgcatattcctactagctgaaacaatccatcgacagtacatcattttctcttctcaactatttattttattttatgtttaattcaatttttacactcgatattacacacacacacacacacacacacacacactcacactcctacttctccatgtcccacacctcctcctatcaaatatttcttttagacataaagtaactgaatagcatggaaattcctaaagcttgatttcttagagtttacattatataaacacttcatactcatgttgcaagcacaatgaaatatatctgcactaatgcaaaacgtttcacagcacacatttactgttcgagaaatgaaaccacaaagcacaaatttcaaggcagcaaaactatttgaggcaatcattctatttgagaaaatagtgtgcatctattatggagagcaacttgcaaagtgagtgctgcgaacagaggagatacagtaatcataaattatggggttaatgcatgttcatatcacacttggaaatggcaaggcagagcaagatggtgtccttagaaaaacaaatgtatgagtaaataaatagatctctaatttgcagtgtttgccccattgtgtaatataaatacattcaccatttcaaccatcaacatgatatcattgaatacagaattggcaaacaataggtggcatattctctcgctggctcctgcaaattgcctctactcctctgctggtaaaaactctgctgctgctttcctaagacactgccaaagaaaccatgccatataatttcctattggctgattagctgaatttatttaggtggaaactacagatgaggatgaggtgcccccacagtaataataaaatatgttacttttgcaggtaacaaagttgtaaagctattcccctaagacttggaatgcttttggaaggaaacaaaatcggagaaaaggcttggagggttttctttaaaaaaaaaatcactttaacaagtgctatactctacctccttcattgggctagagaaagtacccaaggagctaaagggatctgcaaccctataggagggacaacaatacaagctaacctgtatgccacagagcttgtgtctgtagttgcatatgtagcaactatgggaggagagacccttggtcttgggaagattatatgccccagtacaggggaatgccagggccaggaagcaggagtgggtgggttggggagcagggcaaggggagggtataggggactttcagaaaggggatagcatttgaaatttaaatgaagaaaacatctagtaaaaaattaacattaaaaaaaaaaacaagtgctatcctatttccaatattgggaactgttaagtatgctttgaggcatctttttcttagccattgcaagctcaaaaattgaatagggagacagtaggcaaagacctttttctttgcaacatggtatattaaatcttagaatttctcaaatcctcctattcccacatgatgcagaattgttttgaaattattgagtgtagtttaactacagttgaaaaagtatttattatataatctatagcttagacttcaagataaagtatttgatactattattttattgcattgcatttattcatttgccttcattcctcgtaatgctagtaaaaatgtctccatttaataattgttgaaaaatatttaaaacattctgataagaattccaaacagaatttttcttctcttcaatattccctagctattccaaacttgacatttaattaaatagtactataattatttctgtttcataaattaggtacatggaatagatcacttgttacaattttttccaggtttattacttaacaattcttgattaagcccattgtttcacaaatgtttactgtgcattcactataatcagttgcttttcgttttggaaggattcatagggaccaaaacaaacaccaaccctcttacccctttgttgtagtaggtaaagacaataagaaaaacaaacaaaataatacatgagtatattatgagacactgtggtacatagtacaggagaatatcagctgaggaaggaccaggagtgcctaagcatctctacaggggtacaattaagaaagctaggtgatagtaaaaagctaacgtatgtaaatatattgcagatcatcttcttcattcaaagcacagaaccccaaggcgatattgtgacttataccattagcaacagggtcaataagcagagcgtctgagagacaatgtcttgactgaccctatgtgttctttatccaatacagattgagagttaggagatgtaaaggggcaggtgattagcagctatcacagcaatccaggtgaatgaaggtgatcacttgggtcatagtggggacatgcaactggttagatttttataaagtttcaagtacatataatttgtgggatgattataggtaggatatggcagaaagagagagagagagagagagagagagagagagagagagagagagagagagaatagtaatagttctgattctatacaaatattgaatttaatgagataagaaacattaaggaaagaagaactttgccggggacttgtaaacaataaatatacttaatttaaaacagaaaagaagcgagcaaattttcttgtctaattctatgtattagttaaagtttgaatgagactatcaacattccatcattctgttttttaggagagaaatctaacgtgccaatattgacacataggatctggtatccacactttcttgtactttcatctatagagatgtatctatggataaaacacttggtacataagttgaggatatgaatttttcatccaagaaaccaccaaaagccaggtgtacacatcgcaatctgcgttgttttatagggtgatatgtgaggcagacacagattcctttcgagggctaacttaatgtatgcagtggttaatagcaaaggagagcctgactcaaagaatttgtcagacaaagacctgcacccaggatggtgcttttgtacttctttatgtgctggggaacacaaatgcccctccccaggtaaaaaatgttgtatttggtgctatgataaacttatttatacacagaagaaaggtaatttttacagattctcttaatgaatcagaaggggcagatacataattatggaaactgaattctgtggatgaacgaagagaaagacagtactatgataatggtcctagagaagagaccattgttaaatatctatagagttgtatagagtacaaattacagaatgtcagagccttaaatatattaagtctaaatattagtcaagtgttgctctgggcaccgaaattctaaaattgggtccactgttacagtcaatgttgctcatattacagacttttgttaagtgaagatggctatgcatttggaggaagtctgtcatgtcacactagtaagaaaacaatgagcatatatgtgacacatgaccaagattccaagaaataatcatggccatgtcataaaaagaattaaaactaaatacaactatttgagatgatgagcaatgtaatcgcccttcatactatgtataaatacagcaagatattatgctccattgttaaaaatatataactattatctgctaatagaagtaaataaaagatggtgactcccaagttctggctgagttaataacttttctactttctctataatgatcttcatttgtactctatgattggcactgtatgtactctatgattggcctgtttgcagcccctcaggattttatggatagagtgtaaactaaatatcagcttcctttctgtcttcaatgtgctccttgtgtaccacgttgtgcctctcatgttctagaagtttagctggttttctgctttaattttttttctgagattctattactaatgtatttgtactaagtgatgcatgttatagcttgttcactttctatactctcttcaagaaaaaaattaaataattccctcatttgtatctccctcactaatacaccatacaccctgagctgagtcctctgctccttccagcactgtcaaatccttctgtttcaggtacccttttttcccagggaagggaacttggcaagcagctatcagctggaacagatgtctactggggaagtgctgactcaagcctggccccaaaaggagtcagaaattatcctctgtgttttaccccaagaaacagaccagtaaagagaaaacctatatcacatgttatatctacactttacttatattattccttctcaattacctttcctcatgcctgcttatagaatacagcctcctcctcctgagacactgggtaagcagatattcacatagcttctcttgaccttgcctttcagaatgagagcctttgatgtatcactgtgttgtcaattctccaacaggcattatgtgtgcccctgattatgttcttcctaccctacctgaagcagaactcctaccaggaggctttaatggcaaacatcactcagctctgcaaagcctaagaatccctacggtagctgaagaatttaatgaggactgtctagtacgagaaggggtatattaggaaaggcttaagaacaatctctttgtaggtgacaagctttaatcataactgagatttaaattcatatcagtgatatatatccatttaagatgctggtgatccagtttctaatttatatcatagatggcaagactagagtaagaaagagataaaattggtcattaaagcaaatgaagcttggttaattattattatctttattattattgtacttattatctttttgagtcagggatattagaaatattttgacaagagtaagttatgtaatgtctgtgggcaaaaaaagaaagtctttaaacacttatcagcacagtgagaccatatcatacaattaacccaaaactttattcctagatctttttttctaatttagatagactggggttacatgaatttaaaaagaaattaaattgaatatgaaataacaatccaggttggggctagaaatgtccaaaaatcaacctttatttctaagaaaatctgtgaagagatggctgctgcaaacattttagcccttatgaatcaaagacattttattgctacttgaagacacaaggtctaaaatcaataaatgagtcagatgatgtttcatgaacaatttgagaaaacaccatgtttagtgggatcaataaattggtaaacaactttaatatataccagaattcaaaattttatatatttatttttatacttgtattatatataaaatatacaaatactttatgtcaatatatttatatttataaatatatacatgattgtatctatatatgtatagatacacacaatgcatatttttttttctaaaggtttttagaagcctttagaaactgctcagaaacttccatagtaaagcacactgaatcagaggagaagcattgactaagtgccacttagtggtctgcatgtcttagttttatagctctgtaaaactaaacatgacagtttcatgagaggtgtcgaagtcttagaagtctcccctcccattattttctgttaaatttttatatcatcttcacttatatttggtctctataatatttaaacctaaatttaaagtgtgtgtgtgtgtgtgtgtgtgtgtgtgtgtgnnnnnnnnnnnnnnnnnnnnnnnnnnnnnnnnnnnnnnnnnnnnaattggacaattaatacgttttacattgcataccattctaatgagcatggttaaatttagtggtgccctacctaatttagctcccagcatgtgatctcttcagcatgtgtatccaacctctatacgtaataacccttttgtagcaatcagatcaactgttaaaatattgattacttgaggccaagtaaaacttcttttattcagcaactatgtaaatcacaacaatagtgtttacaacttagacaggtagaaaatgaggttaaaaatgtaatcagaaagataaaacagaaaacaataaacagcaaacagtgttcacataacttttataatgctctatcacctttactattctaacttattgatctcttactatacttaatttatatgttcacatttatctgaatttacatgtaggaacactattgtgtatgcagtaatttttgtcatctatgttttcacacaatgactggattttttacactgtaacccacaaggataaggaagtactatagtattccccaagtgttaatacaaagaagttactagaactgtcccatcatgaaaaccttacacagcaggaaaggtgcctggtgccaagcacagtttagtaccagttactcacaagattgaatgaaatatccaactctcaaaagatgttcttagatcttcacatatacactctctctctctctttctctctctctctctctctctctctctctctctctctctctcacacacacacacacacacacacacacacacacacatacatatgcacacacacaagcacacactaacaaattaatagattaaatgtaaaaatattttaaaagggaaatgtatcagagaatagctgaataaatgcacttcattcttgacttcagaagtgaatcaagggttgtcattgatgatcccaaatcatatactgtcttctaaagaattctacatgtacatatatttttattttttatttttaaagtggaaataattcaggccatgacgcaacacatgctacagaaatgctctacaatgtacatgcattattaggcctatatatgtaatttttaaatgttattttttattcaacacttagtacagtcctaaagaacacataaaaattccactgttaatatgggtcagatttatcaaaatgcataactttttttttcagtttcaaaagtatcattggttagagcaaatcaacttaaccagttcagtgacattagtgtgtaggagcaggaaagaagttaaaacctaacatgctgaattataggtttttagcactgtcattcatgaggatttaaccttggtcaaatcacataatttttctgactgtatgtttttctttgttgaaaagatgatagtaatgttgatctcaaatagatgtcattacattaaattaaaacagtatatgattaaaggcttgaattaaatacaagttacaaggtataatattttttttactatatctgataattggatatgagccactaagtctcaagggctttacatttaggggtgagtagacttcttgtggaggacatgttaagcaatagagaacaaaatgcaataagtaatatgaagctaatgaattaagtttctatctgggtaatacatatagcaagctattccacaggatttttggtaactagacctttgctgtcttacataatactcgaatagcttatcatatgcttggggaaaaaacttagttagaatgaaaagaagggaagagagtaaaaatattctgaacctcctcatatgaatgcagccataccctggagggaaagatgcagtgaaagttcttaggaacagtgattgattgtcacactttgcaaccttatgatgtcacgataatcagctatcacatgttaaggtcagtactgtggtatccagattcatttcaaacagactcctgacctcagccattccagcatttactaagaagcgggtactttcctcattgacagtcttaagagaatctatgccttgacacactcaacattactctattgcaatttcatcccatacctttaaatcatatagatccatctccattttatgctgagaaagattccagaaaagtccatctgataagggtaatgtattttagctcatttcatggagtaatccaaatctttctctccacagtggaatattcatgtcaaacatttataaaatggattagagatatcagaaaattcccctgttattctccacaggcatcacagggagttagttcagttctttcctttctaggggactacatttaacatttcatgccattattatttcacaatgaagaattactcacagaaatggaatttcttttaaacttccctggtttgaaatgcacagaaactgtgcctccaagaaaaatgagagtattcatgagtggactatgactattgaaaatgcatcttcctatcatgaaagtctttaagagtatcacaaagtgaaatagcttggaagaaagaaacgtaggtaggaacgctaagatcactttggtcattatagccatagttcagtctagagtctgtgaaacaagtaactgtactggattaggctatttcagtgaacacaatgaaaggtctgttcatggctgaacatattaaaccctagttttcagtggctctgtagtgagaatcccagcttaatcacaaccaaacttgcccgagttttgacaattaacttaacctctctaatgttctgtatttgttaaaaaaaatctacaaataggtacataacatccatgatatagatcaactttgtctttactgtacaataagctctcatggtatgtcacattgagtatgggtggtaggagaaatccatggaagcaataaataaggaaggaagaaagggaaggatggaggacgggaggaagggagagagggaagggagggacaaacagaggaactaggaaaggaaagaaagattagaaagaaagaagataggagagacggacagaatgaaggagaaatgcaaaaagaaatgaagggaagaacggagattgagcaggagggaagtaatcaaggggccgggggatggagtgacaagaggaggaaaagagaaagagaaaacagaaaaaccatgacagtgagaggacatgtgttccctacttccatttaatttaattgttttcaatttttagtcaaattattgttattcaagtgacaagcagcttatgcccgcttatgttatcacgtgatctgtctctggaggcacgtgtacctggaattgttttttaaagtttcttttatgtccataaagcatagtttgttggggtaaacaaagggttacatcagacaggctagaatggaaaataagtatagtgaaaactatggcaaatcaaggaaaaattagttgggtcaaaagcatccgaaattctttgtaagcactgggtggctgggatggaggcattgcagcagtttattaacaataatatctaagacaagtgaaaatatctactgaaagcaaattatttctcacagaatgcatgttgattattagcaatgacatgtgaatgacagattattattcatgaattcaagaactgtctccacactcttattaaaatcaactcttattattcttattttacatgttaaaatgaaataacacatttgctttattatttaataaggtgcacaatatgaattggtcaaatatttaagaataatattacgatttcagttacttcttgtcagtttgtattattgctccagtagaacaatatttacccaagtcacaagtaaactataagtggaattttatatccactattaatgaagaacatggtgttctgctttttaatataaatatataacttatataaatataattatctaaggatattgcctagtcttaactgaagatgcaattttgctgtattttcttttatgtgtatatgaggatgtctgtatggggatgtctgcatgtgagttcaaatgcccactgaaatctgagttgttggacccagggagcctaagtaacaggcaattctgagcagcctggcaagagtgctagaaaccaaactgagtaggctcttaattaccaagttacctctcctacctccaggatattcaattaaaaattgcaaattcttccaaggatcttcttaaatatcttttagagattttttttcagtgaaaactgaagagagtaacaactgaaatatttttctgaaatgctcaattgcattgcctccttttatatttgtggtattgatgatgctactgttatcaaatcattactgtgcacctgacaatatgtaacctccagagcatatttcagaaaatatattcacagacttttactaacattattagccatgcaggtggtaccatgaccctttatttacaagaaaaatgtatgagtgcttaaaagatttatccttcagttttataataaaagaagttgagttaaatcttaatccatggtctttgaatggtttatttaatcctttaaaatataatacaattcatttaacatggctataaaattgaccttttactggaaattacggtctaaatttaaaatcatttgttttctatagaactttcataactttctaatgtcattgggcttcttagcagatcttattctcacatcaacgtaaatgggtttggagggcccttatatgtaagaaaaatttaatcccatatgtcaataaatagattattacatcattataatactgaatacctctttgtttaatgctgattgtgaaaattgaaatagaactttatgttatttaatcagaaaggtattagattatggtatggtctgaggaacttgcattaagagaaatatttgcacatcttagaatctaactgctgaagtggaaaaacaagacaagatgctgttttcccttgatgctctctttctagagaatagtattcatgggccaactccaaacaactgtgtacaccaaaagtaaattggtaaatgtttacagttatcagtattttgcaggtacacctatagtatatgacaaaacaaacaaaagcaagaactgagttgatgactttaaaaagagaaaagagagcaagagagaataaggaacatagttctcacataaagaaaaagacaagctatctgaagtatatcctttcctgtgtaagaaagcatttattgatgtgtcattttgatggggcatacttgtagaaagcatacttaatgagtcttaagtagaaagtgctgaattgctggcactggaacaaaatcactttctataacctactaaagaccaagaggaaatattatataaattagtaaggaagatggatgtgatgatcagtttgaaactcaaaaaatgttgaagaaaggcacaagccttatatttttagacctatgaaatattaagtgcctggcccatgagaaagaaaacaacatcaggagtttgtgcccttctgggtataggaagatcatgtatttactcgtacatgtgtttgtttgtttgtcaaatttttattacaggtaaggaataccagtcagtgcacatgtgctaggaattaattcaccacaatgtgtcttatgaagcttatttttgagtaggtgccatacataaacgtgctcagtgaaaccacagttggatatgactaagtgctcaaaataatggaagtcagaacgattctcaggattgcagtattatgcagaatagttaggaaatatttgtcggaggagacaacgtcaaagacagaaaaaaaaaaactaggtaccactagggtttcctgaaagttactattctagcataagaacttctagtaatcaaatgggattttcttcaagattgtataaaatcttgtgagtatctgaaactgtatttagatacatgagtggatgacaagagacctgatgatgatgatgatgaaactggagtcctcattgtaaatagtttatcactttttagtgtaagtaaagaataaacttgtatttcagtagagccataatgttgttattttgatgttaaattgggttaatgaagaggaaaacggtcttctaaagaacatgacttgagagaaaaaagaaatagtccatttaaaggaaagatgagcgtaaaacgattggtttagtggagacaatttgagtggacccactacagacagtgtttgaaaacagatatgagtgaatctaaatcccacggaatgatatgtgtcttcttctcagagactttaactgtttgagtaaaatgctgaaagatagcaaggagatgagaaagttggtgaatttaaattatatggcttacagtggtacaaacatcttaagagtacttccaagccgggcgtagtggctcacgcctttaatcccagcactctggaggtagagacagaggtaggcagatttctaagtttgaggccagcctggtctacaaagtgaattccaggacagctggagctatacagagaaaccctttctcgaaaaaccaaaaccaaaataaataaaaaaaaaaaaaaaaaaaaaaaaaaagagtactttccagtgagacaaggcaaagctgcaataaacatttttcttagaattttttatactcttaagacagttgttaacatgatgaacgatgtagttacaacatgcttgaaatggaaattatcagctatggcaatcactagcactgttactttatatataatacagaaaatagtttctttacttatcttcaataaagaataagaatgctaacattatatcatcctgtgtatacatgaaaagagtttattttgtgatacttgagaatacattcagtagtgaattaattttagatactactagttttctgttcattttttggatctattattgcctccaaaaattatatgctttagtagtaatgtgagactttaaagagcttacgctaaaatgagaaaactccagatttggatttagaagacttaaaatcaaacgtgggggtcatttcttcagcgtcatggcttgtgaatgctaggtttagttcaggtctcataattttaattttgtggaaataacttgctattaacttccaagaaaacactcattgtgttagatccacaaatgctaaaagtacaatacgacttctagtcaaatttgtttttcattggccgaggaatttcgggtctaagaaaaatagtcaccctcatcctactggcatagaaatagaatgtctgaatttcaatggtgcatcattagaaaccgccaagtgaaaaatgattttaacatatcatcactaactactaattataaagtagcacacatatgattttgaagctggatttcaacttggcattcttcatcaaatataggcatttatttgaatcatgggtcattaggaacagtaaaataaagtcagtatttcctctcataatgtcttaaaccaggttgttgatattatttatgggtaactaatggaattaaagaatgactcaaatataagcacttagcctattatgattccatctatattaccaaaaattctaaaataaacaacagtaacaacaacaaaataagaacacatacaatatccccacagtgattcttaaatataagttttgaatctgtatagtccgagtttaatttaaacattttgatcagtggtgagacatctaggagcctttttctgtagaggctcactcaattttaagtgaatcctaacatttgcatccaattatgcattggtaaactcaagcaaaacatacaggaaagagtgagttttaagcacttagataagctttgtcagtatgtaaggcacttatgttttttccaaagcaaaagaaaacaatatatttcatcagaaatgatgcttggcactatggtgactaaagatgacaaactaaaaataatatatattgttcattagagggatatcagtcattaaagaaggtactaagagctaaagcctaaaagaaaatgtgtataaactaagaaaattgtatttatggataagtaattaagcacaaaatatatgatcaaagacatctgcctactactgaaatgacattaaggtaaatttgaaattcaaatagttatgaatatattcttgtctattttctgaattgccttccttataactccttttccatgaaatgtcaataaaagaaatgcctttgatgttcaatacattttgtagcataaatggcgtatctgaaagtgccctatacaaatattagagatcctgcatctttgggatacaaaatataattcattaaagggacttaagtacagatgaaatatgattagatgtttgcactgccttccctttataagaaaaatcataaagttgataagagatcattgaagggattcctagaggaaaagaaaaacagaaagggtgatgctagagatgtagcatgtggcaatagggcttggtttggttttatatatatatatatatatatatatatgcacacacacatatatatatatatatatatatatatacatatatatggttgaatatatgtatatatatttggttgaatatatatatatatatatatatatatatggttgaatattgaatatatttgtttgaatataaatataggtatttagattctctaatcaccatctacttaactgaaaatgcaaacatggaaggcacaaaaagtaaaagtttttatttcagacactgtattctttcatagatagctgaaaactgaggacattgttaccttatacactcatttattttataatgccaattcttggatattagtcaatgttcactacaataaggggaaaaggtatgagcgatgagcatcttcatgatggctgtgacaatggttcccaaactgtccatgtgtaataggggagggcagtatccctgcttgttaaattacagatatcctaagcaccagctccaaggtggctgtcatgagacaagatttattttactttagaattcattacaaagatacacccatacatttttaaaattgtttataatttaattggtagttatacctttctacttcattcttcaaaattaagtccattttgaacagaagaagtttttttcattgaatgtgatctcttaataattctcatattgtatcaatttaaacaaagacttccaggaagtggtaaaagattttagcacccttcccagtctacattcttcttgctgcagaagagccacttatgtgtcagcgaagtttagtgggatgtctaagattaccgagcaaagagaaattgagagattcaagcctcttttttgtttgtatgtttctatttataaaattcttccacgccactacatagtcacatagtcaatttggattgttttttacttgaacataaaactgaatggaagacacagaggaggtcacactgagaaacttcctttattacctttaaacacagaagcagattacaggacctggagcatcagcagagccatgaggcacagggccactgaagaactggctctgctttcagcttgcctattttctttcttttcacgtatgttttcctttaaactgtaatttttcacatctgaaaatgttatgtatgtaatggactttttcatttgttagctaatatgcctgcaagagtgtctcctttttgcagaaaacacaaactgcttgcacttaataatatgcagcatctgaagaattgagtaaacacattctgacacctccttagcatcctgcaatactttaccccaaacaccgagaaaacatgtggaagaggacaggtgaaagtgagttactgagccattacagaatgctgaatttttctttcctgggaaatgtacatttctattcaatagcttacatcttagaaggaaacttaatgcttaaagaggcaaagttaaatactaggtgacccacattaaggtggaaagagtagtggagggcaaaaatccaattacacaatgttggagaatcttttactaagtcaaaaggactgaacagctagaggatgaattttaaaaatgacagatgatgcatgcccatattcttgcagacttctacgaataaaagagttgttgagaacaagtttctggggtgtataatttgcaagcattgcaaggttctggcaattacaattaaaagagattgaagtgatctaacaaagttattgagaatggacctgcaaatgagaaatgataattcagtccttttacttaaagacacaagtctactgatgactggtcaattttcaagcaggagcaacagtagcttgagagaaaagtgtgtgctgctgtcagatgcgttttggtgccaaaattgttagataatgtgtttaaatctaaaaaaaaatgtttagctttcctgcacaacagcttagggttgtgtagttcataagttttatttataggtaggctatagagattatgccagaaaggaaggtttcaagaaaaatttgccatttatctaatgatgctgaagtttggatgtctaaaatcatgatgtaaaatagatgatattaatgggttgtttataggtgaaaagctgtgccttgtccatctcttggctttttcttgtgtttggcatcaatcttttaaaactttttgactagaaacattcctttaacctgtgacccccatacacattgtcctttattcctggacatgcctttgtatcatctcctccatctaaagaactccagatcatgtttggtcttgtatcaactcgtttcaagctagctaataagcccagaaaaaataatcttgaaatctgttattctgttctaacagacattcttctacccagtgcatgtgctgggtataatttcttattgatttggtcagtagtataggaagaaggaaagataagagtatgttcacttgaaagctgtagctcttcccatatccaacaaggagaacggacattttacaaaagattccagatcggtgaggtggttctgctttaggatttataagatgtctgagaataaatgatagttataatatttatcattgaaatttgaatcctctcgactacgaaagaggtgtactgatatattagcaagcattaatttatctatcaagccatgttctatctaatttaacaggatcatatgcctaatctgtcaaaaagaaagaaagcatgaagaaaggaaggaaggagaaagaaaggtagaaaaaagaacaaaagaaagaaaggagagagagggatggagggagggaggaaagaaggaagggagggagggaggaaagaaggaaggaaggaaggaaggaaggaaggaaggaaggaaggaaggaaggaaggaaagaaggaaggacagatctttaaaaacaatcaaggatattattttgggcagataggccacactattcaaggcgttcctccttcctgttaattaatgggcaggatgaatagcacacaagcagtggagagcaaacaggttctccagagaaaaactttgacagattagaaaaggatgcaaatataagaattgggatttgatgtagtgaactggctacagagatgcgattcagtcctcttttgagtaacagaggggactacttacagaggaaagacacatgctggtaaagtggttaactatttgagagtagtatatttgagttaattataacatgtgcctgactttagcacagccatggagtagtggcatctatagttctctgtagtcttcagctttaatactgacttcatacaagtgtttgcaaaaccctccctttcctgacttgaaatgaaacatataattaatgttatcagcctcataataaactattgacaattagaaataaccataactgcttaactgtaataaaaggaaagcaattttaaaggtacattgatatgtaaatggaccaactcttccagtgtagaaggtataatagagccttcagatgcctccaactccactgggagttgagttgtgattaagaaaactgcaaatgcaggtatcttagatgtcactgctgccttaaaaagcttgagtaggaaggacatcaggcacaagatatttttgtaagttttgaacagttctttgcagatctctgaacaatatagaatatagtcaccctggatatacaagttagtacttcagagaagcttaatgtgtttttaaacttgtccaactcatgaggttgcattcatgagagaacaatgtgctgtgcttcatagtatttcatgccagaaaaaattggtcttgtatggcctttatggttgtaggttgttggcactaaattagtttgcatggtggaaacagagaaaggcagaatcacacagagagagagagagagagagagagagagagagagagagagagagagagagagagagagagagagagaagagagagagagagagagaagagagagagagagagagagagagagagagagagagagagagagagaagagagagaaaactaatatgtgtttatatgtatgaaaagcaaaattagcagatttaggctacagaaggaatttcatgtttcagtgtttgcttttagtttatttctttttctttggttgtgttttggttgagagaggctgtcactatcttggctaagaatacaattcactatgtacagcccagcttggctctaaattctttatcttcttgccttggacttccaaatgatggtgttataagaaggtattgctaaatccaggttcagcttttcatatcttcaggttggaatttttttttagggtgttattctttttttattttattagatattttctttatttacatttctattgttatctcctttcctggttttccctctgaaaacctcccaatcccctcccccttcccctgctcaccaacacacacactgctgcttctgggccctggcagtcccctatactggggcatagaatcttcaaaggactaagggcctcttctgctattgatgaccaactaggccatcttctgctacatatgcagctggagccatgagtcccaccctgtgattttttttttttgtcccagggagctctgggggtaatggttagttcctattgttgttcctcctatggggatgcaaacccctttagctccttgggtactttctctagctcctccattggggaccctgtgctccatccagtggatgactgtgagcatccacttctgtatttatcaggcatgataccatattttaagcataatttgagtgtcaggcagaacacatatacccaacaattttagacatccaatgagttctcaaaaatctaaaatgtctctgagaatcaagaaaatatgtaattgtaaatttttaaatttaaagtgtgtagtatgtagttttaaataaaatctgcaataaatccatctaatcagcattggtggtcttgcccaacccaaaggctagctcaatggttcactgactgggaattgaacttggccagttcctgtggctagcttgataaactaaccaaaccagtttaacctgaaatgcctgaagcttcagcttgcatttctcaggccatgcacctggggttggccttcaggacaccagctaccactcactcagctctccttagccctgtaaaatgaaaacattggagacttacaccagacagatttataatggtagatgtccaaccccaaaatgcctgtgcaaagaacatgcaactcagttaatacaaatacaagctgcatgcctagacagggcaaatcgactctattgctcagctatgaaatccctagctacttgcagttcatccaggccatgtggatctgctccagcttcccctctgtttcctctatcttctattccctccatcctccatctcttcttctctttatcccccttctctcccttctccaaaactttcagttctgtcttttccttccactacccagtcgcaggcactagcctttatttgaccatttaaatttttacctgacatcacctgagtatgtgatctacttctcttctgggcacccttcttgagggagcagaaaatgcaaacaacaatgcacataaaaagtaaattatatttttctgtgtacccaatgttacttaacattttcaatgtatttttgagagatttcacttaaagccaatttcaatggtttcagtccatcatacaaattaaatattttagatttctaatcctgctttacttaattttgtgaaaaatttcagggaagaaaaggtcacagaactctcctggttttgtgtattttcaccaaaaaaaaaaaaaaaaattaagatcatgtagtcaatatgaatttgggtaaaactggtgtgatttaacttttttgaacaaagaaacagacccagacaccacacctgccagttgtgtagttagagatcaaagcaataaatgcaagcttccattgtaaagggattcagagttcaaatagaatcccatctctagggagttgataataatcccattgactgatcaactgagatattatgcaaatttatagctaaaaaattctcaacaattatgagacattaccaactaggatttttgtttcaaatcctacctgctaagaaaattttaatataatcaggaataaaaaatgataaaatactacacatgtaaatgtttatttatatatgtttttatatacctacaaaattttgtctatatgaaaactttcaatcttaaaaaatcttgttttataatcataaattcatacaaaatttgttaagcaaacattaaataatcttttcagtacatattaatcttgtttcttaagttgtgttactaaacaaccatacaatatgaactctccactaagatctctaaggacaatagagggctgtttgccacatatacactgttggaaaaacttttagaattgtactaagttctgcactcactaaagccaacaattcctttcctggttattactagcatctgataatcactattcaactttctaagtgtataaaatcttgaatttattattttcttcacaaaggtataaacagatgttatctgcaaatttttatgtacattgaaacatttgacaaaattgttcaaagctatatacattttcccttctatatgtaggtcatggtatttttttgtttgttatatctgttaatgtatgaatgggcatttaacttgttattcctcctgtatattgcaaataaagctgtaatagatgtagtagtagtatgttttcgttatttttctattgctgtgataaaattttgtgaccaaggcaacttttataaaaagtttataaaaaaagcatttaattggtcttaatggtttcagaggataaagtctttgatggtgaaataaaagtgtggcattaggaacaactaatagctcacatcttagcccacaatgcagaagttagagcaatcacactgggaacagcaagcacccaccccactcaaacagcacttccagtgaagccacatttcttcctttccaagcaactccaagtgttgatgaagtgttcaagcatataagtcagtatgtgcaattctcacttaaaccactttatagtgaaaatatattttgtttgttgttttgttttgttttgtttttgttttctttgagacagggtttctctgtgtagccctggctgtcctcgactcactctgcagatcaagctggcctcgaactcagaaatccacttgcctctgtctcttaagtactgggattaaaggcctatgctaccatgcccagatgaaaatattattttttagaccctaatgtcaaatactttgaaaatatctataaagaagattctgtagggttatacacggattccattttatttatttacatttttttttaaaactctggcatatttttcacagtggctgcaccatgttacatttctaaaaaatacaaaagctgtaatttctttttattctgaatagttttttctatgggttttcgttattttgaaaataataatggtaaaaaaccacatgaagtgatatcttgaagttttgccagttcttactaactcactattttcaccatgctttcatgtagggcttgactctccggatgttttcatttgagaattgtcattttgtattctttgccatgattttcaatgggttgctcattttcttgttttttacttacacgagttgttttatatgttttgttttgtgactacttatcagatgtatgtttacaaatattgtctcccatcctgtagattgcttttttaccgtgttgactgtttccattactatgcactagcacttgactttgatatatctccattttcttactcttatttttatgcccatgtttctcttattgtatcccaaatattattgccaaggtcgatataataaaactttcccttttgttttcttttaatttttttttacattttcacaccttacatttaagtcatctatgatttaaaaaaatgagatatttttatgtagtaagatcctttcttttgtgtatacacaggttccttaatataatttattgaggacactctcatttccccattgtgtagttctagtcctacgttgaaaatcaatacctaacttccttaatgtcggtttcatagtgctttgattactcgcttctgtaattcattttaacgtctatcatttgtctcccaattgtgtttcaaacatcacacattctttgtggttgactaaaaaccttagggcatttttaatatttgtcaaataatgctattggcatttggactgggattatactggttatgggttgctttaagtacaattaataactttttaatctacaaacaaaatcaaaaggccccttcaacttctttccctggtcatttttcatctttagaatttaagtcttgcttactgtgttgattttaatgatacttcatatgtgattatatttcaatatctggtcccaagtttgtggaagtgtttggaaacagtcagagagtgcatcattattgcagaagttattttactagcagtatgcttcccattgtcaaaactctatccaggcccattcttgctctctttgcctcatatctgcttcagatgtaaactatcagctctatgtggtataaccaatgagttgattttcctgtctgtttaccccaggtataattcccacatacctttcacatcttttctagatatgaacgttctttgaacatctgtgtataaatgcatgagagattgttccagttcttccttcaggatctaccactgctgttcattctcaggaatgcctgacatctgaattacagactctttgcaagtcatccaagtcatgtgatctcatgatgctctccctgagcttttggcttttagaatacttcaggtaccatcttttttgttttagaatacttcaggtaccatcatcatttgttcctgaaaccaagagaacggaaccagttgtttcacaactccatggcctctcaaaaatgacagatgtaggacatacactctattaatcttttttcattatgaaaaagcctagaaagttatagctgatctttgcctgtagtgtcatggaacaatagcaagccatctagacctttggactatcatccttttgcagataatcagaataaagtacatactctgcatacttcaaagcaggaggtaaagtactaggccattgcaagctctcaaggaaccaaaatatggaacatagtttccaatcttttcctttggtctctcttcttctttcctcaatcttcttttctcttcttctctatcagagtacattgtcttagtttcttcttgaagttgaagattagttaattaacatcaattctaggtttgttttatctgacaacagttttattttcatcactttgctttgcattattattattttaactccaattttacaagtgtaaccccaatgttacaattacaatgccaagaagtgtaaaaataattccagaccttattttagcacaattcacaattctttctactctactatcctgttaagtttatgattgagaaattgaggaaacattttcatctgtaagtgttagctttaattatttctaatttctggccttctaaaaaggcataaaatagaaaggatatatgagctgaaattaaatccaatccactgtaactactaaaaatatgataatatgatttaaagcaatggcagctaagaacagtgaggtgtgttctctgtatgtatatttaaaaacaccatatgggctgggcagtggtggcacatgcctttaatcccagcacttgggaggtagaggtagtcagatttctgagtttgaggccagcctagtctatagagtgagttccaggacagccagggctacacagagatttactgtctcaaacacacacacacacacacacacacacacacacacacacacagacacacaccaccaccaccaccaccaccatatgcatgttttaaaatatcatatctcaaaattattttaataaatattcaggttaactctcaaattagttctgcaatatttagttttggattagtcacttatgattagataaatttttactgatttctactttcatatttatatgtgtgactaaaagtgcatgcaaatacacatagaaagatttaattcataataatcctgtgtcagtacaccaatgattcagatatgtgacaactaagatatctgtaaacttattatcactgttggcacatacatggggactttatacagagtaaattcttatgtcaattttcagaatatttatttaattttattcttttctataaatttgggactttgtccagtagaagccttcacccctccaactgcaacatccattatctgtaaattttctagttttggcttatcctaatcacatgtgaaaattgtattgaaattttaaataaattaacttagtgaaagtttatttggtgctatacaatgaaccaactggtcaaaggcaattacctggttctgtttttcaacatgtcctagagaattggtgtgcactcaggatgcacaaagtctataagtgcgctcaagtctgtgctgatttttagccaatcttctcagctcagaatcctccctttttatataaaccctactaagatactggattttctacattagcattcccagttagtgtctgtacaccttgcatgtaatgtttccgggaattaaactaacttgaatgttaggatagatgccaaagcagttggtcctcagatgtgactgaaacacaggaagaaaattttggcagaacatgtttcttttaatgcctgctttggcaggtgctcagcaatgcacttcaattcacatatcaatctagaaatgatgatttctctagtaattatcaaacgctactgctggtgcactgttttagaaaaaggctcgtgcaccagtggctttgtgatgctataatgacaaacttgatgctgacaggatacatctgtaccactagtaactgttttcaaactcatttggcctttctatttaccattctttctacatactacctgtggtcttctttttatttttcttcctatggtctttactttatttcagtatttcacgattttggacatttaagtaattaattttagttattttgccctccccattctcctttctaagtcttcttttattttgtcttttaatactttctccctgagcttaattagggttgtctacatgtgaatggggtgttacctactggttcaaagacagcttattaatggctacactatcgaagacgatgacacccatactctaacaactgccaattgtttttaaaaattatgagacctcatggacactcctccaatgatgaggagtgttgacaagtttaatcttgtatatgccttctgttgataatattagctgcattgagttctggccacatcatgccagggaggtcatttttttttttttttttgctgacatctttgtatattcttgttcttacaacattttatccctttcttaaagatgctccttaagttttggagggactggtgtaattgtttcatttagttattcttggaactttggctaactgtatttttctgtaataaccacagtgaactgagaagcttctctcaaaaaggctggattggaggtctctacaagaaataggtctcaaataccaccaggacaaaaatggctatacatacaactaacactccacaggtgcactaaaaggcttttatttcttagaaggccattctttctttagcaggattcagagcttagtaaggctgttgataattacccctccccccatccccacagcagactgagtagtattttctcccactacgaagtttatctaacagtcaagaagattctatatcagctccaggttaatatcttaatagcatatgaccaaggcatgtaaagttattcattggtaggagttaccatcaaatccatcagtcatatttttttattttgagtgactttagggtcttgataacaagatcaataaaaagatagtcagcttgtcttttaaagatgcatggcaattatgtatgcatgcatatgtgaggggccacttacgtacctggggacatgtgtagagtttaggggacagcatactgaagtagattcggtccgtctaccatgtggatcctagggattaaacttaatcaaggtaccctgtaggtttccccagctgccttttatcattgttccgctgtagatttctctttacttttgaattttgtctgagtattttttttttcatgagaagttacaggtcaaacagatgagcggacaagggaaatttaagaaatgacaaagacatataaaacatataatcattacttccgtttaacttaaaaaaaaaaaacaaaaaaaaaccttttctgactactggagtgctataaagtaacaattaacactgtactctgagctttccctaggcctagaagtttgtttacaagcagtgccctagttataatatgcatcttctctctttcttaccccttttacttttccttgtaggcaatcagttacctagctataaagggactccatttttaaattaattaaaaagaagatgaaaggagagagaaattatgtcagttgtttcctgtgttgaggtggtgcttatgaattagcacatttttaaatgtactttcctgtatacatatactgagcacactggacaagctccccagataactcttcctctggaggtatggaacaaccttaccttcccattgcttccatgcaagattaggtttatacctacaaacatcagggtgagtactatgttcggaatattctgatgaagataacaactctgtatctatagtaagtttattctttcagaaatatttgcagggattctaaccacacatgtgatagtattatgaagtatgtctttgataacaagattgactttattattaccaagtttcttctaccatgtgtgatcacaccaagaagatcgaacttatgaagttcaactggataccatatacgattgctgatataagatttccaagatgtcaagaaaagtgaaggactgtgatactttgtcaaacaaaacaaaacaaacaaacaaacaaaacctcatgatacaaacaagttatatggtagacttaatataaatttaaataaaatttaagtttaaattcctcataatgtattgttttcttaatctcaatatttattttctacctttaaactccctgttcatgtggatcttctctctttttgtctcttttactgtctttatctctgtctctcttgattataaatggacttttaataaactctattagttattaataggacccagccagcataccaataaccaggacaaagtcctatgagtttatttaattacctcttgcacaatgaccccttctctatttttctctaacttagactattaattcccagatgtgctccacaaatgcatctgtttggtctcgccttagttgcttcttctctagcagtctgtcctggggctgggagccatttctctcaggcatgtgctcctcgtctatcacttctaatggagacttcctgttctctctaatattcttcctccttcattctttctctccatctactttctccttcctttattcacccagccattggctgtagtcaatttattttaataaatggctttaaattgcagagcaagatttacagagcatcacttgatatccatgaggctgctcatgggggaagggggtcaaccagatcttgggtccagtagcatgtgaatacatcgcagcaccagaccaaaccctaacacttgatctttcattctctttcttttcatgtttttgttttctttttgcctctttcttttccttttaaaattttcagtagttacgatggaagaaaacagcaaacttcccacattgccatcagtgtacttactctctggctaacagaaccaggcctcttagaaagtagcactcattttcacttcggttgttttctcatgaacacaatttgcacacgtgtatcttcacctgtatccaagctctccagagaacacatgtctccaactgggatttcaaatgagtttataaagtaggaacacacaatatttgtacctgttaaaatatttcctgagaccagcaggaaagagaaataaaggtcctttaaaagttccccaaagtttgttcactcatagttatgtgtaatttttatttcactatagaataagcaatagtcaaatgcagtaggatttcagttctttttagcataaagcatgttaagtgttctttactatgaaaggcaatatgcattatttagtaggacctattttggtttttttttttttttttttttggatttgtgatagaaaggagagccatatccccactagtcaagtacatgatgactgaattacattccttgccctcaatttttagtttttgtttcataataaaagtttcaccgaaattaccatactaactttggcctcaatttgtaaaacaagaagacccttatttacagttctcttgcctcttgtcttccaactaattgggttacaggtctgtaccaccaggcttggctctgcttctgccccacataccaccagactcatcttttaagtaagtcacattatagtcataaatcaaaaacattgtatctatgatttaaaagatagatttgacatgtatctacatatcaaagcaattttgttgatgtatgaaatggcgaaatgatgatgataatgatcataagctgaaaagaaagacattgaagcaaaacagatgtggttatagagtggtttctgaacatagttgattagcagtaaccacctggtcaattttttttattttttactactaagcctgatttataactggcctgcagaccattggaatcagaacttctggaatgcaagcataggtgttatatattcaaaaatacccatgtgcaggggccagtctcagctatttccaggtctcaaagaggagataaggaactgtaggagaaagagagaatcagaagcagtgtatcctaggaagagtcttttaacctgatctgcgaccaacttctctagtccagctatccttgtttatcttttaatgttacgttgttcttaaattgagtttacatgttcctaagtagcacaggtgcagatgttttaagagtatctctagtcagagacttacaagggaatcctggcattgatatttgagtcataacttccagggtgtaaggaagaccttcaagtagggccacataagaatagctctctaaaagagggaagggtagtgtgctcaggcctttctttgggaagtttaaaagcagtattcttggaaatacataagtgattcataatccaatatccccaagttgtacaaatattaacagttcctccacctcccccaagcatggaacaagattacatcatttggctcagctttgctggatccttgtcctgcatctgtgctttctctgtttagactttccctgttctctgtagacatggctgtgctacccatgcataaactgactccacaggagaattaatagtaaagacagaacaaataaagaaaaacagtttattgtatacatgccacgtagaaggactcatatggcgaagaaaagtgggtagcagttgaattcagtgctaagaagggaacactcagcaagaaaatgaaaaaatactagatgtatagaggtgtacaaaacatgtcatggggccaggcagtggtggtgcacacctttaatcccagcaattgggaggaagaggcaggaggatttctgagtttgaggccagcctgggctacagagtgagttccaggacagccagggctatacagagaaaccctgtctcaaaaaactaaaacaaaacaacaaaacaaaacaaaacaaacaaacaaacaaaaaacaaaaagcatgtcatgggttactaaagttacatgttttatgggaatgaatgatttttgatgaagaacaaagaataaactttcgtaaactatgtaatatgggtattttgtggctagtgaatcaatgaagaattaatttagattgataccattatatgctctgtcctatgcctaacttttaaagacagctttttaagagagtagaggccacattggaataaaactgacaacataatcagaatgcaagtaatagtcctcttcaagtgggcgtagcaaagaaaatataacctgcatttttatatcagaaaaaaattaattttaattttttaacccagtcttcagctttccatatcaaggtaatatgatacagggaaaaccaaataagatctttcttggtattgcctagctctgttatttattcacaggtgatccaaaagtgttaatattcttgcaaagtatgagatccaagttccaatgtcatccttagaaggaataaaggacacatctttttctggattttagatgtttgaaatatccaggagacatgtagtaaagatatttctccataggacgctatgggtttactggcataatcttagtaatctagtcatagtcttctagggaatatcatacttttgtggcagagagaggaagcaaaccattgctggctaaaaatttagccttgtcttgtcagaaaatgctttttataattatattattatatacataggatagaaacgaagcagaattgagggataatacaaattcctgtgtcatcctagagtgtgatacatcctctgcatgtctcaggtgtatcattaaatgaaataaaaattccttcagataaaagttttatcaggatcaaaaaatacaattatatctctaaatgatttaacagtacctagaaaacactgcattgctaaggaaagtttcagtgctagtgcctcttattgttttctttttaattaggtattttcctcatttacattttcaatgctagccccaaaaggtcccccatacccaccccccaatcccctacccacccactccccctttttggccctggcgttcccctgtactggggcatataaagtttgcaagtccaatgggcctctctttgcagtgatggccgactaggccatcttttgatacatatgcagctaaagacaagagctcctaggtactggttagttcatattgttgttccacctatagggttgcagttccctatagctccttgggtaatttctctagttcctccattggggaccgtgtgacccatccaatagctgactgtgatcatccacttctgtgtttgctaggccccggcatagtatcacaagagagagctataactgggtcctttcagcgaaatcttgctagtgtatgcaatggtgtcagcattgggaagctgattatgggatggatccctgtatatggcagtcactagatggtccatccttttgtcacagctccaaattttgtctctgtaagtccttctatgggtgctttgttcccatttctaagaaagggtaaaatgtccacactttggtcttcgttcttcttgaatttcatgcgtttggcaagttgtatcttatatcttgggtatcctaagtttctgggctattatccacttatcagtgagtacatattgtgtgagttcctttgtgattgggttacttcactcaggatgataccctccaggtccatccatttgcctaggaatttcataaattcattttttaatagctgagtagtattccattgtgtaaatgtaccacattttttgtatctattcctttgttgagggtaaccaaacgaggagttggttctttgagaaaatcaacaagatagataaacccttagctagactcactagagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccatctaaacagtcccttatcccctaaagaaatagaagcagttattaatagtctcccagccaaaaaaagcccacgaccagatgggtttagtgcagagttctatcagaccttcaaagaagacctaattccagttctgcctcttattgttaaacgtataatgtctccaacaagctcaagtgtgaattcatggtcccaacctgatggtgctatttcaggagggagaaatattttggagacaatggttaggtaaacaaaatggttcactgaaaagatttaaatgtgctatacaattctggatctggcccaacaccctatttccagattcaccatgatgtgatgaactaacactgttaccagggctttggccgtgttacacaaaaccacctcagttatagactgaaagccactctattattagacaaaataaattcttcctcattgagtagtttattaggtatttcattatagcaatactgaagataactaacaatgtgaccactgagtggctacaaagttcaaaacttaagtccaaatacttctgtagttcttaaattttggatttctttgatgctgtttctggttcatctcgcatgctatatacaaagatagggcccctgttgagcattttctacttgactaaaatatacgggccctgtcatttttcacttatcataaatattcatttataaacttataataagggttggtatattttagtcccttctctactagacatagataacagttatttatctagcatcgtttcccttggggccaaatgttttgacatagagcacattaggcaactcttatttcgttatttatacttctacactaaatcctcaggggtttctatactttaatgaatttattttgctttagtgtcactatttctgcctcttttatatgtcatcatttattcatatactactcattcctacaaatttttgccataatcatattctgttctaaaatccattatagagataatgaatacatctctataaaatacctatctgacaacatctagtattcatacttaggtagaaagcatgccatgtaaatagatagtataagactactttaaagaatcaggagcatgataagaaataaagcaagatactttggtggatagtagcaagatggaagtagagaaaagtggctcataagaagatttttctaaggggatattgaagccaaaacttccatctaagtgaagagctgtgggtggtgaggcaaaagttttacagatgaatgtccttagccccgagtcttctatataaatgggaaatccagccctgccatcaaaatacaataagaggacatcataggcagtgttagaaagatatgcagccatccatccatgtgccctgaaaggactgaattttattgtgaagcctggataagatccaatactatcttcattctgatttctccccagtgtggtctcatcttttagagatgagactgcatcctgtgttcattttcttgtcaatacctgcccagcatcccaacctcacaaattcagagcaaagtggatgccgaagaatcattctacagtcattttcactgcatgcacctttcttcatgctggaacaagcaccctagcaacttttctgttcaagttcaaatatagctacatagaaaacatgcatctattagaaataacactgtttacaattatgaaattaactaaggaacacagtgtgaagaaaaattgtatgtaaatatatgaaaatggctttgattatttagtatattaaataaaacaattatcattgagtatgtaattaatcaaaataagattcataaaataaacattgacagggagattcaactcagtaaagagacagtgcaaaacatcccagctggacttgataacaatagaaacgctcatcaaggctgatcgtttttcatctgctgtttggtacctgaagtgtttaaatgactattatttgccaagaactatcttagtgctttgtcagtgactgaataatagaattctcttttttgacctgtgtattcgaacttgaatgcttcattataccctaaatcaacgactgatatggtaaagcttgttttatgtgtgttcatttgttggtttttaatcttagccattttttggggtctgagaatgagtcatgttttagtcatttctcggttgacgtaaaattcaatgtctttgacaaggaagttagcccacctgaagattcaaagatggttaccattttcttctggcacatagggagaaagaaaaaatgatgctttaatttgaccgaaagatagacacagaataccactccaaataaccagtcttacttgtcctatgtgctcatccacttgagtgtctctccaatttcagaggaaagtttagcaaaaagactgagagtcactaataaatggggttcacttttcagattatgtgcctaaaacagtaaaaacgactttcagaattcagtgacacttagattccatgattctcctgaacctcagttgatggctatgtcatgttttcagagataaaaatagggacaccgttggctacttttatttatggtattgggcctttacttatggtctggaaaatccgccccccccacacacacactgatacacagctatgtaaaaaattgtttagctaagacaaaagtcacagtgtgttgctgctctgacaactcaactctggtaaaggcagaaagctaaatatctaagtaacaatgtaactctctccaactccaacactctgtgcttaggcactctgcttctttattgaagaaatttaaagaagtgaagtccatggtggcaatgggttccttccttcctttaataggtttctcatattgctttcataccacattgttgtattttacacaaactcagtatctgtggcttaaatgatggcaggtggtgagtacagttttagtggatttatgcctaagacaataaatattgtccaactataaagacaaacttgaacaagacaaggatgcttatattcagcatggtagaactgagtttaagagcagacatatttgtacatgaacctagggactaccaataagctaatccatgcaatgttagatgaattgattcattatcttttgactaacaattggtttgtggattaatatggtgcacaactttgaagaaagtcattaacgacaagtacattgaatgctaaccagactaaaagcctgcaaccaaaatgttaattgtcttttttaatagctatatcctgaagtcagaacttgcctaaatgtaagcataattcagacaagtgtgtttcctgagctgatgatttttaatgtgagcatacatagcactgtgaatcttagtctccaagtttattaagccatatcaagttggcatcttcaattttaaatttatcactgttgtttttttagacataccctattctgtcttgttaaaaatagacaccgaataaaaacttttagattttcatgatgtttgtacaaatgttttaagtttgatttctatcttgctagggtaacaagtaacttatactttctgttccttagaacaattcccaaggtctatgaaatgggttctgagtttcatattgataccatgttaatgtcattgtttattcatcccaagagctgagacaaagttttttattttccctacatgcctgatactttcatgtttgataattatttctattctatactggtattacaagaaacttagtgaaaaggaacatgtaacatttggagctgaatgcattccacagccagtctcacatgccccgtggtcttggctattagggttctactccagaaaggtgttgcctttcctctgccttgttccaagctcctccgcttcttctaacaaaacaccccttctctcgctctacctaaactaaaatatattaacaaactgataataactttgctctttacagaattggagaaatatatcgtctatttcttcttgtcattcttttacctacaaagagtcagttaagaacaatggcacttttcaaaacttgaagaagacataaaagcaaagaacaaaatatttgacaacttagtattttgaaatatattgatctcttttattactttagtatcatgtaaatacttcatcaaagtgtgtttctgggagaaaataaataaaagaaagaaaaggaaaggaaaggagaggagaggggaggaggggaggggagggnnnnnnnnnnnnnnnnnnnnagaggagaggagaggagggagaggggagggaaggggaagggagggaagaggaggggaaagaaaagaaaagagaagagaagagaagagaagagaaaagaaaagaaaagaaaagaaaagaaaagaaaagaaaagaaaagagaaaagagaacagtttctagcaaagatgaagaagttaccagttgaggggagatgaaggagaggaaggggcacagaaggagaaggttgaaggcacatgctcctatgaccaacaatattggttcatgtaaagggcactgacattttttagatgacttattttggttcctagtaccttgctatgtataatttttgcactagactttgctttagatagtgaaaattctctattgagacattttgtaccactgtagtatttttatattatactaagacagtctctctattttcttgataagactaacaccttaatgctcagataccacgactaatgataaattaatgctaattttactaaatttataaaattaagccttagtttaacctttctcattcttgatcaatgcttcatcattgtcattataggagaatgtttgggaaaacatgttgtgtggctgtttaaatatgttaagaaagactaataaaatgggcaagcaaaacatcacacattctttgaaacttactatgtaaatatcaggtaactatattataaagttgaatttattgctatccttaagttctatgtttataaattttatttgggatctattgtattattaagtatttttagacagtttaaagtaaactagttttggtttatttattttttaagtatctatggaaatacagatattataaatgaaaacaaaatggcttgtcattttgaaaattgttcataactaatttgcaggactgaatacaccagaagttgccatatgtcagatatcaggtcactatttgcactttttgaattgttttacctctatgcatatataaataaccactttctacatcacatataaggatcgaaggatgataggctctctctctctctctctctctctctatatatatatatatatatatatatatatatatatatatatatatatataaaacaaacaactttctacatcacattctgggagtttagcaagtgaaacgtgtaaaatgtctatctagtaatatccaccttagaggtgagcaatgggcctttactttctgatcctcattttgagtgctagtaggaaagcatcaaggggtagtggaattggcacaggagctctgtgggagaaaataaaaatcaaactaaatctatggaggtattagtagtgcccaaaggcaaggtccccagaatctcccagctcttgttttctcagccataaaatgagaatgattgttttacctcccttgtagtgcagtaatgaggattatgtaagatggtgtataaaatgagcccggcgcaaatggagaactgggaccatagcaaagagttcataaaaattagcatgttatgtattgctcagccattagagttgtctaagtagaaatgttattatagtggaccacacacaatgccatgataaagtgctagtatggtgatgaaaggttgaagagtagaccaagaacatgaggttgaaagtgacctacatatgatctgagcttccaaagcttcagcaaacagcttgttccacatttttgcttctgttatgttatagagttaggagaaaaaactcttatctgcataaccaaaatagaaatttgttctaaaattatctttgattcatcttcatacataaattgtttcgaacatttaactacatctgattggtactagggtttaatttcaattcagaagtggcatgggtttttaaacagtttgaagagttttctgtctcaatatgaaggagacagaacattcacaaatgaaaatgcacccccatgttactttatgaacaggaaatacatggtcagaaaatcctttaagcatcatcatatgtagcaattttattttccacataggaaaactgaattctagaatgatcactgttttatacaaacttacatagcaattgagaataagaactgagcagcaactcccaggacaacagtttcactacatcaccacatccctacacctctgatgtttcttatagctttttcattaccttttttgtaggtatgccagaaattggcacatgaataatttatataaataatgcatatgcataaaattagtcattgtggcttttttaagtgaaagaaattgtgcatttgtggataaacatatgaaaagggacttcatatgttcatgccatgtgggtgtctgtgtttgtgtgtgtgtctgtgtgtgtgtgtgctatatattatatgatatctaaaataatatatgatttttaaggctttttaaagtaaaggtaactcttaaaaatgtgtacttcattcctgaccctatatactttcctcggtcaagtcttcctaaactatcactttgtttgatgtgtttgcataacatctctatctgctaatacactgttcgtccagtcactagagctcagcctctgaaaactatctctgcataaatggtacctgccttgccatatttccagttgagaaattgtaatttgtattgattagtaaattttccctattcaaagatatcagaaaaccccacgagaggcagaatttcttctatattagttcaagagcactcttgagaaaggaatgtgttttcagtaagattgcactctccatctgaaaaaggatgaagaatatcctgaagcactgcttaaaatagatcgcattctctcatagaaagggaagatgcaccaggcagtgatggctcacttatttttaggtagtaggactgctgagtactttttactagctaacaacgataaaaataatctgtgtctactaaagtgtggaatctggaaagagcctgacccagtgtagagaatgtatcacctgatgtctgcttaaattaatcaatgaaactttctcttggttagggtcctacctatgaacattcaaagcatttgttttgttttgttgtgcatcatgagcacaagatggcccaactagtgtgtttgctttatttggaagacacagtcattctcaaagtgtagttctgagactagtaatgcctacaaacactgagtccttgaaacttgagaattctctgagcccattacaacttcatcgcttgcggactttgaagtgggactcagaatattaatagcttgtaaattgaattagtgtttaaaaatcacccatgtagttaactataatctatctcttttgagtgtaaagcttctctgtcccctgccctagataccattttctcaatatgagacagtttggttgctctacttcatactgtttgctacagtgcccattaatgaagtggtatatgacgatttgaatgctcaacacctttaggctcaactaacctctcctatactgtggttttacttgcccttcagagcactgccaacacacagacagttttctatcttcatgagaacctggagaactcttatccaatggaatctccccatatattcagtccacaagaatctcttaattttacaacaggttaatatttttatttttccttttctttcatattgattatgtctaatattataaccacttctttggtttcacttgtcattcctttatgctagaagatatttctatttttttcacattgattcattgttcttctgaggcagtagtctcaattattaacaactgagatgaaaaaaaactattatcatacaataataataatttatataaacatttctaaatttgaagaaactttgacttccaaatacatttgtcatttcaagaagcctttgtgattatcaaaacaaaatgggtaacactacagataccctggtcactgtcatggattccctgaaatatttagattataaaagacagcccatttatgctacacaaagagttgttagatgtaaaattttgatagttttgtggtaagaaaatctggcttctaggagtcctcatataaagcaaaatttaaataaatgttgccttttctacctattctttcaatccatgttagttttgtaattctgaaaggttgggacgctttcagaagttttgttttgtcactcgcattagcaaaggtatgaattcctagccttctgattgacctctgcaattgtcacctaccacgtttccaagtttctattctctgtcttaaacccagtgtttagcttttagtacatagagttaacaggcataaaggaaactggaattgataactccacatatagaaagcaggaatgtgatccaaggcaggcaagagatataacataaacataaggactcttttaaagagaagaaaagaggagctggagagagcctattttatttgcaattgaaagatagttgtttggtaggttagaacacagtgagaaatttgcagagaaaagcagaagaaatgtaaggtttcccagcctgggaacacataggtggacttcccagaaataagcaggcaatggagtggagttagctgcagacatgtaggtctcaggggcacctatagtttgtagcctccacagtgagtggaggtcagtgggatagggcggtaaattccaggaaatgcatttacgtgataaaccatgagagcagtcagagattgtaatactgagaagactgagtgaaggatagatctataaggaaaggaggaggtggggtaagaagaaacctcaactattttaaccaattgaaagttggaaaaatgtcacagattgaaattagcccatctttggcacctaaagcttaggggatattgcagaagaggaggaaggcagactgtaggaactagaaaactaggacatctactgtgagatattgttccccggggaaatgatggtaaggaaaatacattcacaacacctcaaaatatggctaaatgaacaatgacaatatagagacatgctaatgaggaaggggtatctcttagggtcatacacaaagaactacatgctaatcaattactgctgatcgtgggagaattagcttctcagagggatgagcctcttaattggctactcgatacaaagtggtcagcccaaaaaccataataaacataagtcacactaaaccaattaaggagctagaatttatgtatttatgcatgtacatgtgtgaaacaatcataataaaataaaaatactactctggcaagtgaatgaaacaggcatggaaggggtactggagatggtagctgcgaagggatgcaagaaggaaaaggaaagaagaaaggagcatcattccatttcaattaaataacatttttctaaatcattttaaaagaaattatcccatgtgtgtataaggagtttaatgannnnnnnnnnnnnnnnnnnnggtacttctactactactgcttcttcttcttcttcctcctggtggtgttgatgatactactactactcctcctcctcctcctactactagggcaacgccaacatcaacaccccatgatgatcatgatgatgtggttgttcttgtcctcctccacctccttcatcatcttcttctgctgctgctggtggtagtagttgctgcgcagcagcctcatcatcatcatcatcctcctgcgacgtcgtccccgtcaccaccatcatcatcatcatcatcagcaccaccatgacgaaggagatgatgttgttgttgtggtggtgctgggcgcgcaccaccatcataataatataatactactactactactactaccagccgcagccgtggcggtggtggtggtggtggtggtggtggaggtcgcgaagaagaagaagaagaagaagaagcagcatcccccccctcctcctcctccgtgttcttcctcttcatcatcatcatcacactccccccgaccatcagatgatgaagaagaaggaggaggaggaggaggaggaggaagaggaagaggaaagtgaatttcttcagggctggggtggtggtgtcttagacagttatatactttttgggcaatctgtttttaaaaatgcatttactcataatccagttttcttttaatttatttatttttattattttatttacattcaaaatgttgccccctttctgcccccccttccaggaattcttcacctcatcttcccttttcttctgagagagtgctcctatactcacccacccactgccctctcacctatctaacgtcaccatttcttggagcatcagttttctacaggattaagcacatcctttcccactgaggccagacaaggcagtctttattatatatgtagtggggatgatgtatactctttggttggtggcttagtgtctgggatctcagaggagtccggcttagttgatactgttgttatttctatggggttgcaagctccatcagtccttcccctaactcttccataggaatcattgatctcagcccaacggttggctataagaatctgcatctgtctcagtcagatgctggtaaaacctctcaaaacatagccatgctaggctcctgtctgcaagtacaacatggcatcagtaatactgtctggtttttggtgcctgctcacgggatggaccccaagttgagcaggtctctgggtgacgtttccttcagtctctgatcaatttttgtctttccatttcatttagactggaacaattctgggtcataaaagactaacgtaaatgttgggaggttttttttttttttacaattttttattagatattttattcatttacatttcaattgctatcctgaaagtcccctataacctcctcccccaccctgttccctgacccacccacttccacttcttggccctggtgttcccctgtaatgaggcatataaaggttgcaagaccaagggcctctcctcccattgatggctgactaggccatcttctgctacatatgcagctagagacatgagctatggggttactggttagttcatattgttgttccacctatagggttgcagaccccttcagctccttgggtactttctctagctcctccattgggggccctgtgttccatccaatggatgactgtgagcatccacttctgtatttgccaggtactggcatagcctcataagagatagctatatcagggtcctttcagcaaaatcttgctggcatatgcaatagtgtctgcatttggtggctgattatgggatggatccctgggtggggcagtctctggatggtctatccttttgtctcagctccaatatttgtctctgtaaatccttcaagtccttccatgggtattttgttccccattctaaggagggacgaagtatccacactttggtcttccttcttgagttccatgtgttttgcaaattgtatcttcagtattctgtttctgggctaatatccacttatcagtgagtgcatatttaatgacttcttttgtgattgggtttcctctttcaggatgacacccttcagatccctccatttgcctaggaatttcataaatccattgtttttaatagctgagtagtactccattgtgtaaatgtaccacattttctgtatccattcctctgttgagggacatttgggttctttcgagcttctggctattataaataaggctgctgtgaacatagtggagcatgtgtgcttattaccagttggaacatcttctggatatatacccagcagaggtattgctggatcttccagtagtactatgtacaaatttctgaggaaccaccagacccatcccatgggtagcagatatggggatctctgaagtatgctgcctggatatcctagcagagttaatgaaccttgggttcaaatgggaggctttacttcaatatacaaggggagaaagattgaggaagacatagaaagttcatgtctgactgctatatacacaggcacaaagatgtacactcacctcacatgtgtttacaccattggaaaacacacatgtacaaactaaatactatcatatgaaagtaaataagggagtttttcctttaaaagtagtgtaatctttactagagaaaggtattgctttttcttattccttttaatatgtatgaactggtgctgatattttctattgttcaaattgtgcagtatatatacttctcttttttaccagaccatggtaaattccttttcccaatgagctaatcattctacctacatacagtagtatgtttattccttcattctgtagtctaagattatctgtaaatttctattttgttttatagtatttattgtcatttctattgttatattagattctagtaactaggtatgaaatttgatttgataattaaaatttatattggtattatgtatttatttattagttattttgttatcttttatttacatgttatgtatgaactttggtggctgtgtgtatgctgtgctatgcatgtggatagaggtcagaagacagtttacaagaatttgttttttcttccaccatgtgggacttgggaattaaagtcaggtcatcatgtttggctgtaaatcttctgagtcatctctcttgctcagggtatgttttttttttctcaatccatttttatttattggcagagttttatttgtattttttctgaggatatatagagtttcacccttattagttattataatttaaacattatgtattaggtggtgataaaacaatagatcactcataaactttaaattatccagagacagcaaaaattggtgttgacaagaaagaaacacacacagaaaccttgtcaagaatataagcaaggtttaaaacacagtcaactcaactggtagctagactttgaggacaattgcattaatgaaaagtagcaatagcgttagaaacatttctaataaatcagtatggttcaatggctcagtgccctgattgtgttttaatcatcagtattacaagacaaaactcagttgcacagtaaacaatttaccatagaattgcactgagttatagttttcactggaatttctgtagttgaacccattgacatttgatgagtcaattttcccttagtgtaattagcctgcttagatttataaaagcacatttttcatgccccaaagataatggttttaggagagtgaaagggaaaatattcaaagaatggaaacaaaagcagtaggctagatgtacaaaggaggtacacagtgtagaaaaatagcaatattgcttacttacacaattatgcaaaacaatagtgtctgagaggacaaggtcatattaaagtggcagtaatgtttctgaaatagttcatttcagaaagaggagcaatattacagcatctaagttagctatccaaacttgtttaagcacttcatagcaaaatattgaaagtggagggtttaaagtgaaagcccatttttccatctctttatcaaatgaaaatcctgcttatccaagttaagatctttgattatattctcattaatgccagaaattttatcaggtgtagttcttttgaaagtactgatatattaaagattggaaaattgagcatttgctttttaatggagaatgttcatctgtgttgttctgtaaagctaaatatatcatcactgaagtattgtttaaagaaggttagcatatttattttcttattacatttgttgaaagttgcaaaatagaaaaaaaagaatgactattgcaaacgtgttttggaagggggaaacttcaaacataattttatgaaaagaatatatagttaaatgtcaaaggatagtctgaaattcagcgcactggtggggtttaagttattattttacaatcctcttcctaaccttcaaaagtagagaagcagcaagataaaagtcatggcactaaatttatgtattacttgcttttttgatacttaataagaaagtgctagcatactataagtactaaatgtgtgaatgataaataaattaccccaatatcagctataatactagtattctgttttggtttgaatagatacactataaacagctagatgcaatttcatatttcttctcatgaaaaaaaaggctgtctgtaatttaaattttaaattggaaactgaattcctgattgcttattgactggcaatctcaaaaagggaaaaaaaaatatcatagtattttttttcttgtttgttactttttttctttttttttctattagatattttctttatttacatttcaaatattgtcccctttcctggtttcctctttgaaaatcccctgtactctccctcctccccctgctcaacaacctacccactcccactttctggccctggcattcctctatattggggcatagaaccttcaaaggaccaagggcctctcctcccattgatgaccaactatgccatcctctgctacatatgaagctaaagctatgagacccatagctcatagctcatagttttctttggttggtggtttagtcccagggaacactgggggtacttgttagtattcttcttaaaagtcggttttgtattttgtcctctttccttttcaattaccaaaaaagtattctgattgggagcctcagatttccaaaaaagccttaggtatccaatggatctgagaagatgagagtgtcatccatgtagttaagagtattggatcatctagttgaagacttagtacttttactcatttatcctgtggtcctgtcaatggaatatgatgccattggcaaagtaattttgttctagaatagtataaaaatatatcatattatagaaacattatatataatccatctctgttataactctcagaggttgcattgtacctttaacattggatgtagtaaccgtttcctcagttcctgctctgttcttgccccagatatccgtttctttggtggatgagactgaattatgattgacactaggtcctgattcagctctaaagacagagacttccatgcatatactaaaacactgacccttcaagctgaactcactgttgtcttaaagctaagaatctcaggaaacatactgagtgaaaatggtaaacgtattttgctcacaattctgtgacttagtatactgagctcaactactcataatgttgctcactcctacaccagagtttgagtcttttgatgataagagaatgattcaaagtaaacaccagagaagataactaaacattgcaaatgactttacccaagctcagataacaagaaagattccttttagaaatgatcagttagaataatactgaaagaatttaaaaatggaaatgagtaaaactgaaatatataaagcagcatttcttaaagaggaagagcaacaattaggaaacaaagaaaaaaaataactaaatcaaaatacattctagagaacgaaagtacttttttcactgattttaagactatggatataaggtccattttaaattatgtttgaaaagaagaaattgtcaaattattaatgtggataaaagttgccatatagatatcagaaaagaaaactgtatccatctaggaagttgagtgacagaacacactaatttaggtgaggattcaaatatcagtggagatgacacactgcagtccgtgaggtgaaaaaccagggaagggatattttgagagttggagcattactcattctttatcttgttattgtctcatggtaaaattataggaagattacaaatttttggtcatttgatataaaagttcaggagaataaatataacaaaaggtattatgaattaagttagaattagtagagatgaaaaaatagagatggaggaaaagtataacctgaaaagaaaatttaattggtatgaatgttgactagctattgaattatgaatgctttaaggtgtgtttctccaggttagtattatcttccaggaaccatgtgttataattttttcccaccccaaggccagtacctcacttgagcacaaacacacatacatgcacacactcaaacacatatatacacatacactcacaaatatgaacatacctacacatacacacacaaatattaacatacctgcacatacacaacacatcatatcacacacacatgcttatacacacatgcaatgagagacagagacagagtgatacacacacacacacacacacacacacacacacacacacagacagacagacagacagacagacagacaattgggaaaagtggaaggggaaaggaacgggggaggaagataatattagtttttgatgacccttattcaaaaagtctcaattttttccttcttcttcttcttttatttatttatttttttaaagaatgagttttggaacatgctgtgataacaaccaactcaagtatagtgatacttagttataaaataccaaaagaaatcaccttatgactataaaattatcagcaggatccaaactcattttcaactaaatatttgtaattttatctaataaaaaagaaaatggaagattttaaaatgtaccctaaattcttaataattctctaggcatttttttctgataaaatattctttcttacatatatgtgtaaaatgtggcatgtgctttagggttcagttgcaggatgatggctgtattttgcatgttctttcagatataggaaagaagttaggtggagagagaagaatttcaagagacaaaacataagatacaaaaaagattttgtacttaaaatattttcatgcacttgaatatgtacaatatagttttttaacaagaagaatgccatttttctgtttttgaagactaatcttgttctgatgacttgataccaaaaatactttactaaatttctgatgaccaaaatctctccagatatatccagatgcctacctgtcctgtttcattctttaactcatggtgaactatttaatatggtgagtataaaataaagacctgtaacagattataaagtattattgtcaggttcacttgagaaaaatctcagttatacttattacactttcttcttattttccccgagtctcccttttcaaaatcctctctcactataagatacagtctgtgatcattctctgttgatcatctatctcaaatctgcacattaaaaataccgtttgtacacataagtggatgctcacagtcagctattggatggatcacagggtccccaatggagaagctaaagaaaatacccaaggagctaaagggatctgcaaccctataggtggaacaacattatgaactaaccagtaccccggagctcttgactttagctacatatgtatcaaaagatggcccagtcggccatcactggaaagagaggcccattggacttgcaaactttatatgccccggtacaggggaacgccagggccaaaaaatgggagtgggtggttagtggagtggggggggggggagggtatgggggacttttgggatagcattggaaatgtaaatgaggaaaatacctcataattttttttaaaaaaggaaacaagatacctatctgaaaaagaaataaatgctgttttaatctaaaataaaaaaaaaaatacgtttgtagaacaatgaggatagagcttggccttttctggtttttacttttcattaggtcaagcaggtatctattctattagctttaggtcagcagcattagttttgggttgcccttattctaaatgtctaaatatccttctgcctttgtgtaagaagaatgtgacttgcgttatagaaataaaccaattcagtttatatctctcaatagtgttgtataataccttatctttatttaattcattgtgacacatgaaaataatgtgtttagattagttctgttctctaccttcccactcttaactccatctagctacttatacacatctttctcccaaattaacattgttgatgtcttcatcataatcaccaacattttatgttggatagcatatcattagatatactgctgaagaaaagtgtcctttccttccccattagttccacagttagatatgcaacctaatcctaatgagtagatcccctattcattctgaaacattgactgttttgatttcctatacttttcaggaaggcaaccacagaagccaagacttcatgccttaccaatttaaatgcataaagcaggtgaattcgtgtttacaatgcatatttcaaaccacaccttttgctatggcaattaaaaatgtgtgttttttaatgttctcggacctattcatgtgcagcgtacttatttgaagatattgctatagcttcaagtacccaataacagtcatgctttggagcattggttaactagatgcggtagatgtctaatgtgtattgggcaacaaagtagggcactgcatctacacaggtgaaaattataactaattctctagagaattttctctttaaaacaaaggagacagccatgaaaacacggattcataatacaatatgactttgtccttaagaaaggctaagtgagaagtgcttttgaaagaattaagatttctacttatagagagtaaaggaccaaaatagaagacttgtcatgcataaacataaatgttcttatactttttgactttttctgcacatgagggttaaaatgccatataaatctccacaatgagcccaagagcatataataaagatgaatgcagccacattcaaggatcaattagtatgtatagctaatcccctttcaagattgtgttttcaggaagggcaccagacttaagatacaaagaatttcaaaactgtagaggcaagggtctctgccaaagtttacaaaaatcttcttgttggagcacacatttctgtaagaattaaaaaatgactgaaatgttctaaaaataacagctaccagtctcacaaaatagcctggccctatgtttcagacacaccatatcagtgctcaggcctatcatgtttagtcttcatttgttagaaaggctctggctaagcgaatagtcactaactctacacaggtatctcctggtcctttatcccactaggacagggctttattttttgttcattttatttttcttattttgcccatatttttccaattcaaacaacaggcagattttaagaagcatggtgtttttttatttgcttttctgcaagaagtagtaaaataatatttttttaaaaaaataaatgaaaataagaatgcaaacagggattctgtgttctgtctttagatttgactactccatcccatatcattcagacataacttataaacagaaagcatacacactgaattatattggtggaggtataaaggaagattttgttatctgtctacccattttcaaacctgataatgtatgatttttttttggattatttttgaagtatagtatcttaaaatatatacaatccttatgatgattaattctgaaaattaattaaaagtacttcttctaaataaggtttgttaatatattattgaacactgaatcttcagttgttcaggaaactgaattcttatatttacagataaatcctagacaaaaggcttaaatccacacaactaaaagttttaaggttgaaaccagaaatcaaatactgctgattctagatgttttctttactttgcctaagatatgtcggtgatgttacatttgaattcctccctcttattatagaagccttatgataacacattttaggttcactggtgcttcacgagctcttctacacagttaaggtctcttccgtctgagagagcttttgtttgtgcatctgtttgtttcagaaacaagcagattatgaaaatttccaggatcctttccactgtcatcggcttcgctgattgaaaggagcaaaataagataccttgaatgaaaatgagactgtgcaaagttgatgtgtgtatttgttcactctttcacactgacttttttccatatatatttttaattttattatcttccttgctcacacacaaacttaggggagagacattttatatatccgtatgctgtattgtacgcgtcaaattttacaatattttattttgaactgtgatgacaatatttctgtgatcttttgccaagagggctcttttcattagactccttacctcaactttggtggattcactcttcgatatcttgaactaagggaaaagagtgtttgcaaccagtctaatatgcctacctagagattacatcatattttctggacaatactacatctgtctcaagaagatacatatatgttttttggcaagtgttaacactcctacagctctctgtatatttccacactcaaagtagctaattataggaacctgggaggaagatgtgcaaataacttgcaaaagtgaggcgcagcgccttcatttcactatgcatttcctattagcatgggaacacagcagaagtggagaggaagatgatgatataggtcaagaatgccatccaggtctacattcccctggaccagtagttctcacccactttcaaaggtgtctaagaacttctatatttataccagcattccagattagtatggagggacatttttcaaaataggagacttgaactcattttatttcacagttggttagcttgatttattttaaaactctacccatatggtgttctggtctgcatttgtactattgtttcaggatccaaaattcttatgagaagaccaaattgttctcttcccttacatcatactttacctctagatgtactcagaaataaactttctgagaatcccaagtcatatgggcagctatttagtcagcattgttatcgagggtcagtatctaattttattccctttttttcttttcttttttagttttaagacatcatcacattatgcatgcagccatggcttgtctagaactaactatgtagaccaggttggcctcaaagtcatagagttccatctgcctttgcctctgcctctctagttctggaattaaaggtatgtaccaccacacacagctcattttgttttatttaggactgtactcctttatcctacagggtcaattattccgaacctctccagttcggcatggttctatttgctgtcatgttatttccttaacagaaagtaaataaacaagtaaataaggtcacaccctaggatatataaagatttataaatcactgccttgaaactgatagaagagaatcagataaactttatactttacaggggtatttttttttccctctaaagctaagaagcaacaaagatatttcctgcatacatcacacacatttctccttacatacatatgcataggcttcaactctacacattgctttgtcagcacgttgtggaactactgtatcagagtagccaaactctataaatttagacatagacatgtacaaaaataatctaacaaatgacagcagcttgccttcattaagcatttataatgtgccagctgtgtttgaagccaactacgtgcattgtaacacttgattatctttgttagtataacagcccaatgattctgaagatccattaagcaaataggtaactgaggcattagcattcatttttctcaagtcatataagtaatgtgtagcaatatgtttactgtcaaaccatcagctaatccacccacatatatttactgccaacttatcctgttatgtatttattctgggctaggtgatcctaattagttgtagaaatagataacaaaataatcatttctggaatttcttgtgtgaaaagcatcaagcttttttcttttcttactgtgtttttataaatctgaagattatcattgaatttcatgtgggaaatagaggtttggaagattttttgtgcaaagtcaaatctggaactgggtcagaaaaagtaaaaactattgcataagactgggacaaggctaagcatgagccttggaaccagtataggcactaatccttaagtatgaatatgcctacaagataaagtgtgttgtacatggtcagagaatttttttaaaaaaacagggaccaatgaggttaaattaaaaggagactgagaaaatacatggaagaagatagaggacagatgtggaacaggcattttaggatgcggagaacatgtagttctcactgttccttgtggcatctgaatggtaaagaaatggagataacacgccggacggatgccatcatctgaaagtggaaaagtagttgccagtcccatggcttgcatccaaaaatctaacaaatttaaatttaagtgaatggatatgctctactggatgactggattttataatgataattccaacacaaatagttttgcacagtgaaaaaaaaagagagtaaaccatgttccataaacaatgacatctgagcatctgcaaaggcatgctttgacttcaaacatagaaggcagttccatttaatttctttttttccctttcttcattttaatataccagagataaggacacagtgccttaatctggtatgtttgatatccacaatagcttacagtacacaggaaaatctacttaagtcgttgatggcttagaggatgagagaggatgtgtttttagagcagatgttatagagaaaaaggatcataccctgtagagatgaagtggaaatcacaaatatatacatgacataaatctagtatgagggattagtagcaacttcgtgtcctggacaaaaatgcagtttcctccataaacagtcatatttgtcaggtattttccacagtgtttaaatagcagtcattttacaggttatacggattaaagtccttcaagtgggagaggagctgcattatttccgatgcctggaaagaccacacagtcggtcctctgcgaggtagcccggaagcccttgctccatcaagcatagcctattatatacataaagacacacacatatatatacatatatatacacacacataccatatatatatatatatatatatatatatgcacacaatatatatatatgcacacacatatacacatcaaataaataaactttcccttagacatgattaattccttaattgaagtgactagttctcatcaataagaagtatatctcatctaattttaatttgcaaacattgttttttattgagcataaaactatattccacataaaacctggaaactgcatcactgcatagaaaatattcagagtcatgttgttcaggcattgcactactttggaacatgctcttttaatatttatatgatagatatgtgagtatatttatttatagtgttaatatatcaatgtacagatatatttcagtttgtatatccgttcatacacactgttgctatttctatttatatgtacatggttttaaactattaattatacaaactgttagaatagtttgatttttttccactgaacaattgtatcctgtgtctataaatattccttaacaaatgagtttaatggtgtttagtagtttgctgtgtggatttactttaattcgtttaatttgtctattttttcatgttgataaaatattgtgaatatttggtttctaaattgctttattaccacacatagaatgacaaacagaagtctggaattgttttgttttgttttgttttgttttgttttgttttttgtttagagacagggtttctctgtgtagtcctggctgtcctggaacttactctgtagaccaggctagccttgaactaagaaattcacctgcctctgccttcctagtgctgggattaaaggcacgtgccaccactgcctggttggaagtctgtttatatagaattctcagagagaaactgttgacctcacaatgatcgctttatactggcattgtgctaaaagttctatgaacaatttaacatatagtacttacccagttagagagtcaagaaagttatatttttcagtcatagaaaaagacttattcgagacttactagagtgccttacaggctgtgttctgcctatgccagccatgcctgtcaccagccaaaaggtaaagaattcaatagttctttgtcctatcagactgaatgcctcagttaatctgtgtaggcaagaattccaaagaagtaggaactgatgtcagagaaggaatgggtatgtcagtgatagtgagggctaggaggcaaagagaagaagctatttcacctcatgtcctttataaagggtgtcaccagaagatgaggtccaggctcaggatgggtcttctctcctcagatatttcaatatggaatagtctcacaaatgcacttggcttttgtaaagttgataaccaggaatatctatcatagcgaggattattaaatagaattaattacaggaaaatgaattgataatgtttccccaaatcccttcattgaaggaatactatttgaaacagaccttaacatggtttggatgtataggaggattttacaagaaaatgaacaggaacgaaatgtactggtctgaacaaagacataaagtattcttaggcctgagactcatccattctatcggttttacaaactaccatatgccagagctaccgtctgatcaggttagagcacaggagagttcttgtgtcttatctaactctctgagaaaaaactattaacccagtgttcttattgcttctaagtgatgttacattatttttctaggccagtaactgcatgtcaaacttcattatagaatcatgagaatggagaccattataaagaatcatgaagcttatcttactttgtggaaatagaaagggcgtcctatctgaaacacctgaattccatttgggccacttatcagtcctttgcttaagtcacttaaccttgttaaatcaatgtgtccatagctctaaaagagaacaattataattatgtcaaactgctgttgggagaattaaaagagatagcatttgtgcaaacatgtgtcttactgcctgatgttcaacagacacccaatatgccttgctgcacctcattgtccagtacatttgcagccttcttttttcttttagaagttctctgaaatcacgacaaaaaagtgatcactaagactttttttcacgcctcaaagggaagttagcattttttatattattataagtctttgacatctttctttgacccacaggcacaatgactataaaattatgacaaaattaacttcacttaaattttatttatttagttaatatgttacataataggatattcctcaatagatgcatcttaattgagttattttgcacattttgttaaaaatatgaattctttcaaaattacaactaacactgctgattacaaaagaaatctgaagaactatagtaaacctcaaacaaacagatggctaattaacatggcttaagaatctgtttttggccgggcgtagtggcacatgcctttaattccagcactctggaggcataggcaggtgggtttctgagttcaaggccatcctggtctacaaagtgagttccaggacagccagggctatacagagaaaccctgtctcgaacccctcccctgccaaaaaaaaaaaaatctgtttttgtcttcagaaagatatataatacctttgctaattgtagattcagaattgtgtgacaggctgtaatttatgcttctcatctgatttcctcttaaagaaagtaggctcctttgcatgaggtagtctatacatcttaaatagtaactttatttcattgtaggagctactaaagatatattagcaataaaagagggaaaaaatgatgtacccagatgtgtaacaaaaggatttagggtgtggctctgtggtaggttgtatgcatatccagcaagtatgaaaagtaacataccaaaattctccttgattggttccattacaacacaaagaatgtgcatccctacttagcacacaatgaatgtgcttactgacaagcaaaattaggaatttttttaagtcatatatccaacctatttctaatattgcattttagattgattaatcttctacattgatatgataaactctatttagttagtacatattatttaacgtctaatgaatcagatttataattataaatgtaatttttaaagactaagaattcaaaacgctggacagtttggagagagtatgagagacttatagaaaagctcagtctttgcagtttattgtaggataaaggtaaagtgtgtaaggaaaaggaaaactaggagactacatttgcatatctcacatggaagtctctgaagtggtttgtgggtagctacaatcattccccaacttcctcctataaagtgtttaaaagcatattgagaacaaatccaatgtaacattaatgaaaggaaaaaaatatatgtattaaataaaaaagaggtaatatgtggtggggaaggtatatatatatatatatatatatatatatatatatatatatatatacacacacacatatatacacacacatatatataaatatatataatttgctaaatcatttcctaccaatgttcctttaaaataaacaaaacagtatttgacatttcatagaacatattttttcattactgttgattttattaaaataccttttaatagcctagtatgaaaaccctcagtgctccctgctatagtttttttaaatttatattccaaacattgcccagtcatattttaaaaaataaaatgctttcaaaatggcaggaaaaaaaaatcaaagcttcttagttcatagagattgggctttcctttatctctatggtcaaaaagttttacaaccaagcaaaggctttccatacacaccatatttttgtgagacttgagaaactgtttttgctgtaaggtggtgtgtctgttcagggcatataaaaagtagatgtcaagacaaaattatatttataagaaatctatcaagggataaagcctctaaagagccatgcaggaaggaaaaaggaaaacagtgggagatttgtttgctcagaatgcagatctggcatctgtgaaaacagagcagggagaaagcaagaacttccactgctgtgctggagggagaattccagccagctctggggcagcccacaagagagagaaccttggagaacattagtgacaatgcttttagatggaatgaagaccctctcctattctgattaatgaagccgctctcttactctcttcgagttcaatgattggatggaaaaattcatgagctcttgtgacttggaaatggaatcagcagaagatacaaaaactgctgccttggttaatgatcagtgtgctggagattgactctcagtgtttctttgaaggaagatctgagtagtgtatgttgtagcagccacagtctaatactcatagtgcatggcacagttctgtaactcagaataaattaataagtacatgacctttatagtttctgcagttgtcatctcaaggcaaatagtctgataacttttaactttttctgacacttggaacacctcctggctacaggggttggtgacttaccaaacattttttctgaatgttaggaatatctagaaatcaaaacattttcatctatatttgcagtatatatattaagttgtacttaaggtaaggaataagtagaactacaaggtatatcacttaggtgccacaaagagtcctctgttcctgtagtatattaacagcagagtttattttgcaccatggacaaatgaggtataccaaaacgattcttgcctacataagaagcctaagtacttgatggcagttgatattatatttaaattttcttatttatttacatcccaaatattgcctaacttctagtgtccccttcacagagtttctcccccattcccctccccttttgcctctgagagggaagctctccaacaccctgcttcagatatgtccccacactggctcatcaagtctctaaaggattaggcacatcctctgaaactgaggccagacatggcagccctctgctatgtatgtgccagggcttcaggctagcccatgtgtgctctttcattggtggctcagtctttaggagctctcagaggtcctggttgatagacaatgattgtcttcctgtggggttactaacttcttgaaggtgttcaatccttcccctaattcttccatagcagtcctcaacctctgtcaagtattgtctgtaggtatatgcatctctcttagtcagcctctgcataggaccactcagatagatgctatgctaggctcctggctgaaagcacaacatagcatcatttatttttctgtgggcatctgcacatatctcagtcaacagctgatatatttactgggatcttgctgtggtccccaggaaaaggttttctttttttttttatagtacattgaatatatctttgaaaatacaagtttacaacactaccagaatgggctatacaaaggagaatttgtcaaataagtcaaacagaaagccacagcatttttccaagtgtcatagtaaaatgtattattgggtctaacatagttggtatctagtacaagtttcctcatcactatattgtctacaaacatgggcagccatgtagagaacttcttaggagtttagcattacgccttgaagtatagttttgatgacaaaagtgaattacagcttgcatggcctcctagagataaaaagtagccttctgagcatcatttaaatttatttaataaggaccgttgcggcattctcatccttatgttctattttatccgttgcttttctactttgcaaggtgtgacaatttatatttggtctggcctgcaaggagttgccctcaaaccaatgtgcccatttctctggttatccctaggatattataagtaatatccttaggaagtattctcaagtaggaatatctaaccatgcattctaaatccattcgcttagtgtccatggaaatatcaatgtaggggttttgttctgtctctagattatatacactaggtaagtactaaagcatagttaaagaaaatacagttgcgaattcatggattagttatcaggattagcacaaacctctgataattcaccttgaggtgtaagcctagttactggactggaagatgaggcagcaaacagttcctgctcctgatacccatggccttaaggatactgggatctctaccttattttcctgcccagtgaaagtaattgggagaaggtcttcttgggaccagtggatgttactttcaagcaaagagggtttcagattagagtataagtctaaactcccaaaggacttcttgactatggcttctcattccatgcttcagagtttagtatttttctatgtaatatttactattgttaactgttctaagcagaaagcatgttttatttaaataatgcctttatgtagctgacaatttaactcttattgtctgaccataactttgacttcagatttctttatcacaggttggtttctaaaatggcaaaatgaaaaaaaaaattttagcaaaaaaaaaaaaaattagaatgtattagtacaaaggtctctgccagatgacaacatttagattttgctttttattactaactgttacacttcacatcacttatatatgtcattatgcttcaggtactcagggactctgtactctgctgaggaggcccactactttcttttattcttcactagatggtatatctcagactattcatggttttctcttaaggaaagggcttaaaccattttttttccaggaaatattcttcttgtagtttgaataagatgcccccttcctcaataagtcttaggtatttgggtacttggttactagatgattaaaggctgggaagagtgagatgtggtcttgttggaagatgtttatgactgtggaagggatggagaaaccttctgttatccccagtgcataatttgcatctggctagtgggtctgattagtgaggtctcagttgtttctgccactatgcctttatgctgtcttaatggaaatttaccctctgaaagtataaacctaattaaatgtcttattttataatttatcttggtaacttttagcacagtaataaaaagtaattaatacagttctattccattttaagtcgcttcacattcactggatcttcaaactgtatcttcttatgtaccttatcagaacagtttttgagcaagaaaaataattttttggtgttttcagaagctaagatcaaaatgggatttcagatacctggacaaacgtatacaagataaagatttcaagtcactaaccgaatttgacttggtacagagaatacctataaaatagaaagaatctcagaaagaatgctgcactaaaagcccacagttagacatatggtaaccatggtatagaaatggcctgctagaaaaggtgggaattggatacaagtggtgtagttctgatactcacacattgttgagtcattggcttaaatatgacctggaagtgtcagtgagaacacagtagctgatctaaaggtgacatctctcaggtagggtttctcttataggaaagtctcagttattcactttcaggaaattcaacacactgggataataaaaggaaatattcattataatgtaagatagatgagattcaaatcaccttacctagatctggaatgccaatgtttcttgatacatacagaactgtgtttctttccttataatacaaatataacttcatcctgtattttaaagtcttggtagaaaatatgcagaagatctcagcatggtggctgggtatagcaagttgttcttagtgtcatttaacccctaccctttgcttaaattcttctggatttcagtcaatcataatttatttgtatttcaatgtaggtataaatttggtacacacaaaatataaattcaggaaaaatatgataggtacactttatgctgttaccacttagaagacttagtttattctaataaaaatgagatcaataagcctaaaaatttgaggttttaatatatagtgttccaagtttttatttatttatcatttgtactaaattagctcttattaattgatcactttgtctctgaactaagaagttattttaatcacccaagggaaactttttgactctgtgtgtgtgtgtgtgtgtgtgtgtgtgtgtgtgtgtctgtttatatgtttgagtgtatattacaatattatatgtatctgccaagcaccagaggccaatattttattgggtttggcatatgtgttggcttgtgtaaacaccctcatctcaatattgcctgtaaagaaggttagtccagaagagaacttagcaaattgatattattcttagtatattcttggtaacataatggggttacaacccgtgcggtttcctagagatgatgaaaaattatatgaagcactatataaacttacctagtaatttctattccagtatttctgccacaatattctattattattattgcttttttttttctattttgcacgatatggccatgttttggaactgtgatttgaaaggctaacatcccagtgagtttacttactctccttggctcttcacaggatattaaaaccacatgtatattgagcatatgtttttgtataagctactaaattatgatattcacatagcatatttatagactctgagttttagctacgttagaactatcttcttagtttcttggatcacagaattcaattacttttacaaaacatatggaaattatttgtgacttcaaagtcactgttttatttttattggaaaaggaatttgaaatttgagaaagaaataagactatattttctttaggggcttttactatgtaaaacatagacatatacttagttggttagattagtggtctcacctagctttcatgttggtgcaaataggaatcattgagtgtggatttgaaactgaaatcttcactgagatatagtaggaatgatcaagataatgtgttttatgcaaaaggaaatgtttcaaaaacttgttctctatctcttgatatacagtggtttttgtgtacaattactccagtaatttttgtctctaggtgagaagtaattaattcatgaatgctgagaatattgtaaagcttatatctaaagattttcacagaggataactctttaaacataccttaggatttcaaaaatagtaccttaatataggctttcaattaaatatctgattcaatttatattattttcctaagacattaccatgatactcaggaaaaaaaaatattatattgaaggatatcaattttaggaaagtgttttatatttgaacagatttttaatttaattgggtaatttcttcatttacatttcaaattctatcccaaaagtcccccttaccccccccccacttccctactcacctactcccacttcttggccctggtgttcccctgtactgaggcatataaagtttgcaagactaagggcctctcttcccaatgatgtcctactaggccatcttctgatacatatacaggtagagacacgagctctggggggtactggtgagttcatattgttgttccacctatagggttgcagatccctttagctccttgggtactttctctagctcctccattggggaccctgaacagatgtttttatttgaagcattggctcttctttatcaatccattttaatactcatgctcattgaagctaagtatatacactagcttagttaatgaagacagtgggccaagattgacaatacagatgcaggaatatatataatcatgccaaaatcactcaaaccaaaatatgcaagtaagagataggttttttttggggggggataggggatagtagaacacatccttactgaactgcatagtctctgtcttgaaatgtgttttctagacctggcaaaaagtagacattaaaagtgcttagtttggattttataaaaacagtatatcagaagtgttcatgaagccataaagtaagttcaagtccaaattaagcaagcattccatgaactgatgggagaaaggatcaacaatatctgctaaattatggagtctctagaatagtaaagtaagtgtggtaaaaggtttaagactgtgtgacattcaaatataatttgatattttctggatcatttagcccattaaattcttactttcaatagtcataggccttttactttgcatccctttctgtttgaatccgtaaaccattattttttaacaacaatggcaatgttaattataatatttgtgttcaaaggcacagatccttctaggagtgattcaagtatataaactgaattacttttacaatgggccaggattaatcgtcattatgttaccccagtattttctttgaacttaattattagtaatttggatcaatttttaacttaaaaaaaacaataatttattacacacatcttcctggctcattaatctctttactactgccacttaggataaaatggctcatcaaacaatagtgatttaatcataaatatatgaagtagaatagcattcacattgaaggctcaacagactcaaaacattttcctcttctcagcattctttatcttcacatatatcatggcgggagattttcccacttcattaaataataattatccactaacaagtattttatttttcccacacacatatacttacagacctgcaaattcttatgtattaataagagagaaattcacatttcttatctttagaatcagatgcttacagtcactcctacttcagaaagtgaaatcacaaatcattattatgatacaatattttatatgactaaatattgatgagaaatgaattttttcttcatctctaaaatatttttctggatttctcttatagaaatattttatgtgacagatactgtctttggtaccattgaaatagaatgtgggagaatttcactattgcctatcaaactttatttctagtattctcacaagagactcatggaaaccaaatgccttattcacaatttaaaataaaaggtgggaaatacattggtaactagggttgcctctaaggcaactttatttttcaccatacatctgcatttcttttatttaaacatttctctaactccttttcagcctaatttatttctcccactgaagctgagatgagaataagggactgttttgttgtaaaggtattaaaaatggaaaattttttgattcaatcaatattgaattaatggcaatatacaaatcattccagttatctcaaagtagcaccataattcagctttcttgtgtttcattgactgtttttataaatgagaaaatggagtctcacagatttcagcaacatatcagagcagatttgatattacaactaacaagatgagacaggaaattacattccaccctggcatttttttactctcaactatgttcatttattaatcttatattcaaataaattctccctaaggtgcaacatggttttacatgttatttttagagcaacttcattttttgattatttgtcttttggaattagccattgactttgaacactaaaagtggatgtcactcctgtgtgagctgtctattgtgatttctctttggctctgcttatacttttcagttttatggcagtgtttcagccctagagagagccagaactgtctggtggttcaaacaccaaccccagtgacagggcaagtccatgatttaccatctgcagccctcacagcaacaggaggatcagttggactgtgagcctatggagacatgtacaaaacctattttcacacatgatttacaacacttggagcagacaactgatagtttctctgaggccgcagactagatgattttagatcagtgaaggatggtgtctcgcaatctatttctatagctaactctctctatgtgctgtctccaggtttatagactcagcgagggaaatattgccagcttcagaataaacagaagttagtaagaaagatagacccatatgtctctcataaattaaatgttaggattacatatcccaataggataaatgtgtcaaaaaagcatcagatattacttgtgtgaaataacatttcttgttatatattaaatatgccagactgggaacttttctttaacttttaatttctgttttattgatatttttcagaagcatcatagcataacatctacttaatgtgtagataataaggcaggggcataaatgacatttctattttagaaattggtgtaaggtttctaagaatgggaaagaaataataattttcaacctccttgtcatagctgacattgccctccttgatcacaaaacatatgaaaatgaacaaatatcaacattttaagacttgattccttattgttataatcattttatacagacttgtatttacttgtaggatcaaacaatatatcacttttttatcttgcaattttctgcagaagagagaaatggttcatgtatttcttgaaaggtgccaggaatcctggtactttattctttataaagttccttgaagacgtctatatatgagtattaacagaaattctcaaaatgaggatacttgtacaaataagataataaacattttttctcttctggtctttgaataaaatataaaaaatcacaaattaacacttgcattggcatatgttactgatgaaaagatctatgataaaatttcagggtgtaattttatctcaaatacatgtattaaaatgctacttatatgcagcaaacaataggtttaaaacaatgaaaaatgtacattatctcaaaggtaaggtgacaaatatatcttctttcattaaagataactatcttctggacttgaatataggctattgattaacctgagatatcttaatatagaacatagtctttgtctattacattttcttttgcctgttggtctgtatcctgaatgacctccctacccagatacttcagtttgttcttataaaatattgccaaaatacctaaggcctttgcctgttctactttactatagaagagatgatatttttcatttttctctccactgtttcccttctttctctgaattggtaaattttccatataatttcctaggtatatttatattgttatgttatgagaatattaatctatgtttactaaggagcatatggcataaaattgtgtgtgtgtgtgtgtgtgtgtgtgtgtgtgtttgtaaatgacaaagatattagaaaacaatttggcaagactaacattgatgaattaaaagtttcccaattctcgattccagggtaaatctggtctgatatagcgaatatctcaacatacgtagataaatcttcatgtatttgatacaggcactatgctactttattttaatatacattataaaatgccattttaataaagtttaaaagccaacttttaggaaataaattatatgactttgtacaaatatatttgtaatgaattttactgatataataggtacatatcaataactttcaaataacttcttagttagggttttactctttggaacagatgtcattaccaaggcaactcatttaacaacatttaaattggggctggcttacaggttcagtggttcagtccattttcatcaaggtagggatatgaccgcacccaggcaaggatcttgtaggaagatctgaaaattctacatcttgttctgaggcaaacaggaaaagactgacctctagttagctagaatgagggtttttcttttcttttcttttcttttctttttaaaagatattttataggtggaacaacaatatgaactaaccagtacccgggagctcttgtctttagctgcatatgtatcaaaagatggcctagtcggccatcactgcaaagagaggcccattggacttgcaaactttatatgccccagtacaggggaacgccagggccaaaaagggggagtgggtgggtaggggattgggggggtgggtatgggggacctttgggatagcattgaaaatgtaaatgaggaaaatacctaataaaaaaaaagaatttttcctccttggttgggtttattccaaaatattttattttcttaaaggctaaaatatttacttgtaagtcaccttaccctcctctgttttgattatttcaagaaattacattttcttttatgatgttgtaaatgtgagtgtatcgacaatctacgttcacagatatttttgttggtgttagaaaagctttggatttgtgtaatttcattcaaataaaaaataaaaaaagatattttatttatttaaatttcaaatgttagcccctttcctccttttccctctgaactccccccttcccattccccccccctgccctgctcaccaaccgacccacttccatttccctgtcctccattcccctacaatggagcatcaagccttcataggactaaaggtctcttctctcattgatgtttgacaaagctgtcctctgttacatatgcagctggagccatggttccctccgggtgtactttttgtttggtggatcagttcccgggagttctggggatactggttggttcatattgttgttcctcttatgcagctgcaaaccccttctgctccttggttactttctctagctccttcactggggaccctgtgctccatcaaatgaatggctatgagcacacacttctgtatctgtcaggcactggcaaagcctctcaggagacagccatatcagactccttccagcaagcatttgtttacatccacaatagtgtctgggtttagtgactgtatatgagatggatccccaggtggtgcagtctctggatggcctttccttcagtgtctgctccatactttgtctctgtatttcctccggtgaatattttgttctcccttctgagaaggacagaagtatacacacttttgtcttcttcttcttcttcatatggtctataatttctttaaacacacatacatttttacttcccctctatatatttctcatgtgtaatttctattgctaagatttctagtaatatgggggataagttctctaaataaagttacttctcattttttagaccttatatgttaaaaaaaatgtattgatcttatacttcaaaaagcagctcaatttcagtgatagaatcagaaatttggcctccaaagccacttgggaacaaattcaaactctactagcagtctctgggactcaattaaatcacctgattatccatcactttcatcttgctcaaagtggtcacataagaactaatttatgcatttggaaaatgtgttatgaattttgttgtgattctacaaagcatacagggagcatgaggatgtacagaaagagaaaaagtgatttaaaaaataaactcatattgcttatgataaatgatgaaaatgaaaagtggatgttagacataaatagggaagagtgctacaaagattaagcaaataaattaactaatttaaaacatcaaatggagaatgtctgtcaggtgtataataagtggccattatatacgactttttgtgttcatttacaagatttaacatgaaatcatggtgtttatcattatgaaatgttagtcaaagcagaaaatcgttgatattattcatctgtcttgtttaacatgagtagctaaagttcaaaaaagattaaacactcaatttcagattacagtttctattttcattctttaatgtttctgtcttatcttatacatttttatgttgaccattaaaccatcaatcctgcaatgcacatttggaaccagataactcatctgaattttgatacaaatattaaagcttaatttgagcaggaatgaaagcaggaattcagagactgagccattttgaagggaaatgttaagggaagagtgctaaaactccaataggctagtagaccaacaacacaaggttctaggacagtggaaattcccttctttgagtaaaacataatttatataatgtatcagttaaaactctaaaagattgggtagctatttgagcatatattagtcttgcccttttcatgataaattttctctagtttcagttgcatgtgaccaagtctgttctgaaaccattaagttaaaatttctgaaagaaactatttcatgtctcttaagccacaggctataaacaattagcatgatgaaatctgccctgaaattcagtttgccaaagccatgattcatctctttgtgcaacatgtccttagtgtataggctacactcttggatttcaaatcaactgtgacagtactgtggtgcatgcatttaagtatttttccttaggaatagctctgagagcaaggccagtgatgttggaaacatgactatgtcaagaaaaaagtctgtatttattttaagtgaaaaagataagagttctcaaattaatcagaaagaaatggcatccctgtatcagtccagccagagcaaagtcaaacagttctctgagggggcagtgaagataattataagacagacagaaaagaatactcagagacaaaggacaaaattctggaggcctacccaattagtattgtagcagcctctagtttaattatcttaaggtttgtatactttacagcagagtgggaaacaacctcacaagctagtagaaacaatggctgacataccttcaaaatctgtacccatctcgaggcctcccaattcttccttgttgcttcctccaagattcacaaacatcagccccttgccttgatcttcacatgtatcccctcatattagtccatgcttcagcagaccaggtactctgccagcaagccttgacctaacttgcctctctttctacctatcaggcaggttttcacacaagtagacaaaaaaaaaaaaaaaaaagctgtaacaaatgtgctcagaactgggtaggtgaatgaattatcaacacatgaaattataaagaaaatgtcaattcatgggaaattttctatgcacatcatggtaaattgttttctatttgttttttttaattagatattttctttatttacatttcaaatattatccccactccacatttaccctccaaaaaccccctatacactaccacccccccccctgctcaacaagtctcccactcccatttccctgtcctggaatctgcctatactgttgcatcaggccttcacaggaccaagggccttaccttccattgatacccaacaaggccatcctctgctacatatcaagctgctgccatgggtccctccatgtgtactctttggttggtagtttagcacctgggagctctggggtactggttggttcatttttgttcctcctattggggttgcaaatctcttcagctccttgggttctttctctagctcctccattaggaaccctgggctttgtccaatggatggctgtgagcatccacctctgtgtttgtcaggcactggcagagcttctcaggagacagctatattaggctcctgccagcaattacttgttggaatccaaaatagtgtttgagtttggtaactgcatatgggattgatccctaggtggggcaatctctggatggcctgtccttctatctttgctccacactttgtctctgtatcttctcccatgtgtatctctgtatctttccaatgctcatggattggagggttaatatagtcaaaatggccatcttgctgaaatcaatctacaggttcagtgcaatccccatcaaaattccaattcaattcttcatagagttagaaagaacaatttgcaaattcatctggaataacaaacaaaccaggatagcgaaaactattctcaacaataaaagaacttctggtagaatcaccatcctggacctcaagctgtactacagagcagtagtgataaaaactgcatggtattggttcaatgacaggcagatagttcaatggaatataactgaagacccagaaatgaacttacacacatatggtcatttgatctttgacaaaggacttaaaccctccagtttcggaaaaaagacagcatttttaacaaatggtgctgtttcaactggagggcagcttgtagaagaatgcaaattgacccattctcatctccttgtacaaatctcaaatctaagttgatcaaggacctccacataaaaccagatacactgaaactaatggaaaagaaagtggtggtacatgcctttaatcccagcatttgggaggcagagacaggcagatttctgagttccagaccagtctgttttacagagtgagttccaggacatcccaggcaatacagagaaaccctgtcttaaaaaacaatgccccccccaaaaaaaggggagaaagaaagaaagaaagaaagaaagaaagaaagaaagaaagaaagaaagaaagaaagaaagaaaaaaggaaagaaagaggcaaagaatagaacaccattagcttttgctctaaaatcaagaagtgataaattggaactcataagattacaaaactttggtaaggcaaaggacactgtcaataggacaaaatggcaaccaacaaattcgtaaaagatctttaccaatcctacatctgaaaagggctaatattcaatatatacaaagaactcaagaaggtagactccattaaaatatggggtacagagctaaacaatgatttctcaactaaggaatagggaatggctgagaagcacctaaaaaatgtttaacatccttaatcatcagggaattgcaaatcaaaacaacgctgagatcccacctcacaccagccagaatggctaagatcaaaaactcaggtgacagcagatgctggcaaggatgtggagaaagatgaacactcctgcattgctggtgggattacaagcttgtactatcactctagaaatcagtttagcagtttctcagtagattgaacatagtactacctgagaacccagctataccactcctgggcatatacccaaaagatgctccaacatgtaaaaaaacacatgctccagccttatttataatagccagaagctggaaagaatgcagatgtcattcaacataggaatggatacagaaactgtcatacatttacacaatggagtactactcaactattaaaaacaatgaattcatgaaattcttaggcagaagtatggatctagaaaatatcattctgagtgaggtaacccaatcacaaaagaacacacatggtatggactcactgataagtggatattagcccagaagcttgaaatagccaagataaaattcacagatcacaggaagctcaagaaggaagatccaaatgtgaatactttgatccttcttagaaggggaacaaaatatccacaggagaagatagacaaagtggttgaaaagagacagaagggaaggccatcttaaattgttatagccatggtgaatggtgtacatttgaaaatacaaagggcaataaatttaaagttttagaattaaatgtaattcagggtatttaattaggcctaagaatgtataccaagaacatgaccatatatcctggaacattattttctcaatttttaactgcaaatatgtgaactttctcatacatttttttttcttttacactaaaacttttcaagttttctcagtacaggctggtttgtatgaataatctcatggtggtagttatagtaaaaatatatcaaggtcagtgctggtaagcctgtatgcaagcagcactaagtgtaacacactgcaaatagctctagctgtctaagaaactggattgagaaatgtcaacagcattgttcaggtttatgaacagcaattaatattcattcacaagatggtctctatttcctgcttttctacttatgcaaataagactgtcagtctagcagcagacatgccattgaagagttcatgttggcacatgtgtatactgcataaatattttgttttcctttcttagaaagatctttataaaactgactctaaagtgtgtacatataaatagtctgtaaatacataagaacttgtcttttcatccaaagcagagataacatattctggggtagaacatatttgagttgaatctgggtaaacagtatgtctaacaagagaaaagatagcttttagaagaaaggaggatagggaattgatgcctacggaataaaatttgcttcggtgtcattatttaattatctgattaatattatttaataatgcacattaatttacagtaaggaagcttgttgacctctttctctataatttccacatcaggtctcttgatatctgtaacctattaattttataggcatgtcatatcattattcaattacagttctaggtatcttggagagatatgaggaaaagatgataattaggtttaaaacatgactattgctttcctattatcaagtagatggcctgcctctttaatttagtcaggtagcagtttcacacaacacatattcacaaataatgatactcacaaatgctataaaatatgactcaatgtccacacaatttattacctgatgaacatctgagcaccatgtatgcaacacaagcagctgaccaacatgggattcttattcccatggatttcctcttcctagagtcccagtttttcctatcatgatatttcctcacttgatatctggtatcaaatgtgccatttgatgctatctctgtgacatcatcatggtttcctacactactgtgaagaagatatccataagtttgcccagcttcaaaaaactgggcataaattcctcctctttcctaagcatggttaacagtattgattccttgtgcttccatgatatgaacttgcttttttttaaaaatgcacaccctaaagcctccacatcatttgttttccactatattgttatatttcaagataaaataccattgctattccttataagtacatatccaaaatttattagcacctatctgctgttctaggatggggaatgaggcagaaataaatatacattctgtttgtactaccggttatttaaacccagtgaagatgatattagagttgaaaaagaacagacaggagcttaacagaatatttttttaggcatagtatattttcaaaactttatcctctgattgaataaggaccacatatactttatgaaaagatgataggaggaaagacttgtttctagtggaacaaacgtgatttaagaaatcttcactgaagccacatgaggcatagggagaatgctctatttggaagagtgtagttgctttcagccatacctttggtcattgatgatttagttattttgtagagcagattcacccctgagtttaatttctttgaggaactgggaatgaatgttttcacacttacatatagactgttgttattcattgtagatggttgtaatgaagtagatgtaaaacaaatctaggggtgggcacagatggtccacccattagatattcttttcaaacaagtaagaaggctgagtatgaatccacagaaactgtataaatgctctggagagtatcagacttcttataattccaaccacagaacgtagaaagttaggattcaggattaagaccagtcatttcgagaactttggggtttactgatatcctacttcacttcagtggttgcaatagaaagaatgattaaagagcatccccttgttaactctgggactccaagtgcacattcacacttgtgaatacacacccacacatataaccacacataggcatgcatagatgcacacatgcttatattcaacacacacacatacacttaaaatatgaagtaaaggatggaccatctagagactgccatacctggagatccatcccataatcagcctccaaacgctgacaccattgcatacactagcaagattttgctgaaaggacccagatatagctgtctcttatgaggctatgccagggcttagctaacacagaagtggatgcttacagtcagctattggatggattcacagggcccccaatggaggagctagagaaagtactcaaggagctaaagggatctgcaaccctataggtggaacaacaatatgaactaaccagtgccccctggacctcgtgtctctagctgcatatgtatcagaagatggcctagtaggccatcattgggaagagtggccccttggtcttgcaaactttatatgccccagtacaggggaatgccagggacaaaaggtgggagtgggtgggtagggaagtgggtggggagggtatgggggacttgggatagcatttgaaatgtaaatgaagaaaagacctaataaaaataaataaataaataaataaataaataaataaataaataaataaaaaggtaactcagaatttctctgctaacaatgaaacaccctcagaaattgccatcagctactaacctctctgtaagatttctgcattttgttcttgtggaataatgaaaaatgagacttcccctccttcagtcataacaacatagcataaatgttccagtttaaagtatagagatggattgccaaatatgaaggtgccttggtgtttgaaataattaacgtgtactattgctgataccatccaaggccagcaatggaaagatccatggtcacattcctacttggctcatgtgtgttcactgtctttttgtgtcattacaatacagtccatctctgtgtctgtctctgtatccaaatttctgtttttagcaatgatgtttttcatattgagcttattaaaaagtttcacttttttataaatcacattttaccttgatcatgactataaatgttcttccgtaataaccacactcagaggagatagataaacaccagcacagtattcattgtgccttttactttttgaaaagcagttcagtgacagttcccacaattgttctagggtttattatatagaggatgactctgtgacaatccaatcagatgaatcttcattttcagatacatttatgttcctagtgcaccttttctgtttttattcagtcaataacatttaattaccactagcagatgttttataccacaggttctgccctgtcctgtcaacattattcctctagttttacgacctcatgggagcaggacttctgtcttttcacttctctactttatatgtagttgctatgatgtacactctgtattaggctcttcaaacatgtttgctgaatggtacataaggttttctctactgcatccctccctctgtagaaggtgtaaagaaggggcatcgcgagtctctgttctcatggctgctgtgtatcatttttactctcagcatcccagagccatttacatactcatattagttcaagtgaacagcctttcaggaagcatcattcattgcactgtagcatatttcacttcactgtagtatccacatcccaattctcagtgagaaatgagcttcaacaagctcaagcctccacatatattttagctgtttacaaatcccaccggtctctactattggagaaaaaaaggatttaggtagcaacaaaggcaaaacaatgaagcgtagggaagccagatatcagatggtggtgaaataatacagggtatttcccctctctcaggtattcacttggagagaaagagaggctctctgcttagttctagtgagcctaaagcaccatgttgggttcacttagcaatcagcctcattaaaatcattatgtttctctacccagaatttggcttccagatcacttccagtactttagatgttcactgccatggtttttagtgagaaatgaaaaacaggctttatttccagatcttccccagcaaatgaacttcataaaggtgccagtgacaaaataaatcagttatctggtgctctgagccgaatttagctgctgttattgttggctgatatgcttctggggaaaagacatttcagaagggactaaatccacatgtagctgctgtaataaagaaacgtttagccaaaaaaaaaaaaaaaacctcaactttacaaggactatgtaaagttggaagctaacttactaagaaggctgtgcaaaatctattaattcaaggctatctagttgtaactgactcaagtactgccagggttatgtatgcattcaaagtattgccattttctggcacaagtttcatggcatgctgctggaaagaagttggatttgtaagtataatcactgtagttcagctacttactaactccctgatgttagtcatgtttctgcctttctaaatctgcctttttcatctttcaatgtagctgataatatcctctcaagatatacatgtgcaagttaaattacttagaacgtatgcacagtcagttccacttctgctattctggttattgatgttataaatctgccaccaccttagtcccatcactttggattattttaccatttcagcaaaatacattcctgcttttgtttctgcgggttgggtgattttgaacataccggttccctggcagccaagtttcccacctacctaaccagagactaatgatagtgtgttagttagggttttactgctgtgaaaataccacgactaaagcaacacttataacaacaacatttaattggggctgttttacaagtgatcctaggtgaccatcccatggtactgacatcttcaatattctatggtcttccattgcaactaggcttcatcattcacctctcatgggcttttttcatggggccaaatctcaactcctttgcataacccccgcagtcctggcctgacaactacaactgaggctgtactttcaccaatggcctttcatggcctctcacagtaccaagcctcagttgttcttaatgtccccttcatgccttcaaaatcagtaccacctgggtgactcttatacattaccaatacagttggagcacaaggctatctctggaaaacaacttatttgtgctctcagacacttcccagaagattttacctcagtgatgctggtctgctattaatcaccactaatttcttagttccagcaaaccagcatcaattgtcccagtagtcctttctactctggactctaacaccagagccacatgaccaagactgttaggttctgctgcttgctgagactggatcatggccccctagttttattatattatcacgagttttctgtttttcaacttcttcactgcctgagcttggctgccctggaacttgatccatacaatgactttgaactcagagatctgcatgtctgtctccaaaactctgggattaaaagtgtggtccacctaatctggatataagcttttcttcactaagaactttctctgttctaggctgggcttgaactcagagatatgcttgtctttgtttcctgggattaaaggcttgtatgacagtgcctggacctaaatttagctgggtggaatcttgccccagggtcactactcccttaattgaatttaatatccttgaacacaggattcagatccattttcactggtaccccttaaatactcaaaccatatattttatatttttcctttctcagagtgctatgcttgtttaaaactctcttcatgaaacttagagaacaaagtcaatgacgggaatttttgagacttcctttgtcaatataattaatctgagtctcttcaccttagcctccggcagattcttcagacaaggtcaaaacgcagccacattctttaccaaaataccacaaaaacagtcactaggccacatattgaaattctccactgaaacctgttgggccaggtccccacaattcaaatcactctgagtaacaaagtcttccatattcctactaggatgggccactaagtcccagttaaagcattctactcccttccaaatccaaagtccaaaaatacacactcttccaaacaaaagcatgctctggcctatcacagcaataccccccatccctggtaccaaattctgtcttagggttttacttctgtgaacagacaccatgaccaaggcaactcttaaaaggacagcatttgattggggctggcttacaggttcagaggttcagtccattaacatcaaggtgggaacatggcagcatccaggctctcttaaaatataggcagtatgtgacaagtacgttgttaattaatataatagtgaaagtgaaggaggtagagagtaaagaagaggcagggaatatgcatgaataaaactcgacactattctcttagacagttgttatcagctttctgaccttttgactatttcctgagagctgataatatggtctatgccaatcctgttaacaatcacaacttctgctggatgatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatagaaactttatcaattctttctaatccaatgttctttatatactatatatagtatagttagaaatatatattgactacacacacactacacacacacacacacacacacacacacacacacacacacatagtgtgtgtcactcactcctgaatattctgtacacagtgatatttcattttcttgcctctacttagaatgatactatgttttaaaattttaatttccttcttgcctccaaatgccaagttcaaaacatttttttttttttttttggacaaggtttctctgtgtaaccctagctgtcctggaacacactttgtagaccagggtggccttgaactcagaaatcttcctgcctcttcctcccaagtgctgtaatcaaaggtgtatgccaccactacctggccaaatgccaagttccaattcattccctctccagagagtctaatatcttctatagaaatgacaccctccatcttgcttttccacagtcttatggagttatatctcctatagtattagtatttacattttcttttataatgcatttactgtatatctctctcctgctctccagttagactagcaattacttaaacaaatgctttactgaggatgcaagcaatgtatgattttttagatggtagaatttcaaacatgtcttcttatattataaaatttcattttattgagtatgtattataatttaattaatctgatttatttactgtattcaacaccagatagcagttgaaaacagatgaatgaaattgagagtgttagcaaaaagtatgggttaagtatgggtttaaaagtatggnnnnnnnnnnnnnnnnnnnnccacattctttaccaaaataccacaaaaacagtcactaggccacatattgaaattctccactgaaacctgttgggccaggtccccacaattcaaatcactctgagtaacaaagtcttccatattcctactaggatgggccactaagtcccagttaaagcattctactcccttccaaatccaaagtccaaaaatacacactcttccaaacaaaagcatgctctggcctatcacagcaataccccccatccctggtaccaaattctgtcttagggttttacttctgtgaacagacaccatgaccaaggcaactcttaaaaggacagcatttgattggggctggcttacaggttcagaggttcagtccattaacatcaaggtgggaacatggcagcatccaggctctcttaaaatataggcagtatgtgacaagtacgttgttaattaatataatagtgaaagtgaaggaggtagagagtaaagaagaggcagggaatatgcatgaataaaactcgacactattctcttagacagttgttatcagctttctgaccttttgactatttcctgagagctgataatatggtctatgccaatcctgttaacaatcacaacttctgctgatgatgtgccattttccagtgctctttacaagtgaacataatgcaggacaagtttctcagtttttaaaaagaatgtcaaggttcctaatatacagaactagacagcaagcacctgagtaaacgctgacattttctaacataattatgtgggtcagttcttctacatagaagtcctaaacttttgtttacagggagaggagtatttctcactttgttaggaaggaataaaattagctttgttgggagaggggctgaaagtataaacagaaccactgattttcctacatattcaaatttcatataatgtgttcttataatgtgttctctaactgttaaagaacacattatatgaaagtttaacccatacttttaaacccatacttaacccatactttttgctaacactctcaatttcattcatctgttttcaactgctatctggtgttgaatacagtaaataaatcagattaattaaattataatacatactcaataaaatgaaattttataatataagaagacatgtttgaaattctaccatctaaaaaatcatacattgcttgcatcctcagtaaagcatttgtttaagtaattgctagtctaactggagagcaggagagagatatacagtaaatgcattataaaagaaaatgtaaatactaatactataggagatataactccataagactgtggaaaagcaagatggagggtgtcatttctatagaagatattagactctctggagagggaatgaattggaacttggcatttggccaggtagtggtggcatacacctttgattacagcacttgggaggaagaggcaggaagatttctgagttcaaggccaccctggtctacaaagtgtgttccaggacagctagggttacacagagaaaccttgtccaaaaaaaaaaaaaaaaatgttttgaacttggcatttggaggcaagaaggaaattaaaattttaaaacatagtatcattctaagtagaggcaagaaaatgaaatatcactgtgtacagaatattcaggagtgagtgacacacactatgtgtgtgtgtgtgtgtgtgtgtgtgtgtgtgtgtgtgtgtagtgtgtgtgtagtcaatatatatttctaactatactatatatagtatataaagaacattggattagaaagaattgataaagtttctatagatttatattttgacaaaatattaaaccttagtagaaaaagtgtcagagggagagagaagaaaagatggattgaatttccatctgaattaaaacacacagacatttgtatgtttataaccccttcttaatattctagctttgtcacagctcaacagaaaaacatgcacattcaaccacctaaatgatagtgttacttttgctgtaatttgttagtagtaatgcagtctcagtttaatttacatctctattatggcaggggaaactttgtttccccagaggaatagagtggcaagtatgccaatggttgcttagtctcctgaaaaataattatgcatatgttgtctgaatgcacatacttgtgaggttctattgctttggatacctgtggagtttttcatttgatgagcacatggagagaatttgtaagaaaaataattggaagtccgaaattttctggcatgtggcaggaagagatgaccaattatgaccaagaaaaccctcagaaatttcatcataaagaagatccatttctaaaagcttggcagttatgtttttttaaaagttgatatctcaatgataatgctaataattgtgtttcagtgggggattttcatgtttatgttttcatgtgtgtgtgtgtgtgtgtgtgtgtgtgtgtgtgtgtgtgtgtgtatgtgtatcattaaattttcccaattcccatctccattttcttctgtactttcacatgctttcttccaggtcatcttgcttttggctcttatgccatgttcactctgttatcatctcctgttttcttccatttccctatagacacagtccttacctcttgtagcacatatcatattccatatgtcataaatcccaaactagatatatttaaatctatttcctattaaagaatatgttttatttgacttcctgtgtgtttgattactttgcataacacaattatttccagataattttcaagcaaatgttataatttcattttgattacaagagagtaaattccattagctgtatgtgtgagattgtgatgactgtagaccccttgtgaataaaataaacaggtgtctccagaagtagaaatattctttaatcggaagaattgaaagtctgcagtatccctgtagaagtggaaactgaatggatgttgtgtaggaaacttgggttttataagacagagaaggaaaaattcggagatggaaaattccatcttcatgtcaattcccctgcagtcttgaagtgattaaaaaacagtgattttggtatgtaggtctcccagctagaaacttccaaaggccttttaaattaagacaactttttcattcagagcttttcactccatcccagcctcttaggttggttcttttacagtatacatcccatttttgctatcaattcatttccctttgggcttcttgactagttctatatcttggatattaataatccttttgaattagacatgagtgtgttgtgatcattctggtctgctgctttagaatctgttgagtatatgcctatggatgggacagctggaccacacagtagtactacatttagctttttttattattattatttttagaaacttccattctactttctgttgttgctacaactaaggcttagtttttttttttttttttctacgcaccttctaaacacatttgttgtttttttccctcttcttgataatcatgctgtctaagtaagatgaaatttcaaaccaatttcaacattgtttttgatagcttagaacttgaacattttttaaatacttattgattgttggtatttttcaaagaaatatcattaatccatttgctattcaaatcattggatttattttcctattacaattctttatagattctaaacattaatcacctgccagatatgtagttgacaaaaattttctgcttttataaggtctctttggctgctaaaaatttctgctgctctgtagcagatttttaatttcataaaatcttgtttggtgatttgagaagttgttttctgtcctaaatagcattgcttgaagaaaatccttggatctgtgtatatcttgaggaattttttctggcagttttaggtttggggagcattcgataaaatctttaatccattttgaatttattattattcaaagtgtaatatagatcccactttaatacttttgtcttatttatttacttatatcccaaatgctgtccaccttctggttccccctcacaaagtctctctcccttctcttctcttctaagaggtatgtcccctggtcatcccccaccctggtgaatgaagtaggtttgggcacatcctcacccacaggtgtaaaacagggcagtcgcatttggggatggataccacagtcagtatatagctttagggactttccctattccaattgttggggaaatcaaacagaaacaaagttgtacctatgtgccagggccccagtctataccatttatgctctatgtttggtgacacagtatctaagagcttccaggggtccaagttagttgactctgttagtcttcctgttgagttcctttcttttacagatggatatatgatttccctggtgtcatttgttgaaaaagtgcattgtattccaaagtatacttaaaccaaagtattgaaatttaagtggctataactctaggttttttttttcttctctagatctacattacttttctgtgatctatgtaattggtctatgtgtcttgcatgtatattcctcaatcccagtcaccttagcatcatatactagagatgcacatacctgtgtaaatgctgaacataccactgctttattttcaaaaatctttaattctatgcctttattctcttggctatattggtgtttcctagttagacaacattgaataattaccttagatatagttgtactctatatatttgactatggcatagtgcagaaatatagatattttaaaccatcactccaggcaaattgtcatggcaatatttgtataatgaagaacattatttcaagaacttgatgtatgaagtcttttctcttgcacatgttcagacaaaggatctatcaacattgttacttcagaaaattaaagtaatgaacagataaatgtaggaaataagaagatttggaaacaaagaagaaattgacaatgtctagctttctataataaaaatatcaacaaatgttaatatagaatgtttagaaagattcatgtcataatgccaatatccaaatgtaaggtctcttactcaattttctactcatttttttctcagaattaccagattcatgtagtaaaagtatgatctatgtatagaaatagttttgcttttcagcttaaagataataaggccttaagatgtgaagatgttttggtctatagagaatttttgttgcaatcacaaaatttaagttcaggccttatttctggtgcgtttagatttgagttcaagtgtcatttctgtgcatttataaccctagccctgaggaagtggagacagatccctgagactctctactaagatggcttatttgaagaactccagctcaagaacagaccttggcacagatcccaaggaatgatactgtcttagggttgtcctgctgtaagaagacatcacgaccaaagcaacccttataaggactttatttggggctggcttacaggttcagagattcagtccactgtcatcaagatgggagcatggcaacatccaggcaggcatggcactgcaggagctgagagttctacattttcatctgaaggctgctattagaatactggctttcaggtagctaggactaaggtgtaaaagcccatgcctacagtgccacacctactccaacaaggtcacacattcaaatagtgccattccctaggccaagcatattcaaatcatgacagataccctaaattattgtctgtgtttactggctcctaccaacccataatgcatttttacactattggtgtccctcaatcaaggtctaatatgttcagtatcaaactgccttttcagaaatctattccctgtcttttttcatcatggatgaaaagatcttagaagtcatttaattcagtgaatcacttctgaggatctttctctatgggtacatcttaaagttttgtagagttagtttgttttttcttgagtagactacacaagcattttaagtgagtagctgttgagatgtgcatattttggtgaatgcagttttcctactaaaggcataaagtaaagtgccatttagataataggcagcataggattctatgattcagtctctgaagattatacactttggcctctacagactaattttcacagaattttgattcaactttcaaaatgacttatatggttttaatctgtttcgcagcactataaaagacaacatcaggctaccccaattaaattaagcaatatatttgagtctcttgtttccggatgttgaggagttcaagaccaaagaactattagctggcacaagtcttccttttgtgccattttttggcaggatggagaaaatttggtgcagaaaaacagccaggcagagacagggagaagagcatctaccctgttatacagaatccacacactcaagataatgtcatatacagtatcagtcatccaatccaaacacaagggccgtgacctagtgacaacaatacacttaattaggctttcctacaatctgtgccgctaggaggaaaaacctccaacatatgaacaaataagggacctagcagtatagacccttgactttcttatagtctgacacctgcaatttcattatcttgattattctggaagatatatgccattggaaagactactggagaggtttttttttaactagtataacatatatgatagaccttaatgtgaaatatgtcaagtatatgatatgccactatcaatttaaaattttaccttcactcacatgtgtatgaaaagttggaatgtgacagtgagttatgggcatagaaaatttctttcacccttgcattgcacgtggggaaagtcaaagactcaaatgttctatggggtctggaatgtagcaagagtttataccaatcatatctgatttaaagttctcaataaaatgaaacactcaaaagtattaataaaaattatctttctcactggacaaaggtgtgcctgtttgagaagaaaagttgacaatcagagaaaagtagggacagagaagggagaagaaatagagaaaataaagagaaattgattctcctgtgtacacaaacttcctttacagaaacatttacaaatatggaataataaaaactcatttaatttataattagctcaaaaaacaaaccaaaacaaaaaaatcatcaaaaaacaaaaaataaacacacacacaataaaaaccccaaataggagaactcacaaatggtgcctgtatatttataaaacactgtgaggtgcactcacaacatgaacatacaaatcagagtcagaaagaacacctttagaattatgagaaaatgtgaacagtttgtagaattgttgctagtagaagtttagaagaaagactgaaacatacaattctgaagaggaccttatgttttctagataacgatcaaaatcacaggcagaattgcaatgatgacttatttctatttaaatgtgaaaagaaaaggatttgctcataaccattcctagttttttgtttttgttttgttgtgtgttttcctttttttgctagtacaccgcaatggtgatgaaattattgtatggaacttagagtgtaaagaccaaaaaatgtactcacaactaagcaatttttattcaagtataaaaatatgttgaatttacatatattacttgaacaacacacatgcctaggcttaggacccttgtataaagaaatgtagggaaaagggagggaaatgaaaggtagagttaatgtttggtgaattgttcagtctcactggaaaacgaatcgcatacaaatgggtgaataatttaaatttgtgacagctggtgtattgttcatgaaagaatagaagtaatggcagagaaactgcagtgctggccttcctatcgtaacatccctgagtttcaactgctcagttgcttttactaaaagggtatcataggctaaacctttagacaaggcaatggaagactactttaaactaaaagagggcatagttcgccatataaaagaggcatgaagtttagagaagtggctaagaaggtattcacactgtggaggatattatgcaagaagatagatactatgtcatagacttcccagggcatgcagagggatagccttttatcccaccaaaatagtgctgtgatgaagacagaattaaaaaccaggctggcaacacatcattctatatattgaaaacaaatggaaaaataccaacctactagttaatattgggttataaattactggcattctacaaactgactattattacctctatgaaagtttttctgtgttttatttctaaaagagaggtgaaagtatttttataaatgcatttctctgggatgtcaattaattaataaagtgagtaagaaagtaagtaatatatttcttagttaaagcctgcaataagcttgttacctataggtcttaccaataggtcttttaataaggagattaatattaggaaaaatgataatagcaatctttctaatggacaaattttatgtgttggggacaaacagtattatcaggtcagatctgatatgtgacacatatacttgaatgcataagtaatttgtaagaattcatgagctaggccatgtaataagacttttatgaaatacaatatcctgaaggaaacctcaacaactttcaatgaaactatttgaacttatcttttagaaaccccaagtaagggacttttgtgtggtgaatgaaccaaaaacaaaaaacaagaaaaaccaaaaccaaaaaacaaacaaaccaaaaaaaaccccaaaaaacaaaaacaaaacaaaacaaaacaaaaccccaaaaatcaaaaacaaatccacaaaggaaactccctatatattgcatataatttccatccaagtatgaagacataaagtaggcctaaacgaatatagaagtgattttctttcctattccaaatctctgaaccttgtgggtagggagccagagcagctctgtgggtggagatgccaggtcagcaggggcactggtcagtttttatctccattcagatcttgctacaatttatgaaatatttggtcagggtttacaatactccttaaaaagaagaaagctcccagaagctgttgaatagaataccaggctgttagggtttggaaaataagaagccataggtgaggttgacaggttacgtggggaggaagcagacagaactggcagtttattttaagcgttccagacttcagtggatcaattttctgaaagggttgccttccgattgttcctttgaaagtgagaactgccagggccacaacagaaagttgacacctattcacttctgctcttagagaaagctaagagggaaaagaaagactcaattcttgttctttctatttattgtgctgttcaaagtgatgaatagtggcgtcgacactaaagagactttttttttttaatgtttcctgcaaagtctcaatgaacctaagtgagtacaggagtcaggtaggaaaactttttcccacttgaagagtttgtggcacagggctagggcagtggccctgtgggtccatgtgcttgcttactgtagagaatctgagttgatctacaggacatacatggtaaaagaaaagaacaaaaacttccatcagtcatcttctaaattctatgcacatgctgtagcacttgcatgataacacataatgcaaatacacacagtaatgcacacgtaattacatgtaatagtttttaattaaaaactagaaaaaacaaaatgagtttttagaatatactcagaagatactaaacttgcttatatgatttaggcttataactacattaaaatatgcttttaatttctctgtcatgttactaaattctttaattcatattcttgacttgctacctcatacaatagctatacaaacctaaagatgtcttagctgctttgatgaatttatttgctttctaaacttttatccattcaaattaaatgtacaggggatgagacagcaatagagtagtgctttttgtagcagtacaatggccagggccagagtaacagggtctgtgtgaaagacaggtacatacatcttgaaggcttattggtcagtcactgtaaacaaactggcaaccaataggttcaatgaaagactgtttcgaaagttgatggagtgggctggtgaaatggcccagggagtaaaggaacctgttaccaagactaaacacttgagttttaaccctgaaatctatatagaggaaggggaaaagtaacatgagttgacttttgacctacatacacacacacacacacacacacacacacacacacacacacacacacacacacacataattttagcaacatatttaaaagaaataaaaagaatggcgagtgcctgagaaagacatctgatgtctgcctttgatcttcacttgaacaaataaagtggagtgtaactgtccccatatggatatcaatgcacgtattacaaatgcaagaacacagaacaaaagataaaataaacatattagagttgcatattaacatataagcagcaatgttttaatgatataagggaaggaggagtttcagtctcattagagtaacaggtattaaggaaaggtgatgttaccctaaacaaactcatgcataagtgtatgttctacagaattccagcacatagaaaatgatatactactagcttatgaaacaaagccggggatccatcccatatacaaccaccaaacccagacactattgcatatgacagaaagattttgctgacaggacactgacatagtgctcttttgtgaggctatgccaatgcctggcaaatacagaagtggatgctcacattcagctattggatggagcgcaggcccctaatgaaggagctaaagaaaatacccaaggagctaaaggggtctgcaaccctataggagaaacaacaatatggaccaaccagtacccctccccaccagacctgtagttgcacatgtagcagaagatggcctagtcagccatccatgggaggagaggaccttggtattgcgaagatcatatgccccagtacaggagaatggcagagccaggaagcaggagtgggtgggttggggagcagggcagagggagggaatatggggctttgggaatagcatttgaaatgaaaatgaagaaaatatctaataaaaaaggccaaagagagagagagagagagagagagagagagagagagaagttaggttacgtcaattctggtaaggcgtgttgctgcaagttctgcagtacccggcccctcattcaatatggcacccctgcccagagcctgcgtgtccaaccacctccacatttgctcccaggagaagatcatgtaccccagtaggatggttaaactccttctccccttataaggtaatctctggcaccactggaattcctccctatatgactgatgcataaccaggccctggacttggtcaaagttgtacacacttctaatggtctaagcagctcctttccccctattaaaagctttctcactgaagctgtgttctaagagtatattctcatcttgtgctcacagctgcctgagatctcttctatatttcttggccacccccaaagttttggccttactttccctctcaggatcctccagtcaaaaccaggccaattgggctttgataggtgggaattggggccatgactcaaagtgcattctattttttctttttttaaaatgctcttgtttggggatatattactagtttatgaattgcagattctatgctatattcacaggactgttggtttcttcggttaacaagctgattgcctttgtgtggtcaagttttgatataataaaactaatacactggataaaacaatttaacagagaaaggctttgtgatcttagctttgaaggctttgtgtataatccactgatcacttccttccttcacttgtgatatcatgatgggaacaggtagctgacaaaactgctaagttcatggtagccagggatcagtgagaaggagagggggtggccagaatctgattattcccttcaaatgtatactttcaatgccctaactctccctgtctggggtcaccctctcatcagtaccctcttaatgatgtgaaattgcaaaacactgaaagctagacttttggaagcttgatgagatccaatatataatattatttttaaagtctattcctttctttttgcaagttttttctttgcattaagagtaatttctttcagcaaaatcttgctggtgtatgcaatagtgtctgcatttggtggctgattatgggatggacccccaggtggggcagtctctggaggtccatccttacatctcagctccaactttgtctctgtaactccttccatgggtgttttgctcccaattctaagaaggagcaaagtgtccacactttggtcttcattcttcttgagtttcatgtgtgaaggggactgcaaccctataggtggaacaacaatatgagctaaccaatacctccagagctcatgtctctagctgcatatgtagcagaagatggcctagtcggccatcattgggaagagaggccccttggtcttgcaaactttatatgccccagtacagggaaaacaatggggccaagaagtgtgagtgggtgggtagggaagcaggggaggggcagagtataggggactgtggggatagcatttgaaatgtaaattaagtaaatacctaataaaaatttgaggaaaaagtaatttctttgaaaatgagttctctaaataagatgtttattaatccaaacagccaattttagttctaagtagacaaacacccatacatcaaaccttttcaacttcttgagacatatacatttatacatacataatatatacatacatatacacacacacacacacatttacctgtagtatttgttattttatttattttaaagagtacttcatacttactgttgtaatgtttttcctacatatcaaaaacagaccctagatacgtgggtcactctgacattagagaaaacaatttttgtctgagcacactgtctctgatttggtttgctactctgaaagcttgtgtgatgatatttaactgtagccaaaaactacagccctggtaactaagaaacactatcctcctcatcttttgaaattcaaatagctgctgacagtttttcctaaaatcaaggatttcaacagtagttaacgtttattgaggactgactgtgttcagacacagaggggctgttattattatattttatccctataagatgcctgcggttaactacttagaaaggttactgtctagacaaagctgccaagaagcaaagcataataaaaataaagaaatctgactaggcatttagactaccaatctcatgttgttatcttctgtgtactcaattatttaataataaaaatttcccaaaccagaacaaaataatgtgttggcattggtgctttaatagaatgtgtgtgtgtgtgtgtgtgtgtgtgtgtgtgtgtgtgtgtgtgtgtgtgtatgtgtatgtaaatgttatatatatttaagccatgaaattaataaaatgttaggaaaacatgacatagcaatgcatagcaatgtggttggtagtcattgtaatacagataattataagcaacaattattatgcctatcatataaatatattcatatctggtacgatagcaagaatcatagcatcctgttgtttcaatcttcctagtatatacaacaaattaggatattaagactaactgaatcatttcttattcatttacctaataaataaacatatataatttacatttaatcttagctcatacatgtatgctcatattatcaacacacattgtttaaagacttgttgccatgtaatatgttgttggaaaataaagtgtactgcagacatatatactcatttgatgcttatgataaattgaagaggaagatgtgtttagcatcctcattttgaatttaaaacaatagaatctcaggaatgctcttatgttttcttggaaaattaattgcacataaggaacaaatatacattcagactcctggcccctccaactgtatctttccatagggaactattgaactatttcccacaattatatttaaagtgtcttgtaaggtgttctgcacaatatggttacatctgattaacactgaaatagtttctgcagctatgcctcttagagtatagtgtgagtcttatccaatagtgtaaaccaaagactgctatcacccacatgtgggtctgcttcctgatgcaagggctagagtgagaaaggaagagaaaaggaaggcagcattcattgtaggcttcctgagagggcaataaaaagtaagacttgaaggtgagttttcctgcagacagaagtcagactagaaagagaaacatgaggttgggggaagtgagaagtgaaggcttcaaggaaaatgctcatattgtgttgtctgtttgtttgtttgtttgtttgtttgtttttcctcctgctataggcattataaacttgctagaaacttctgtaaattaggaaaggaatctatctaagtcctcaaaatcaatacatgtaaaagacacctactacatttgtaagtcaatctagggctttgtgtcctagaaaatcttaaaaaggtgatctcaactaagtatcttagtattaatggtcatggtacagaagagacctacccttttggctctcaattttgaatcctttgagaaataggcctgaagtgaggtcaatcagcacttcagtgagttagctacatggtcttatggatatgttttcttttggtgaacttttctttctattttcctctatgtatctcagttcctttagtgtgccaaacaatcataaagtgacacagaacagtcatttacacaccagaatctagcttcatgtttttcatctttaaacattattttagggtgtctaagaagtcaatgacagatttttattcaaattgttttcattcatgggtgctgatttcataaaggaggagcttaaaggggcagcaccttgtgttctttatataactgagtctcctgttgcctttgaattacactttcttactctttactgatattcttgtctcaatctcaaatcttattttcttttcaagtctcatcaatagttatcatatgatttgtctttctatcctcagacactgttttacatagtttgccctgttaaaaagtagcataattataacttcagtctcaaccaaccaaacaagaaattgaattggaatctttttactaattaatatatcctgaatcttccacattattattattattgttattattactattattatatgtaaaactgatgttttatatttaatccatttctgtcctttctactacatatcagactcatgttgatactgtagattttttttgatccattccacataacatgataatttagcagacttttaaggacttatttttaaaatttgaaaatcaatttctatcattagttctgtaacatctgcacaatcctgagatctcttaaatcttatctaaaaagtgagagtcgtggcttctagctcacaaacttatgaataactcacaggcacaatagacagaaaaaaagttagtgtggtccaggcacctgctagcttctctataaatactttctagtcccgactatcagcatacaatgcaaatcttatcatttaatcccttataattcaagcaaacacttgaccctgctctttcagactcttctgagctgatgccttttggaacttcctttcattcacagtcctccttttttttttttccatattctaacaccaaaacaaaatgagttccagctaaggatcaagatgactgagttgttacatgttctattgcacttcctcatcattatataatctccatattatctacactaccattccacaaacagtttatatacggtccggagttagctgtcatactgagtgttgctagtaaaatataatttgtatttctttttgaacaaaacctgacaattttagttgaaggagagaagttgctgcaagagaagtattacagctcaagtagaaacaacaatgatatttttctgcctcatcttcatttcatattttcttaattctgatttctttctgatttttgtacctgcttcttaatagattgacaagatattcttcctacagctgccaggttttttgtatcttaggatggtgtcaattctcttcctcagtcacaattacacagttttaaaatattcatcctactcagcacatatttggacagtggaggaggtgaagcatgttggatcattctctattttagaatcaatggatcattgaagattgtatgcaaatgtctgtgtacaaatatcagtgtgtgtgaaaatactgctcttaattttattgtgaagcaaagacttgtctaaagattgaaatataatacatacaaaataaatagattaatgtacaaggtaaaatatatccaatgcaaggaaaataagtgataccaaatattataatgtatattatacattcacagaatgtttactcttaagaacaatatgcaagttcactagtaaatagttaatagccgattctggtgcttgtggattctgttagaatccctttgcagatggtaacactgaattataaaagttgaagtaatttctacaggatcaccctaaagagtaattgtctctaaaactcaatgaactttcttccacttgcctgcgtgtaccagtccaaggcttctagtacacaacattttctttattgttgtgtctcatttattcatcctaaaacacctttcactaggtgagcaatgtattatatgtgacagtatttttcatagaacctactgtgaggaatgagggattactctttagaaacaagttttaaatgtatcaatcaatgcatagcacatttagctttcctggtagtcattctttactggtaatgatgttgataaatattcaaagttgttctgagcttggggacccagaatatttactttcctccaaagacctcatttgctggtttcccacttaatgaggtgcatctaacaacaacaagtacatatccctatttttaatgacacaaacctagactttgttttagcttactaatgtgcaaaatgattgttgtgtgacttttcctggggagatatgaacaaacatctattcatttgaaatagggcattgaggacagaggagtaaaccatttcacccaaagttacatcatacctactacatttttttcattttcttttattatatattttctttatttacatttcaaatgttataccctttcctggtttcccctctggaaaacccctatataatctcccctctccctgattctatgagcatgctcccccccattcacccacccacccactcactcccacctccctgcccaggcattcccctactctagagaatctagccttcacaggaccaagggcctcttgtcctattgatgccaaacaatttcatcctctaatacatatgacatggagtgatgggttgctccatgtgtactctttggttgatggtttagtccttgggagctctggggagtctggttgcttaatattgttattcttcctgtggggttgcaaagccttcagctccttcagtctcttctctaacttctcccctgagaacccagttctcagtccaatggttggctatgtgcatccttgcctctgtatttgtcagggtctagaagaacctctcaagagacagctatatcaggctcctgtcagcaagcactttctggcatctgtaatagtgtccgggtttggcgactatatatgagatagagcccctgctggggcaatctctggatggcctttccttcagtctctgttccacactttgactcagtattttctcttctaagtattttgttcccccttgaagaaggcctgaaacatctatacttcggtcttccttcttgaacttcatgtgctctgtatcttgggatttgatgatccctattcactcatatacacatttatacaatacatacatacataagcacacacatttcaaaattctaaaataaatatcaaaacatagtatctatgatttccaagaactcaggaaattgtcctttgttttgaacatcaatccctctttagacatacagtttgtaactatattctttgattcaagggtttcctttacgttttcttaactgtatgttcagtagtgttaaaggtagctttttcatttgaattaatatttacttgtttttctttgttctattcctcataactcttatggcatacccaagaaatgaagcatctaccttctgcaagttacatacactcttaatttgcagttttactcatctctatagatagataatttatgaatttctatttctagatttatttaggttttcatgctatagattcagtaaactaacctatttaatactcatatatttatgtcatttaaaaatacttcatctttagtttgtttggtttttttttttcaaatataaacacataactcccttccggaaacttggcaaatgttaagttaaaagttctagtactacctgtattctgaaatattcttttcatcatactttaagctatagttctattacctgataagatctcttgctagaccaagtaatttttttttaattataatctgacttaaaagattttataatcagtggtattttgtctttaggaaacattcaatgcaatgttcttgaatgtgtttttattatttataatatttatattattttctttaaaaatccatattcaaactctattagaaatctatccttatgtgaagaatatataaattcaagtaaatggaagtgatatatcccttgtggaagacatggctttgtgttagaagtgggagttcttttgcataaagttattttgcatatcagtcaattagtctatgattctacttatgctgataggttctgtggaataaaatctgaaatattgccattaaccatttggtatggcaagaattatctgctatgatctggtaaatgtatatgacattgaggttgaagttggatgaggaaagctttacaacaaaagcatcagcaacaaggagacaaggataatgaggaggtacaggaaaaatcccttacttcagtgctacttgctgggcttttgagagttataattaatcacatccctttcccatctgcactccgaatcaagtaagaaacaaaaagcatcgtcagttagggattaaaatatcaactttaatgccattaaacctaggtgcaaaactactgttttgtatgccatgataaatgagtcctcttagaacttctccaagacaaggccagcgtacagttaaaatattgatactgggaactttctttcctccaacctgagaatcactgaatatggaagcagagtagggaataaagtccttaatgcttgtaaattattcattcaaaacaagtgatgggtgcttgttcattacaaccccatcaatcaggctcagtcctttttccaaagggagaaataaaacacgagcaaaggagactcagattgatgaaggaaacacatgtaagattctcctatggaagcaaagtgggtgttttcttacataaatctcactgtactggtatagactttgaaaaaatgtagacatactttttatgcagtgtccaactatcaatgtattttcacatctatgtggtagaaagagagtcatttgtttttaggaaggtggtccttcctaggttgtcatgcttcagtgggtggatgcacatccatgcacactaacaatactcttcagagtttgtagattaaaaataagagaatataaagttagaagtaagatatggaaagctttttatgatgggagttggatgggaggaaactggtggtgtttgatggctcagaactcagatgcgaacttttcaaagaataactgcaagtatattatagtattggttattttatttatttaaatttatttatttatttattttattttatttatttatttcacatatcctctttccccatttccttcccacctacctctccattcccaactcaccactctagcacccccttatgctggagtatcaagcctctacaggaccaaagggctcccctcccactgatgccagataaggcaataatctgcttcatatgtagctgtatccatgggtccccccatgtatactctttggttggtggtttagtcccttggagctctggggtatcgggttagttgatattcttcctatagggatgcaattcccttcagctccttcagtccttctcctaactcctccattgggaatccacaggctcagtcccttggtaggctgtgagtatctgcatctgtattggttaggggctgacactgcctctcaggaattcctgtcagcaagtacttcttggcatcatcaagtgttggggtttggttggatccctatgtgagaccatctctggatgagctttccttcggtgtttttaaactatttatcaaatcattaagtgatagaggaatttggaaaatatgcatctaataagacattgacatctatcatacataaagagttccaacaattcaccaaaaatctaaatgacaatgaacccaatttaaaaatgagaaaatatctttattgatatttctgcaaggcaaattgctaataataagagtgcaaaaataatatcaaaggttatttatataaaaatcaaatataaaaataaagtaaaatatcatagcactcttgttaagatggaaatggagagaagcctaaggaaaagaaagtgcagttacaggcccaaagtgagatccagctcatggcgaagccccaaggtctgatgctattactgaggctatggagcgctcacaagaaggggcctagcatgatcacactccagaagatccaacaagcagctgaaagagtcaaatgcagatatttgcacccaaccaatggacagaagctgctgacccctgtggttgaattagggaaaagatggaagaagctgaagaggaaggtgacagtgtaggaggaccagcagtctcaattaacttggacccccgacatctctcaaacactggaccaccaaacaggcagcatacaccagctgataggagtcccccaacacatataccgcagaggactgctgggtctgagttcagacagaaaaggtgcacctaaccctcaggagactggaggcaccagggagtttagaagtgtgatggggttagtgaaggggagtaagggagaggtgagggtggggatatccttgaggaaatggggccggggaggaggtagaggatatgaaacagttagagggagggcaagggggggggagtaaaatctaaagtgttaaaaaaatataataaaaagaggtaatatatatatgtatattatatatttaatttatattaaagatggttgtaaaaaagagtaaataaaaagaaggaatatatacatatatttaaaaatatgtgattgttgccaagccagaaaaaaatgcaggtaatagaaaatctagatgatgtactgagacatcagaacatttctcctttgatggttggcatgtaaaataatttagccatgtggaaaacagtatggtgagtcttcaaaagttaattgtgccattaatattcaatctacaagtctcattctttgatataaagctaaaataatcaaaagtatgttttaggaggtatatttatgttcgatatcccagtagtcacaatgtgcagaaaatggaagtgtgaacatacgaatcactctggatgagggatatacacagtttaataaatagctgctggtacagaataattatcaactcataagaacactgaaatcagtagagttcaggatggaaaaaagagaattgtggtttagtatttgctttgaaaatttaaaaaggtaattaagatcatattgcaaagataattaataagataatgcaaaaatatacttttcatggctacgtgaaaatttaatacaagcacagtggtgatgttggcctagaatatcatcttagatgtgtttatactttaatatattgcatgcttgcacattacctcactcaaccatcaaaacaaacccacaaaatgcaaatggacatagtttaaaacatatacacaccacagctgaggaattatagctctcctaagtgaaaaaaacctaactcaatccatatgtttttattttaatctagtaatttatttttacattaatcagcaacttctattgttgccagtggcaatagtgacacctggctttattatgagttttctcttatgccaggcagatatgtgtgcctgtgtgtgattaattctgttcataaataactctataaatgaaattaaaaactgtattggcaattctgaccatgaatacatgtattctaaggttttagacaatattaaataatgtattttttgagattagaacataatcactactgaaaccttacctgaacagtgtgaaaaatattttaaacactagagtatattcaaagtgcaaatatgaaaaagcagcattctaagaaacacacgtacatgcacatatacacaaacataaacacatatgcacacacgtgtgcacacacactacctacactattccacctcagtttatctcacaatcatctgtttcttgaacacttttctagttcaaggaaaactgcctctctcctttcccaggatcctgtcaaagttacttctcgatgaacattcaaaggtttgctcatctctttaaaaacacatcagattcccaccatctctcattagtctagagctactcttatttctaacagtgttaagtctcacaatatgactttctcccttcaaattgggatctaacatgtatatttcacatgccttgctactgtgtatccttaagtaatcaacacaaacaaatcttttaagatgaaccaccatttgctgttcatcctaactcctcccattacttattgtacagaacatattttatttcatataaaaagttgaccataatgtgaaaatatcacattactataatggttggcttatggccttcttctcctataccgtatattttctaagtcttgaaaccataaatgtgcttcattgcctgtgggcatagctgaggactcatctcatcagtaagtgaggagtgaacaacgaatctaatgtgtatgatgaatgtcagaatgagcaagcttgagtagccaccaattctagcattataacattcaaaatcactgattgttccaaattgacatttgatctttaaccctttttttttttacagtccagtcattatccccctcctggtcttccctgcaacagttcctcatcccatcccccctcctcagtttccaagaggatgtcccaacaccctaaacccaccaggcctctcactacctgggacctcaagtctcttgagggttaggcatgccttttctcactggagtcagactgggtagttctttgtagtataggtgtcaggagcctcatatcagctagtgtatgctgcctggttgttggctcagtgtctgagaaatctcaagggtccaggttagctgagcctgctgatcttcctatggggtcaccctcctcctctgcttcttccagcctttccctaattcatccacaggggtctggattctgtctattggttgggtgtaatctgactctttcagctgcttgttgggcctctcagaggatagccatgctaggctcttgtctgtaagcacactataacctgagttatagtgtcaggtcttggaacatccccttgagctggatcccaatttggtgtaatcactagacttccttttcctcactctcttctccatttttgtccctaccattcttttagacaggaagaatacttggtcagagtttttaactgtgggatggcaaccctatccctccacttgatgccctgtctttctactagaggtggctctacaagttccctcatctcactgttgggaggtgagggacacttaggactcaaagggagagaccttagatgaaatgccaaagtagtacttttatatattgatttttattaataatattaactgactcattgctttcactattatgtgatacttctcatctaatggatctctctgttgaaattatgttatatctaaaatgcatgctatgcagacattttatcacattttctttcctgggttattatttttatcagagctagcacaattagttttagaccttgactcttccattagtcataaactgaaccaaagttacattattctctatgggaagaaatttattttacactccacaaatgcttgaagattttgttaatatttcctggtcataaatgtctttcctgattgtcagtgtatgaacttatataagatatgaattcgccattggtttggtattaaacagtgcattctatcaataccaatgaataatgtatttctattttattctttttagaaattcatacaatgtagtttgaccattttaagtgcacatcttcaccttacttctcctagatcttccttcaaatgccatgtcatctttttgaaatgtatgtattttatcaataccattcatataaatttggatgtgtcacaatttacctcagtgtgatcatcctctcaagaggcacactctttaagaaaactgactttttcttcttccaaaagttatcaactattcgtagtttctaagaaatatagggtaattatcccctttttacttcatgctagacttctgactggtttgctcttgtgtaagcctatatgttatgatgaatatatattgcttttatcaaggaaaagcaaagcccaacaccacatgctgcaatcaagtaaatacagtgttagatgaatccagaaagaaaataattataataattataacaatttttcttactgtttatgaattaagtaagttacatatattacagtttgttctatcaataaggtgtaacaaatgacccattatgttttgaatcattaaattctattaatgtagaacacactttgaatccaaactttaggaaacttaattaagtttgctagtttgagaccagtgtagactgcatagaacaccacaagacaagctgagatacatagtgagaacctgtctcaaaaccaaaccaaagcaacacacaacaattccaataatgtaaacacctaggaatcatatgctaatatgaaacttactaaaatttagctttaaatcagtacgacttcctgtccccaagaattactttttaaaaataatttacatttctaatggatatttatgtatttacatttcaaatgttatcccctttccctgatttaccctctgaaaccttcctaactcatcctcccttcccctacttctatgagggtgctccccttcccacccacccctcctaccttactgccctggcgttcctctaccccaggaaatccagccttcacaggatcaagggcctctctatcttggtaaatctctccattccaaatatgccccggcaatgaaaacacaacacaattaatatgaatacatgctgtgtgcctagattgggcagatctactgctacactaccatcttccacacctattgatctcatctaccttagagcttgaggtttctcgagtccatgtgcttctgctgcatctttcttcttcttcctcctctcccttgtgccctctccctcttccattttctccttcttctctctcctcaccttctgctctaccttccctcatctacccaattaccaactctcctttattttacaaattaaggtgggaagcgggatcataaaaaatcacctaagtgctgactcattccttttttgcagccactcacaggggaacagaattaacatcaaatataattagcctcggggctattcagaatatctcttcttctattgatgccagataatgccattcactgctatatatgtggctagagccatgggtccctccacgtgtattctttggctgatggtttagtccctgggagctttgagaggtctggttggttgatattattgttcttcctatggggttgcaaaccccctattcattcatgttcttctgaagttagaacctatgtattcagaggaatggacctctgtgatctatcaacaggtttgagtcaatgtggtctggtttgttgtttcaacaagttttatgcaaagtatctagttgcagagaatctgcgaaaactccgtcttcggctgcctcatgcctataggtaaacttgtgaaatactaaatactacacattaaataatacaaatttgacaacatcttcatttctatctgacattcaaataatatagtagcatgctatctattactgaagattccacagacataacaaaacattttattttccaagagtcagttataaaaacacccttgcatgttgtaactgatttttagagatagatactaactggccaaaagtaatctgtccctgccatgaacacaagatgttcattttgtgtatactcaagcaagcatccatatgtgcagtcattgacttttgtaatagccatgtttcctactgctaattgatgtgtagtaattaactagactttcattctgtcttgtttcaggggcattctgtgcactgagcaagtagagtaactgctagtaatttttgacaaagccacttatgaggtagaaacaaaatacacttcacagagagataaaaggcagtcatattgctgctaacaggtcccaggccacttccagtgaatttttgtttacagaaatgtattgttattccaaaaataataaaaaagcaaaagtattatgttgggattgacttcttagaagttcttgcattgcactctgaatatccctgctttgttctttaatgagatgtttgatttcatacaaatttattcagaaaatgtaaaggaaaattcaattcatgtgcatagtttttaatttgaagtcatttccagaaattgagcatgtatatctttagagcttaagggaaacaaacaaacaaacaaaaatcatgtatgtgtagactgttttaagtgcttcaaacactaagacagagacttaagtttttaagtagttttgcgatcttaattttaaacaagaaaatatattttatagttgggaaatagtgaatgtgaaaattattgaaaaaatacatcctagatgtagcacagagttattcaataaatgcatagacctcataattggtagacctgtaactatttcttcatctgcaagctaaagtaaattatttatatttcagaaggtaaaatattatataaataaaacatgaacatttttataatagggacagaaaccaatattattaattaataatataattctggtaagtgcttgattattcccagtaataattttgttttgcaactatttctaaaaggaaaacctcccttcaccaagaatttctctctatgtaaacatgagtatattaactcacccttcacccactcattacccattcagtctgaagaggaagacacttaggtatttgtttcatatgtactgcataaccaaactgaaatttcatctcagcaatgggactacataatttaacatagtatttaaacacaaaattgaatcattttaaaaatatacatgttaaaaatctcatgttatcaataagccatacaggtaataaactcaatctacatgtggctagcaatatttaagagagctagaataaatccatacaataaaagttggaaatggtatgttttaaaagagtgtacaaatataagtttttatttaattcttgaaaaaattcaataggtaaactattttgtattttagcctgtggagtcctaaagtatattagatattagatataaactaactgttactacagttcttctcttgcataaaataggcaatcttatttcataaaattaaacatgtaaataaacattagttaaatcagcatgtttctcaagacaaaaaagaactacagcagtattgtgtctttcagacctgagctaacacaatttcattgcctactctttaagacaatacaattacatttaaagataaaatagaaagcaatcattttgtaactgtgtaattaatatattttaattatttcctgagagattttaacaattttaccaataaactgaagtccattgaggctttcattctggcaattgcatatcagagtagatgtttttctataactaaggaaaaatgggcttagtattgtgaagtgtctgatcgatttgcaatggtagagaaaggggcatgatttatacttacatgttaattaaagttcacttgacacttttattcaaaacaggacttgcacttttaaaccagaataggacagagacatgaaaagtgctactctacatgataaaataggtaatatgtactggatgaaattcaaagatactaccaactctacaatatctgggtaatttctacttcataggtgacaagttctcatgagactgtttataagtgtatggatgttttcatactaagtatttgtatgtcctcttcggagatatgtgctaaaggaatttacaactcagagaatttcaaagatttaaataagctttataatattttgtcaatatttctgtgctccaatcatcagtgattcactttctgaagtgatctgaaaggaacagatgcagaaagtggagggtgtgtgtgtgttgctgggcatgtgtctttgtgtatctgtgtgtgtctgtgattctgtgtaagaggcgcggaaggaagaagggagggactgagagaaggaagaagtaagaagacagactatagaatatacaaaatgagctgattgcaactataagaagacaatatgtggaagaaaatatctaatgaagagcaaaagaaataatgatttaaataaattggtaatagtttcaatcatactggcagttactatttagtaaatatttgttgtatgccagatactttctattaagtatgagttgtatggtttttgtcaagtaatcctcataaaaataccaaaacacgataagtttgtgtgcattttataaataaccacgaaaaatgatgcttcaaacacagcaaataactcactgaaggccatacatctaataaatggcagtgctgggaacagagccaagattgatttagctccaaattatctcctttaaccaccagggtgaattgcaccaggcaaaggctttccatgtatcatctcattgacttattgtagcaatttagtcatgagttcttaacctctgtattttattagataaaaagattgaagttcagtgaggtcccatggacttatgtcagttcaccagtgagtgtgaggttttgaacctctgtctctgtcactcttcatcaatgaaaagttcaacttgatggaatagataagctgatgagggtgtgtagggcttgcaattcaatagaacaaaagaaggaaagtgagagttccccgtggccctcattgggtattccaacaggatccattgtagaaatgatacttttgaaagatcttaagaatttaaagcaagacaagttgtctccttatcttgtcatccctttgagatattctttacaacacaaaattggtttgggacatcttttccaagatctgtttgaggtccataacctcttatatctgaacaagaaaagataaatcacaaccatacaatgattagaaaaacaaatgaaagcaattctttgaggacctgtccatgaagtgaccagccgtctgaatacgctgaggaagcctgatgtcttgtggaagaagtaacataaacacctgctgaaaattccctctaatgtattcctctctgtaaccagagggatctttacaaagtgcatttggaatcctgatcttctttgtttccacagtttggtggttgcttcctgttgctgaaatgtaaacaggcagggatcatgtttatccagtctcttgtctgaccctgcattatttagatacagtctcaatgtgtggtgcctgcttgctccaatatatatcccatatactatttgagcaaaaatttatgtgcatatgtgtatatcgatgtatttagaagtgtgtcagtacatatttaaaagggagattcaagcatgtgcagaccagcgcttcatatcagatgtcttattatatcgactcttcactttcctttctgagacagtgtctctcgctcactggaatgttctagctacacagcttgctctgaaaatccgctgtcttgacattccagtcctgtaaactatcacaccattcatctgttgagacagattctggggatgtgtgctaaataattttctgtcaacttgacacaagttagagttatctgaaaggaaaaaaatcttaattgagaaaatgcctcagtaatattcagctgtggggtattgtgaagccaaacctactccattttggaacctgcctcatcttataaaagaaaaaaagaaagccggagaaattgacctgcagcaaaacccaagctgtatccacataccaggaaatactccatcccagcttgtccctggctagttactacctagctatttcctagcaacagttaatcaaagattagtctcaatgtttcagatgaactttcagactctttgtaattgtatatagtcttgtgttcagagcacctacctatctgcttacaatagacattcagttatatacctgctaggatagactcctctactacttccatttcccagaaaacctttaggagagcctgaattaagcttttaataaagagatcctaatgctattacatctaaaacgactcattggtggtcttgtggtgttctcaaatgcttcctggcacaacctattttcttagctaatgattgatgatggagggaccagcccattgtggatggtaccatcactgtttttgtggtcctgagttctataaggaagcaggtttagcaggccataatggacaagccagtgagaagcaatcctccatggcctttccatcccatactgccataaggttcttgctcagcttgatttcctgcttgcattattttctatgatgaacagttatatggaactatgagtgaaagaaaccattcttcattcatgggtgtttcatcacagaaatactaaccaaagacattatgcaaacccaggtcttcagaccccttcaaaccccttcatccagttatgccagcccctactaaacattattctaattcatttgttgacaatcagctgattaagatccttttactctactaagaacttgcatttagacaagaagtcacacttttagtgttggcgagcatggtctttactgcaccagaatcacatattatgtttagataagtggggaacatcatctcttctcacagtgcaacttaaaggcacttagcagacacttattcataccagttttggttccttgattggaattctagcatgcctcttatgattagtcttctttagctcatggctcacaagtccttggtttcaacctctgggtcatccttccttctccaaatgtgttccaattgtgtactggaatccacagtgcagcacccttgataaatctggtaattttaacacctaaatcttcttttcattttgtataattttggcatattaagtaagaattaatatcatttcttttattattattattaataaatttgtttacctcctgattgaagctccccctccctcattttattgcagtctctcttttacttcccctccctgaccatatatgcctcttccccttctcctcagaaaaggggaggtcccccacggatatcaatcagccctggtatgtcaagttgcagtaagagtaggcacatattattctattgaggctggacaaggcagcctagttaggggaaagagacctaaatgtggtcactgtagtcagagacaactctcactccctctttaggagtctcacataaaaacccagctctacaactgttacatatgtgcaaaggtcctagatccaccccatgcatgctctctggttggtaggtcagtctctatgagcccctatggtcccaagttagttgattctgtgggttatcttatggtgtccttaaccccactgtctccttcaatcctcctgcctgtcttccacagaattccccaaactgtacttaatgtttggccgtgggtctcttcatcagtttccatcagttgctggatgaagcctttctaataatagtaatattatgcacatgtctgcaaatatagcagaatatcattactagtattggggtgggatcattctcatggcatgggtctcaagctgggacagttattagttcacctttgcctcattttctgctccatctttcacccctgcacattttataagcatgacaattttttttaattaggcattttcttcatttagatttccaatgctatccaaaaaagtctcccatgccaccatcccccccccccccactcctatacctacccactcctacttcttggcactggctttccctgtactgaggcatataaattttgcaagaccaatgggcctctctttccaatgatggccgactagaccatcttctgatacatatgcagctagagacaagagcttcaggaggtactggttagttcatattgttgttccacctatagggttgcagttccctatagctccttggatactttctctagcgcctccattgggggccctgtgatccatccaatagctgactgtgagcatccacttctgtgtttgctaggccccattatagtctcacaagagacagctatatcagggttctttcagcaaacgcttgctagtgtatgcactggtgtcagcgtttggaggctgtttacgggatgggtccccaggtatggcaattcttaagtctacagttttatagctggtttgatgtcccagtccctccactggaaagcctagcctgtttacagacaatgtccagtttattctcattaacccctccccccttgctaggagtcttccctaacatctctttcatagattcctaggaatttccatttttgtatgtttctagctcatcgcagagatgcccctcaccccaacccatttgtctctctaattttctctcctgccagtctcctaccttatccctcctggtcctatatacctccctttgctttcccactcccccctcccatctctcaatgccttcattcacccctgatatctaattttaatctattttcccttctcagtgagattaaagcatccttcttgctccctccttgttatatagctttgggtctatggtttatagcatagtttatactgtactttatgacaaatatctacctgtgagtgagtacatgtcatgttttcttttgttctgagtctaggttttctcacttaggatgatcttttctatttccatccatttgcttaccaatttcaaaataacattatttttaatggctgagtaatactcaattttgtatgtatgtgtgtgtatgtgtgtgtgtgtatgtgtgtgtgtgtgtgtgtgtgtgtgtgtgtgtgtgtggagagagagagagagagagagagcaaattcaaaagagccaggtgcatgatcaaattatgcataagctgtattataaatacgcagtatagagaggctgtcttctctgcctttctattgcatccactgcacactgatggcttttcccttagacaaccaatagcagcatatcagtatactaattatattttactcagttaacaagactgcaatgaatatccacaaactataacattttagctacatagaaactctttcaccatttgtgataaaatattgttctgttcagctttgtattgaaatctagaatgctcttattgaatcaaaaatgatttcttctttgttttggtcactatcctattattttgaaaagacaccatgacaacagcaactcttataaaataaagcatataaatggagcttgcttacagtttccgaggtttagtctattatcatcagagcaggaaagcatggcagcagaaaggcacacatggaactagagaggtagctgagaattccacatctggatccttggaaagcaggaagagggatattggacctggcttgggcttatgaaacctcaaatctgaagcacactctcaatgacacacatcaaatagccacacctactccaaaatctcatgtcttccaatcccttccaagtagtgccactagttgatgactaagctttaaaatatgggagcctaagggatcgttcttattcaaatcaccacactctctcaaatgaaagtttatctgaaaacattaaaaattacaatattatatttagtcaatatcctatacagctttgcacagtaccacttgccaaggagtagagacaggaaaatgtctgttccacttgcttccaatccatgtgactatattttttcgcatcattcgcattttcagaagaaaacaatgggctataaaattgtcaggaatttatcatgttttcttcactcaaaaatgaatttaaatgttgaaaaacaaagggaattctgaggaaaataagatgtaccttgatcttgtaatgctaacaacttttaaagtatttatttaactatgaatcagtccttagtaagaacatgtcaatattgatccatgctgtatgtacactgtttaatcttttatttaagaatacagtgcatgaactacttaatttctcatagaattactttggtgacagaaccataattagttaagcattgcatgttctatttttttctcactttctatctttactgctgctggtttggagcagtgaagctttgtctccttcaagtaaattcttagaaacagaattactaattcaatggatatacttacttggagatgttttaacagatatatctaagccgccttcaagagagataaccgattttcctctgcctcactctgcatttatcaacgatatttttaaagcttagttagcttgatagaacaaaaacctttattgcttatttcaatttaacatctacaatttttaggaatcacagtaattatttgtgttgatgcttttgtaccttataataacacttgaacaatactaattacatcaaatacacactttgacaacattttcacatttattattccctaaaaatccttagcagccatggaagataaacactggagccagttattgttaaagcatgtcacagtgcatagcaattagtattcacaaatattcttccagtgtcgcatttaaagtggatttcttcattacttcagtagtgccttgccttctcacagttgatatattgaaagcagggatttattccttaagactaatcctttttcaataaaactgaaaagacattatttcattataaccagatgaggacataaaccagttgctgacaatgcagtgtgtttattttcagactacgctttctggccagacttccataatttcaatttatgtcgcattttgtagtgtggtattataaatgctgtgtgccctttaaatctcagcattatttttgtgaagtcttcagtacacctgtttatcttgttgcatataattactgtaatactaacacgttctccttttaaaaatatgatgaagttatggtcattcataaaatcaaactaactattttccttcctctggtcttcagctgcctctccaagctaacctttccttggcagcgtggtgttagtaatttagtactttatagttatatatttgtaacttaaacaccatgttaaacttaatactttgtgaaatattttgatgaattatgttcctgtaacattccttgttgcctgagagaatatttcacaggaaaggtataatgcagtgaaatgggtgttttaatgatgaccctgatgtatttcatggctacaattactcccaaccagacaatcaaaattctttgatatcacatgtctccttttcaataaatgaaatagaaatatttacttacaagaggtaaacagttataatgctgatatttaccaacattgcttttggattttttctagctcatctgtccataggtgatcatcatgtctatccttctcttatcttttaattttttccttttattgataattgattttttatcacataatatatcctcattatagttatcctgcatttatccttcctaatattttcccaccttcctttctctccagatccactccctttctgtatcttttgaaaacaaacaggctttaaatggatactataatatgatataatatgtattatatcataactataatacaatataaaagataaaatagaacaggaactaacacactggatttggataaaacaagcagaaagaaaagagctcaagagaaagcacaagaaatagagatccacatgtttctatacccaggagacccatagaaacttggagctggaaggctcctggtgagcactcacacagctggtaagcgtactgcctcagtctctgtgagctgatatgagcttcgctcatattgatttagaggaccttctttttcaaagatcctctatccagtttggctcttacactccctttttctggaaggtttcctaaacaccgaggatgggaatttgataccattcttactcttatcaccatttaatatgttcatcttaatatttatgcatctgcacaatttaaaaactctctatttaatttgtctttaaataaggaggtttacttctttgaatgtttttaaaactagattttatgtttaatcgatttgtttttcataaacgtttccttgtttcctattggagtttctttctgaatttgcaaacttgttgagtattcatgaaagttaggcaaagttactgtatttaaagtatgtaagtagtttttgatgtggagaagttttaataatatagactttcaaagcattattttctatcaaacctatggaagaagtccctatttccaagagtattatgttttgctctcattcattgtgtatgtatggttacaaggagatcaaatggtaacttgtgggagttacttctatctttgtactctgtgggttcaagagattcggttcaaattatagggcttctcaaaaatcatctttatttgttgacccatctcattgggccacttttattcatatagtgttttgcagtgttttgtcaattttttaatcttaagatttaattttaattatgacttgtcaagaaaaataccatgaaagcacagttcagtagatctaccaattatatttacaaatgtgcacacatctcagcaaatttatacctactttttctagtattattcatttaaccataaataactttaaattttcatttgttaaaatgacaccttattatgtacttatttttacagagtttgtctattgtaggaatctttaagtagttttttatctgtttgtaaattctgtgcttatcctaattattgtagtacctcaattaataattgttactcttacattttatacccagaggaacaaaataattcaacttcctctcaatattcatgtctattctcgtgttattttttatacaaagaataatgctttgctttaaaaatgaaaagacagcatttaaattaaaatattttaaattaaatcttgaggtgacagaggaagaatgcaatactgtttcctttggccacatgcccattggctgaggacggggataaataatttagatttttaacaacttgcttttgctaattgtttatcattttattcatttgtagctctttgtcattgatcagaggtaatggttctgcaatgaataacctaattctgtggaggaagttgaaagtcagaatttcatttggtaactttaagccttgcatgtgtcaagctgcacagctgctatagttgagattctcaaagaaaaaagaaagcctaatatgtatttattttttatttatcgcaaatcagagccatataacatagtgctcaccattccatctcataagtgtgagtttaattcatacgaattcactgaagtaattcgtattattaatcttggcatttatcttaaaattatagcctctaaatgcgagcaaaatcgtgaaaaattaaggaaaggaatgctacttgcactaaagagaacattgcaactttatgtaccaattaaagcctataatttcaatggaagactaatttgaaatttataataacctatgagaaatgctttgcagggcatagtgtctcaattctgcaatgtcagctcttggggacctgggacatgaggttaagacgtttaaagacagctcgcattagagagttgaagaatctgtttcaacagataaatattgataatgagaaggaaaaggaaagggaggggaagaatactgagagaaggaagaagtggaaccaaaaaaaaaaaaaagtttccagaaaatctccaaaataagaaatttgaaattcaatgtcccaaattaagaaggtggatttgaagtgcactcttttatacatgaaccactccaccaagtattacatatgctatgccagtttggtacatcatcttatttatttttctcataaagatccaggaatcacagctgaccatttgtggccttcatggccagcccagtggatttccagcttgttaaattctccatgtagtctggatggatctagtagttatataacctgtggttaggaagtagagggagagataagactcagaaagggaaacaagcatctgcccctctaggccctactacagacttctgacctcaatgctggtctccatgggggaaaaatagaaagtgacaattatgcaaattcaaatgtaaggttttgattaacacatcatagaaaccaagtatatatcacttgaagttactctaagtttgttgttattaaagacatatcaagcagactcctgaaaattgcctagatttgtgcaagaaaaaaaaggacattttatagactttaaacagaaaagttagaatatgagagatgaaaagcattctactcaggttcatatgaggttagtgacttttaaaagtgtccaaattctaattttaggacatcgattcagcaccaatcagtgtgttctgtacacaaattaacagaactatcttattcttaggaagtggtctttgtctccacatttatctatttggtgttaaggtggccttaaatcccacttttacccaagtacattttaaatacaaggctattgggtttagttagatatcatacacattactgaagtaagaaagaccctgggatttatgactttcaacttcaaaataaaatataaagagaaagaagtgaaaaagtaatagaaactggtgaacaagaatgagggtgattaaaatatattgtaaatgacacttctgggaaaagataagaggaaaccttatattaagacctataatccccagatgggggatatctgaatcccctggattctgtgagcaaaccaaggtcatctttggtacattctgcatacccagcctgtgtctaaagaatctgaggaaggataataatgactctctcagcagctgtaattttcatgctgccatcaatattaccactcattctcaatttatcatattatctctattttggtatcagtaatatccctaatttataaaaatgtcttcatgtttataaaggtactcttttacttaaatattaatgtacctatgaattagtaggcatttattgaatatcagttgaatgtgtatagggttttgtatctttccaaaatactaaagcagtaaaaaaaaaaatgggttagttaagggagatatgaaaatatgaccatactctagaggatttcacacttgaaatggccaaaagtcatagattgttttcactcatcttcattagttatgtatgtagacaaggaactggattaatgataacagtttccatgaggaggaagatttaaacaatgtacatgtctttcttcttcttctgataaacatcagagttatagcctaaaactctgtctgatattaaagttgataagaggtcaagccaaatatgtcacactatgggatggttcagaaacacttgcatacccttctaagagttccaaattaataacaagaagaaaaggaaatgtggccattaaagtaaatgtgtaactgtctcaatgaaataaaacctattaaaattatttacctataatacttccttcaagaggaaagaaatgaaaaatatttaattgtaaatgagtatgtaatataatatgatttcttcatgcacagattggatacattattttaaaaggtggtgattctagctctgtaggtaaatgcttaaggaactaaatacggcattggcttttgtggtacagagtctttacgtaaatgagcacatcatatagcaagagaccagtgacataggtgaggacatgtctcttctgagctttcaacttctaaacaactcctagggttaaatcacaagagctccagattgatgaccaaatcaagcctaatcaacttccaaagttcctccttcgtagcaagtagttagattaaatgtctttagaatgaggatggaatgtcaatgacaaagtcttagagaacaaatataactactctaaaacaatagcactggtagattagtgaaccaaacaagagtgtaaacacatctctcagaattgtcagttatttctttcaatcttagaagtgtaagtcatgcccagaagtataaatgaaataaggttcaaatggaataaaagaaagtttgatatatggattttattaggacttttaattcctaagaaagaaataagtaataaaataaaattttctggatttcacaatacctggttcagacttttaaaaatttgttatccaatgattttaagaaggtcaatgtctacaaaaggataaagactgtatattagtcacgaaaatgtgtggggagccgccctcacatttgccgttgcaagatggcgctgacatcctgtgttctaagtggtaaacaaataatctgctcatgtgccaagggtagttctccaccccatgtgctctgccttccccgtgacgacaactcggccgatgggctgcagccaatcagggagtgacacgtcctaggcggagaataattctccttaaaaagggacggggtttcaccattctctctcttgcttttgctcttgcactcttgcttttgctcttgcgctctggctcctaaagatgtaagcaatagagctcttgctctcttgcactcttgctcctgaagatgtaagcaataaagttttgccgcagaagattctggtttgttgcgttcttcctggccagtcgcgagaacgcgtgtaagaaaaatgcagttcatttcttaaacaaatatttgttgaccttgtactgtatgctaggcataattccccgtactaggtagatggccacaaacagcatgttgaacatctttatataggtttaaggaaaagtacttagaaattaaaggagcaatgagttctgtcctagagttgatgggcagtgtttatggaagctctttttcctgtaccttgataaaactagaagttatccaggttaggaagtactaagcaacagaaacactatgtgcagaaggtgaaatgaaggaggaagggactgaaacagcaaagtggcaatgcaatgggaattgacatgatgtcttgggaaatgaagacatagtaagtcatctgatctaaatttatacgtaaatgttatgttagctgaagaacagctcatgattttatgagcctatgtgtgtacatttctgctcctctcagatttctcttgggtacccaagtttatgaataaaacatattttacctggtatcaggcccctgcctcctcaattattaggtcatagctgtcataccctctaatgtatctgaatgtgtcaaagtcatagtgatgttttgctggctttagtcatcacactaatgaattagtgagagtaagtaagtacagcaatactggagcctaataggagactatttttcatcaggtatgtcagggtttctttcctaaatgggaattaattacaaaaaaattttgatgaaggaaacccttatgcaagcagaaaaaataataaagtaatgaaagattccacaggcaatatacaccctgttgtcataaatcagaattaaaggattttaagatatgtgcatgcatagaagtaatcatacaatttttattgaacatgtcacattttacatctaagataaagagatacataatgtagatgctttatctagtcagctgttggctttgatatttttgaaaatctactttaaaatgggttctaaaacacttgaatcttccttttagctcaccactcaccagaggcagtgaaaaagaaaacttaacagggtaaaggatgtggacctgtttagacaaatcagcagccatagctcaatccactagcaaacaccattcatgaatcagcaactgcagtttgatccagaagaaacctccaggctctgactattggcctgagtccagagaattggcaagatgctgcaggaatatcacacaagtactttggtgagtttctctctataaagacacaacaaacaatgatcagcaaagaaggcaagatgaaccaatatgacagcattgtcagctaaaatcagtaccagcaaaacccaaagaagaccatcaaagagtgcaagatgaatgaatgccacaatattgtccattggtccactgtctatagggctatacttaaactctttccaaacttcaagtgtcccctcaagcatgtgcaacagaaaaacactacatgccctttacccaggtaacttccagaacaaagctgcatctgttttcagcaaaacatcctcccacatttctgctacaacaaaacatcctctcctagacagtctccttaaaaacaccacatgacccaattgaagaaacgagacatttctacttcagtctcaatttttttttactatatctgtatttttattgaatattttatttatttgcatttcaaatgctatccctgttcccggttttcctgatagaaaccacctatcctattccctctttccctgcttctatgagggtgctcccacgtccacccactcactcccaactccccaccctggtcaagatgccatggtggtatacatgtctaatcctgcttaagatacaaatgagttatgtatattgacaaagacaccaaataaatcattcaacagtactccggttctcaaatatataatgttattcactcagctttttcatacttttttgctgttacagttctgagagcaggaatatcatattggaaattatggtggagccagaaggcaatcagcagcccacaataaaacagacgcaacctctcctcaggttcttttctgttgtttctgatacatacctcactaggcaatctaattttctctcaggaaaatttgtcacgaatctgttctttatcttgtctattcttaaaactttcagtggatagtgatataaacttttagtatatctaagattttaagatttttcattaactatgttagcattattaccatcagaatccgcacattaatctccatcattatcatcattttgtggattttttttttaatgtcaataggataggtcatgagaatatagatcacttaagaagcaggactttggtctctcgcttgtttgtggaaggaattcacagatgtgcagagtttgttatttttaataagcacccagagaagcatcactttagaggtcacatgatgtgggtttgttcttcatgtgacacctgccgctctgaattctccatgatgcgggtgcatttttttctgatgtcagtctggggatactttcacaactttgtttttctagtagccatatggagcttgtacatgcccagtctcaaggtttgacagagcatttcactggatggtagaagcagggacatgctgttcacctaagtgctgtcagttttggcattaacgtgtagagttgctgccaaggcttacataccattttctacactccagtaaggaagttcctctgccaaggccacttaaaatagcactttcagttatgcctagtacttcttaactctttggaggcaggcaaaaatttcatcatcttcagttaaaatgagtaaaccataataaatagtatagatatctactgaaaatggaaagatctgaaaacatgtgcagacagaaaacatgtgcagaggaacaaaaattatgtagataaatacacaaataagtgtaggtgcatgtatgtgcatctatatgcatataaatgagatgaaagtatttggatttaataaaagcacacagaaaaaaaaattcccattatcacaaactactggtagttgtttcagcatgtgttatgtgataggtagctttatgtgtaatagctggggtcagttaaaagtcagttttcttgtaaatcttactgtgattaagattttaacacacatatttgtgcacatgcacacacacaaccacatatacagacacacacagaggaattatatcattatatgaatctcttattttattacaacaatgagcatttaattaaagtatggattcagcatcatttttaacatcattgtcatttagggagcacctgttctatgcacatttttaaaagtttattctgaatcagttttaaccacaataaggctaagtggttaaattcccattttactaatgagaaaacaagaaccaaaaacttgatttattttttgtggccataaatattttaaatttaataaatatattttctttcaatattgaattaaaaactgtagaattaacgtttttaaataaacaaaactatgtgctcaaaaagtcaactgacaatttatttttcctgtctttctatcatcccttggcagtgttgcggtttagaagtatggcaaaactatttttaatttgtatgctgcatttggaaggtgtccaagaattcttctagttcaattctattatagtataagttcaagttgtgttagaaagaggttaactctcctgacagattccacatcttatttaagtagcaactgtagaagcagaagtcattcattctgattcattgcacaaagcagaagtgcaaaataaccttgaccttcaactctgtgctgagtaattctaccagtcctagaattgctaaagcagtggataaatttttatctgtgttgctacttttaaatgaagtatatactattataagtttatgtaaaatatctcatattataccaagtatataatactatatgacctataacattaaatttattttgttgctactttataactgtaattttgctactttttaaattgtaatatgaatttcagaaattcagcatacctgatacctatatgtgaaccctaaagaggtctcaacatacaggttgagtaacactgtcataaagtaagagttaaattataaagggatgttagagatatgaactgagttttcataagaatttaagtcctggcctagtgctttaagaaaaaaaatgttctataggtgtgtgcatatattctgacacacattcactattcaaacactttgagtagaacagggtccaaatatcaaatatttattttggtgatcttaagtgctaagagcatgaaaccatttcaggtaatatctgtagaaaaaaatatcttctctattgcatgtgtgcatcacctgtcaattgaaaagcctttgacctatggattaggcatgtaatgggaggtggtataccctctagatgaaagaattctgggatagagccaggtgcaggagatcaccccagaaagatgtgaggatatggagaaatggtaccatagcataggtatccatccacatgacagaatgtaggttaaaataaatagaatagcttatgtttctagacagattagagcctacctatatggccaaagtatttataaatatattttgagtgtgattcttatttctagaagcttggagctgagagaaataactggactctaacttgtacaaaatagcactccatgttgggggctgtatataaatgaattattattaatacaaatagcatcagtgaattaaactgttggctaaatttctttaagttatttcccagtaaccacacagattaaccaatgtttacttacaactgcccctcagtagctaagcaattaaatgatcaatctttactttccatgctaatctggctacctcccagatccatcccatgacacttgtatatttttattgacctggctctttaggccccttcttcaaggctccaatttctccaccctgccactgatctgagactctcaaccccccttctcccttcttcctctggttggcaggctcctaccctattctctattagctattgtctaatcagcatttattgacaaggatgggaataaacggtaagaatagtttacacaaacttgtgacaagagtttcttggtataaggattgcaatgctgtgtccatattgagtcatgacatgagggcagaaaaatcagcatttgactgacacaaaggtaaacctcacacagtgtacaaaaacatgaggtctacaaagatctatgactatggttcccccatacctgtcttttaacatagaaatttccatgtggtatagatatacattcaagggatgcaaataaggaacttaatcttcacaaagtcaatggtactatttcactgaaacttttggtgttataaattttatttttaggttatatagtgttcaaaggtctcttcatctacattttagtcttaatagatattctcatcataattggtagtaagtgccttttactcactggacacatcttgctatgccttaaaatgatcttactcttggttgatcctcattttgagtcaggtaattatttgtttaaagtgaactcaaagaattggacacataaacacactccctgtgagattctggacatattatgacatcaatgatagtcttaggaggaagctcagaatgtagagggcttgctttgcaaacatgaaaatctgagtctgagcctcatgatctacatatttaaaataataaaataaaggaaatggtgtatgtagtggtgcatgattttaattacagtacttaaaaaatgaagacaaattcccagagttcattgcacagagggcctgttgtacttgaaaaattgtctccaatgtttcaagagaccctatctcaattatatggtagagattgtctgtatcagcatttgggtgtacaattctctagtgtaaattctctaaaagggaacttaatagaatgacttatagaatgtcatcaaacttattcaacaatggatgattatgattggaagatccaagaataaagtagctgtttagttcatgtctgtggaggtctcaggttttctgcagaatactacagattccagaagacatctactctaatgtcagtgaagaaataaattgctaaagaaaactggaaagagaaagtgtttccttatccatgtgattatatgggcttctagcaaaaggcatggtcccccttagagatgtattttcccagatcaaaagatctggatgatagatgtgtcttcctacctcagtgaattaggtttgaactagatctatccacttcaaattaatcaaaattcctctttcatctgcctcttaatttttggttttaattattccagatatatttatattcaaaaataagagtagtcaccacaggatctgatgaattatacagtaatttggtctatgattctccccagttcacatagacaaacacacatgtacacattttcatgtacaccaatatcctcatgcacacacaatatatgaacacaaagagatgcacacacacatacatacacacagatgtgagactgtgtatgtacacacacatacacacaaacacaaatacacaaatgcaaattcacagaagaccatacttgcttcattgtgaacgtgagacttggatgaggaaaaagaagaatccaaaatatttggcaaaattggtgtgcagtctaaaaataatatacgtgatgatttataaataagaagtgagaggtttgttaattggcttcattaattatttcaaaatagattccaaagaaataaggcagacataggtagatgtttgtgagtttgaggctattatagtctacatagggaaatctaggccagccacatagggaaaccctgcttcagtgaaagagaaacaaataaacataacagactttaaattgcatgcatacttcttacacttttaattttttattttactcattttatcgtgcataatgtgtatgtgagtgtacacatgcaccatgagataggcatagaagtcagaggacaattttggggagttggttaaactccctccaaattaagttctagggaatgaaatcggattcttaggattgcatggtaaatacttttaccttctgagccttattgtggcctaaatgtacaacacctttatttgttaattttgccttcacgaaagtggaatttctgaatttattttcaaattgatgacatctaaggagaagagaagttacttatttatatagatcttcatggccaaaacgaatctatagactccaaagagatgaaaacagtcatttttcttctttttgataccctatgtttataatcatttaaaatatttgcactgctgtgtcacatgtgtgtcagcagatagcagagaggagaaaacctgtctggccagtgttctggcctatgaatatctgaaagattagtagccttaaagtccctattcttagctagtcagagacaacaaccaacctggacacagggggcctagagagggaaatgatagtcagtctggacaagcagacacagatgggctcctagggcaggaagcaagtaggaaactagaagaacttcacctggtggcaaggctaggaaatagtgagcaggagacaagggacacttgcaaggagtcacttgggcagtgaggagctaactctagagaaccacagaccatgatgcctggacacggagctatcctgagatgaataacagctcatctacaagcaaccttagggataggggggtccgactatgcttgagatgatccctgccaggcaccataatgggcattcagagaataacagttctgagaccatgcctgagatgactatagacactgggtgtcattaagaggaacaaataagtggtggaaaaatggaggagaaagagaaacaaaagaatgtgggaacaatgaccagaggcagaactggagacttgagggtagtgaggggcagtctattgtgagtaaccagtgataccaccagggatcagagaaggttcctggcttgtgctgcccctagggccatgtctggatccttggccatgtagcagcagagagatgcttggatgccacctgacagtcaagttgtaatactccttagagtgagcccctcacatgggagatacaagtgagctgtcctcaagaatgtgaacatgggaactggcatactcatctccttatggtggggtagacccctttactcctcataacctgctgcaggtaggagacctggccctagggtcctgagagcaggagagctgatcccgccttgcatcagctgcaacagtcaagagactggtagtttacctggtgacaggggcactggccaattggctacaagagcacaggcttagaatagctggtccttccacttttctggcctttgtgacatggaggaaggagggaggtccccctcttgctccctgcacctatgtcaggctgaagagctggccccaacggggtcatgagaggagaactgaccctttactttacctgggaagcatggcagaactgaccctctgttgcagtggatgttggtaagttgacaatgaggataagagagctagcatgcagaccatctcagataattctcaggtgcgtatccaggtcgttgaattagcccaccttaataactatcccatcaatgaactgctggaatgaatgaaggaactggtcttaatagattaataactttaggatctctacaacatagggcagcaacaggatatccaagaagggtcccagtattgatagagtagcaaaagccagaagcctagtaccagaccaatgagtaactgcaatgcacatttgcaagtaaagaagggaatactgtgggtcatactgtgatacactacagcttccacaaaaagagttttttcctctgttggtggagaggttgcaagggatgagggtgggtaagaagggagaggaatatgagtggaattcacaaagaactaatgtcaaaaatatatacatgtttatactggtaattttaattcaagtgatatgccaatgtcttcttttccaatgtaatgttatctccattagcaagtattggatttccttcctagcagagagcctaagagattttgttgttgttcagtttaaaccatacactgagtaacatcaggaaggtaacaaacaaggtcacctggctgtgtgtggtcctgtgtacagctgtcggtattgacctgccaacagtcttataacgtcttgtttctttcaaaggtatttcagcaacatcttcatcagtctggagcatccaaatatggaaatattctaacatgtattattgtaacatatgggaaatttcttttgatacacactattatttcattgtatgtgaccaagttatttatgtttactatatatatatcatctgagctacttggtcattctaataagacagttattgttttcaatattatataaatggtatataggaagtttgtaagtttcttcaagccaaaaagcaaaggttcaaatatatgataggtttgcaaataatctgcacttaaaactaccaccactaaactgctttttaaagtactttgtgagacagtgagatgtgtaatatctgctcagtaattctttactattttaaagggagaatatagtatacctttccagaggaggaagaaattcttacttcatgtattataaatgtatcctctttattgatgcatataatttaccagctgattatatttttgtggttcaaactttgattgcttcttttacttgctcggtatataacaaagtctgatttatgtcacctgtaaaatagggaaatacaaaattacctttgcataaatgagacaatttacacaaagcccccaaggggctacagagtatataaatatcagcatgcatgaatttctttctttagataccattgctattctgatttgaaatgcaagtttcttaaatgatcctaaagtgcttcctaaaaaattatattttgcaaattatttgttccttttttaattttcaggaatatatatgcattttgtacagaatataaaaattatggagtagaaagacataaaaatatcagtttatctgttgccagaaaacagatgcaatagtcattccaagtgatttagcaaggtatagagcaatttagaaattttcctagataccctatagtggaaataagcagcttattctatggagaaagtacagattgatagctggaacctagagagagctgcttagggaacaagctgcccatcgcaaagcttgaccttcagtagcagaaaacaaaagtcataannnnnnnnnnnnnnnnnnnntggttgtacaagcctgcaattccaccaacaatggaaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctggagtccaccttcttgagttctttatatatgttagatattagtcccctatctgatttaggataggtaaagatcctttcccaatatgttggtggtctttttgtcttattgatggtgtcttttgccttgtagaagctttgcaactttatgaggtcccatttatcgattcttgatcttacagcacaagccattgctgttctattcaggaatttttcccctgtacccatatcttcgagggttttccctactttctcctctataagtttcagtgtctctggttttatgtggagttccataatccacttaggtttaacctcaatacaaggagctaggaatggatcaattcacattcttgatacatgatgactgccagttgtgccagcaccatttgttgaaaatgctgtctattttccactggatggttttagctcccttgtcaaatatcaagtgaccataggtgtatgggctcatctctgtctcttcaattcagttccattggtctacttgtctgttgctataccagcaccatgcaatttttattacaattgctctgtagtacagctttaggtcaggcatggtgattccaccagaggttcttttatgcttgagaagagtttttgttatcctaggtttttttttttttattctagataaatctgctgattgccctttctaatttgttgaagaattgagttggaattttgattgggattgcactgaatctgtagattgcttttggcaagatagccatttttactatattgatcctgctagtccatgaacatgggagatctttccatcttctgagatcttgtttaatttctttcttcagagacttgaagttcttatcatacagatctttcacttccctagatagagtcacgccaaggtattttattttatttgtgactattgagaagggttttgtttccttaatttctttctcagcctgtttatcctttgtgtacagaatggccattgacttgtttgagttaattttatatccagatacttcattgaatctgtttatcagatttcggagttctctggtagaattgttagggtcacttatatatactatcatatcatctgcaaaaagtgatattttgacttcttcctttccaatttgtacccacttgatctccttttgttgtgctaattgctctggctaggacttcaagtataatgttgaatcggtagggagagagtagacagcnnnnnnnnnnnnnnnnnnnntatatttttgtggttcaaactttgattgcttcttttacttgctcggtatataacaaagtctgatttatgtcacctgtaaaatagggaaatacaaaattacctttgcataaatgagacaatttacacaaagcccccaaggggctacagagtatataaatatcagcatgcatgaatttctttctttagataccattgctattctaatttgaaatgcaagtttcttaaatgatcctaaagtgcttcctaaaaaattatattttgcaaattatttgttccttttttaattttcaggaatatatatgcattttgtacagaatataaaaattatggagtagaaagacattaaaatatcagtttatctgttgccagaaaacagatgcaatagtcattccaagtgatttagcaaggtatagagcaatttagaaattttctagataccctatagtggaaataagcagcttatctatggagaaagtacagattgatagctggaacctagagagagctgcttagggaacaagctgcccatcgcaaagcttgaccttcagtagcagaaaacaaaagtcataattcttcaacagaagaataagggaatcaattctctgatttcatcctgctacagattcttgaaactccttttcatgctttccattggtaccccaaaagataccagagatcaaaatactcaggtataggcaatattgaatgtcagccctctaggactgacaatgagatgaacaaaattaaagagtagttatatggagaataatagaaaacagtatttagaataattttctctttctatctgggagtaccactttccatgtaaacgctcttagatattcaactttgattcatgaagatcagattcagaagttaccatgctattatcttgaaatgcattagaaaattattcttaagacactactttggttaagcagctgttactgtgtggagggttgaatgagaatggcctgattgtctcatatatttgaatgcttggtttgcagttggtgaaattgtttggaaagtattaggtattgccatgtggatggagatatatcatgttcagatgggctttgaggtttcaaaagcacatagagtttcctgcgtatgatctctctctctctctctctctctctctctctctctctctctcctcacacacacacacacacacacacacacacacacacacacatatgcttgataatcagacataagttcatagctgtctacctgctgtcatgcttcctgccataatggttatgaacactaaacttatataactgtgagcctgcaaattcaaagttttcttttgtatgttgctttagtcacagtatctccttacagcaatagaaaggtaactaacatagaggttggtaataggggtgacatatgattgtacaaagcctgcaattccagttttctttgtttgtttgcttgcttgcttttggagaaacttagaagactgtgtctttggactagataggaaggtagtagaaagctgtaagtgggtattaatcagctatcctagtaggatcttggagaacaaatgtgctgaaagttctctggaacttgttggcccacctgaagagtttttgaggagacgaacattagcaattggattagagaccattcttgtcatgttgttctaagattctgcctgaggctaaaatgaagacttttgtttgtttgtttatttggggggggtgtttttgtttttgtttttggtagagatttgacaaccatctactattgactctgtcccttactttatagtgaccactcatatacagatcaatgaaaaagaccagatagggcataaagatacagtaaatgatcacactacaataaagtatttggaccacacttgatactgaaaagagatagtgagaattggtttaaagacagtggagtctttagggcaagacttcactcagctaatcctgcactttttgaaaatataaggcccaaggaattttctgatcctaaagagaaacaagacaaagtttgtgcaaatttaatgaaagaaggggccaaattccatcctaagcaaagagcaaaacttggcagtgatgggaatgtagttctagctttagaattatataggatacaagaaccaaggtatataggaacttcctccatgtttaaaaaaatccactgaggccaggcctgtagcaaggcaatccatgtttggaggtttagagaaatcttacatgaaactgtgaaggtggtgtctggatttcactggcaacccaatgtcagatctgtgggatgtctgccaaagacagctgtgtcaaggtatgacacaggctaaagaaacagaggcatgtggctgtctgtgacactgaaagggaaggttaatctcagaccctggagatcagacttggagataacaggattttcacttttctctgatgcattttattttcaatttgcttcagtattccctcattaagtctccttaccttcacttttagaatggtaacgtgcattctgttcatttatatgttggaagcaaataatttgatttttacattatggggagttacaactgaaagatctatgtgagtttcagaacagaattaaggctttagacttttaaattgtgttgagactgtgaaagactatcaggacttttgaagttggcctaaatgtgttttgagttatgatgcatctacaaacctatggaggccaggaaatgatataatgtagttagaatgagaatacccccctctccacataggctcatatgcttgaagcttgcttcagagttggtggaattatttgggaaggatgaaaatgtgtggccttgtcagtggagataagtttgaggattcaaaagttcctactttttccatttagtgctccctgtccctgtcttatacttaagactcaggtacaagttttctgccatcttgctagcttccttcctgctgtcccgctcccagccatgaactctaaccctaggatttctttaatgtgttgtttatacctatgcgtcacccagtttatctcaaaatctacattttaaccacatatttatagaaatatacatattaacatttatattttgtcactattttcagtatttaacacattaaataaatctcaggatggtcaccaatatgcatcagtgtttcaagacggaatgagaacagacaactcttcttcatatacattgaacaaaagtgaggccaaatttgaattttccattaatcttactgtattatttgactatcttcagtttggggttactggattatacgtagttgtctgttgtgtatgtgtgtctgattattttcccatgtctcatacttgttctacacaaaaggctttgctctgtatttattgcctatcacaaaaattagagagaatgaaaattttaatctatctatctatctatctatctatctatctatctatctatcatctagagtgatttatttctttatctaggaagagttatttccatacatattctttaaaagagtaaaggatagaatttgaactcatgatctacggaaaagcagtcggtactcttaactgctgagccatctcccagcaaccacatggtgggtggctcacaaacaggcctggagcaagagggagaaaaggaagggggggaagagtaaaggttaatttaatttactgagcacaactagccaagaatggtactcaaaaccacacacaaatgttactactccttacatacatgttgcttttaacattattggaatttttgtttgtttgtttgtttgtttgtttaaggcatcttttatctgttgtgtgcaattagccaaagatttaccataacacacacacacacacaaacatatgcacacacacacatcattccaggttctggacatagaaaagtttatgattttaaataaatctgattacatagggaatacaccacatagttaacttgattacattactcacttaaatgctggttaaatttatcgagtctaaatacaaggtatggccataagtaaagtgaattgtttgacattatctgaaggcatataatttaacatctggttctcacttgatggtggtgttggaggagccttaagaggtttgacgcattgacttaaaaatccaggcaacctccatcactcaaaatttactctttctccattgtgctgctggttcaagagggaagctcccagtgtcctgtgcctgccacgatgcttgctgcctgctgccatgctgccccagccatattgactctgcttctctaaaacaatacaacaaaataaaaccctcccttttcttttttaaaaataagcgaacatgctcataagattttatcttagcaacagaaaggtaactaatccagatggcattgggagacgattgaagagaacatgggttttaagcaaccttatgcatagatccaacaccttggccatgatcttgtaaaaatcctgagcagaagattgaagtgaagagaatctgagacttttgaccttcagaatcagtgagattatgtgtgtgtgtgtgtgtgtgtgtgtgtgtgtgtgtgtgtgtatttgtgtgtgcattgtttacagctaaaaattatgttctaattttttatatagcaagagaaactaatgaactttctcacacttttccattagaagataaccttttccagttattttgtttcccagactcaaggtgctttggattcagacaagcagtgaagtggctcaaacatagtctggatgtcaaaatgaaagtgatactattcatgagctttgtctgagaagacaactcttctgtttttaagattgtgtgcatttcataaaccaggcttttgaaaagcaatctctatgtgtcattgcattataaatatttccagattaaagaataattcagagttgaggaatttaacgggcaagatagaggttgttcaggagttacatgcttaatttactcccttgggtatgcactgccgagaaagctaaagtgtttcctttatatggaggaacttaagagctactcctttctctgtcccaggagcaacagagttgagaacttaagtaacgttagaaaaaaaattgtatcttttcttgctttaaatatcactttcatttgcaaatacatagtccacatagttatgtattgcctatagatgcatgggtaaaggtcgcagagagagagagagagagagagagaaagagagagagacagacagacagacagagacagagacagacagagacagacagagagacagagagaagatatgaagatagaaaaatgttgaaccatagaaatgaagaagagagaagaaggaaggattggggatagattgtatcaatgcatattaattatatccatgtacaaaattctcaataaaaataattataatttcacaaattcagaaaatatttgaataaccattaaatatgctatttaagacttgcttttttaaaaagaattttactagttatatacttataaatgaggatattagaaaaatatgggaacaggtatgcatcccctgaagtgtttggctagaggttatctcatcgacaaccagaatttcatgagaaaagcaagtttgcaattgtgctatgttgaatgttagccattagaaggtgatgccttcatgtgcagagatattgtaaaagaaagtgagtactttatttaataactacacaaagaccaacgttgtgtgtccaagtactgtggataggagaagcagaaataattaaattaaaaatcacaattttgtaaatagctttaccttcttcaatttaattactgttgaaacagaatcttaattttatttatttataaatatttatacattttatcccctcaatctatatttattgaaaacattacaggatatttctgcacatgtttctctatgtttatatttgctttcatgtttatggggacttattcaggtgtgtcttaaacacctaagtctgggggtgatgctaggctaacgaaggcatctgcaattgctccccacctcattcgctgaggggtaatctctcaattgaacctacaacacccctacttagataatttcgctagtcagtttgtctttgggactccagtctctgcgttgcaagcaccatgattgtaagtgtagtgctgcagttttacatgggttttgaagaccaaagttgcagacctcatacttccatagccaacactaaccactaccatttcccttgcccataaaacatttgccacaaaattaagaataaggaaaataaatactttctatatagttttgacatactataaatttcagtgtgtgtgtgtaaaatctaaatgtcgttcccagtcaagtatcctacacaggatgtgtgcattgtaagcacacattaaatatatccattttacttacaaattattgaagcagaaacaaaactcctagattctaaaattattctaacacctttgcttaaaatgcatattcaagggtctggcaagatagcaaagtgaactaagttacttaccaactaaccatgagtacctgagtttgaacattcaaacctctgtgtcaagtggacagaataacttcctacaagttgtttcttacttccacaagcaatgttgagtgcatgtgagcatgtgaaaatacatgcattctcatgcacaatatctctaaacatgaaaataaattagaaatttggcacttttgaattcttagaattacaggttagcccagaggagaggatgacttatggaaccaagtggttgttattgaaggatgtgaagaagttccatttgttttttttgttttttgttttttttttttttttttgatggcttgcaacaaagtaagtttattccatcaaagttctttttttttttaattttttttaattaggtnnnnnnnnnnnnnnnnnnnnatgcgtttagcaaattggtttcttatatcttgggtatcaagaagtttctgggctaatatccacttatcagtgagtacatatcatttgagttcttttctgattgggttacctcactcaggatgatgccctcaaaggtccatccatttgcctaggaatttcataaaatcattctttttaatagctgagtagtactccattgtataaatgtaccacattttctgtatccattcctctgttgaggagcatctgggttctttcctgcttctggctattataaataaggctgctatgaacatagtggagcatgtgtccttcttaccggttggaacatcttctggatatttgcccaggagaggtattgcgggatcctccattagtactatgtccaattttctgaggaaccgccagactgatttccagagtggttgtacaagcttgcaatcccaacaacaatggaggagtgttcctctttctccacatccttgccagcatctgctgtcacctgaatttttgatctttgccattctgaatgttgtgaggtggaatctcagggttattttgatttgcatttccctgatgattaaggatgttgaccattttttcaggtgtttctctgccatttggtattcctcggatgagaaatctttgttcagctctgagccccattttttaatggggttatttgattttctgggagtccaccttcttgagttctttatatatgttagatattggtcccctatctgatttaggataggtaaagatcctttcccaatatgttggtggtctttttgtcttattgatggtgtcttttgccttgtagaagctttgcaactttatgaggtcccatttatcgattcttgatcttacagcacaagccattgctgttctattcaggaatttttcccctgtacccatatcttcgaagggttttccctactttctcctctataagtttcagtgtctctggttttatgggggagttccataatccacttaggtttaacctcaatacaagggagctagggaatgggatcaattcacattcttgatacatgatgactgccagttgtgccagcaccatttgttgaaaannnnnnnnnnnnnnnnnnnnttccctttctttactaattagagagttataagacagaaaaaaattcctccatttttatttaattgctgcttcaaaggcttgagataatgcagacagagcaaaattactctatagagtgtttaaatataggataagtctgtttgtcattttctcagtagtatatttttttctgcctctagggttttcttttagctcctcaaaagtgagatgagggtattttacaatttgaaaaaacattaacttcaggactgatttgtttagtttctctatggatgtggatagctacttaaaatcttgaaattcacttttcacatccctaacgtgtgtagtgggtatggacaagttgttaactattacacattttacaacattacgtcctagagataatgaaagttttggaagaccttagaaaaatgaaaacaaccaaggaaatgtatatatgtttgtaaatattagagaaagaatttttgatattaatgatgctttcagtcagaaccctaatggagttttttttttaataaacaaatcaaacagaaacaaaataagcaattttattattatgaatagtattgaagataaattgattattaatatattcttcttgtctttttaattgattctagcactcggtttccttttctaatgaatttcagtccctctcaattaaggggacagattgtaatcaagcacatatagtaaccattccgaaatttcctgtacggttataatttcctgcatcctttgacaaagtacaataattttattctgagtcatcaggtatgaaacttcataaaacctctttttaaaatatttttattaggtattttccacatttacatttccaatgctatcccaaaagtccccccacacacacacacacccctacccacccactcccactttttggcactggcattcccctgtactggggcatataaagtttgtaagtccaatggacctctctttccaatgatggccaactaagccatcttttgatacatatgagctagagtcaagagctccgggttcttgttagttcataatgatgtttcaccgatagggttgcagatccctttagctccttgggtactttctctaggtcctacattgtgggccctatgatccatccaatagctgactgtgagcatccacttatgtgtttgctaggccccggcataatctcacaagagacagctatatcagggtcctaacaacaaaatcttgctagtgtatgcaatggtgtcagcgtttggaagctgattatgagatggatcccaggatatggcagtctctagatggtccatccttttgtcatagctccaaactttgtctctgtaactccttcgatgggtgttttgttcccaatgataagaaggggcaagatgtccacaccgtggtcttcattcttcttgagtttcatgcgtttagcaaattgtatcttatatcttgggtatcatgagtttctgggctaatatccacttatcagtgagtacatatcatttgagttcttttgtgattgggttacctctgttgaggggcatctgggttctttccagcttctggctattataaataaggctgctatgaacatagtggagcatgtgtccttcttaccggttggaacatcttctggatatatgcccaggagaggtattgcgggatcctccagtagtactatgtccaattttctgaggaaccgccagactgatttccagagtggttgtacaagcttgcaatcccaacaacaatggaggagtgttcctctttctccacatccttgccagcatctgctgtcacctgaatttttgatctttgccgttctgattggtgtgaggtggaatctcaggattgttttgatttgcatttccctgatgattaaggatgttgaccattttttcacgtgtttctctgccatttggtattccttggatgagaaatctttgttcagctctgagccccattttttaatggggttatttgattttctggagtccaccgtcttgagttctttatatatgttagatattggtcccctatctgatttaggataggtaaagatcatttcccaatatgttggtggtctttttgtcttattgatggtgtcttttgccttgtagaagctttgcaactttatgaggtcccatttatcgattcttgatcttaaagcacaagccattgctgttctattcaggaatttttcccctgtacccatatctacgagggttttccctactttctcctctataagtttcagtgtctctggttttatgtggagttccataatccatttaggtttaacctcaatacaaggagctaggaatggatcaattcacattcttgatacatgatgcctgccagttgtgccagcacnnnnnnnnnnnnnnnnnnnnccatttggtattccttggatgagaaatctttgttcagctctgagccccattttttaatggggttatttgattttctggagtccaccgtcttgagttctttatatatgttagatattggtcccctatctgatttaggataggtaaagatcatttcccaatatgttggtggtctttttgtcttattgatggtgtcttttgccttgtagaagctttgcaactttatgaggtcccatttatcgattcttgatcttaaagcacaagccattgctgttctattcaggaatttttcccctgtacccatatctacgagggttttccctactttctcctctataagtttcagtgtctctggttttatgtggagttccataatccatttaggtttaacctcaatacaaggagctaggaatggatcaattcacattcttgatacatgatgcctgccagttgtgccagcaccatttgttgaaaatgctgtctgttttccactggatggttttagctcccgtgtcaaatatcaagtgaccataggtgtatgggctcatctctgtgtcttcaattcagttccattggtctacttgtctgtttctataccagcaccatgcagtttttattacaattgctctgtagtacagctttaggtcaggcatggtgattccaccagaggttcttttatccttgagaagagtttttgttatcctagtttttttttttattctagataaatctgctgattgccctttctaatttgttgaagaattgagttggaattttgattgggattgcactgaatctgtagattgcttttggcaagatagccatttttactatattgatcctgccagtccatgaacatgggagatctttccatcgtctgagatcttgtttaatttctttcttcagagacttgaagttcttatcatacagatctttcacttccctagttagagtcacgccaaggtattttattttatttgtgactattgagaaggattttgtttccttaatttctttctnnnnnnnnnnnnnnnnnnnnaagatagccatttttactatattgatcctgccagtccatgaacatgggagatctttccatcgtctgagatcttgtttaatttctttcttcagagacttgaagttcttatcatacagatctttcacttccctagttagagtcacgccaaggtattttattttatttgtgactattgagaaggattttgtttccttaatttctttctcagcctgtttatcctttgtgtacagaatggccattgacttgtttgagttaattttatatccagctacttcattgaatctgtttatcaggtttcggagttctctggtagaattgttagggtcacttatatatatactatcatatcatctgcaaaaagtgatattttgacttcttcctttccaatttgtacccacttgatctccttttgttgtctaattgctctggctaggacttcaagtataatgttgaatcggtagggagagagtagacagccttgtctagtccctgattttagtgggattgcttccagcttctcaccatttactttgatgttggctactggtttgctgtagattgcatttatcatggttaagtatggaccttgaattcctgatctttccaagacttttaacatgaatgggtgttggattttgtcaaatgatttctctgcctctaacgagatgatcatgtggtttttgtcttttgagtttgtttatgtactggattacattgatggatttctgtatattgaaccattgctgcatctctgggatgaaacctacttggtcaggatggattattgttttgatgtgttcttggattccgttagagagaactttattgaggatttttgcatcgatattcatagggaaattggtctaaagatctctacctttgttgggtctttttgtggtttaggtgtcagtgtaattgtggcttcatagaatgaattgggttgagtaccttctgttttattttgtggaatagtttgtgaagaactgggattagatcttctttgaatatctgatagaactctgcactaaaacccatctggtcctgggatttttttggttgggagactattaatgactacttctatttctttaggggatataggactgtttaaatcattaacctgatcttgatttaactttggtacctggtatctgtctagaaacttgtccatttcatccaggttctccagttttgttgagtatagccttttgtagaaggatctgatagtgttttggatttcttcatgatctgttgttatgtctcctttttcatttctgattttgttaattaggatgctttccctgtgcactctagtgagtctggctaagggtttatctatcttatagattttctcaaagaaccagctccttgattggttgattctttgaaaagttcttcttgtttccacttggttgatttcagcctcaagttttattatttcctgctgtctactactcttgggtgaatttgcttccttttgtcctagagcttttaggtgtgttgtcaagctgctaatgtgtgctctctcaagtttttttatggagggactcagatctatgagttttcctcttagaaatgtgttcattgtgtcccataagtttggatatgttgtggcttcattttcattaaattccaaaaagtccttaatttctttctttattccttccttgaccaaggtatcattgagaagaattttgttcagtttccacgtgaatattggcattctattatttattttgttgttgaagataagccttagtccgtggtgatctgataggatgcatgggacaatttcaatatttttgtatatgttgaggcttgttttgtgattaattatatggtcagttttggagaagataccatgaggtgccgagaagaaggtaaaaccttttgtttaggacaaaatgttctgtacatatctgttagatccatttgtttcataacttctgttagttttactgtgtccttgtttagtttctgtttccatgatctgtccattggtgaaagtggtgtgttgaagtctcccactattattgtgtgaggtgcaatatctgctttgagctttactaaagtttctttaatgaatgtggttgcccttgtatttggaacatagatattcagaattgatagttcctcttggaggattttgcctttgatgagtatgaagtgtcccttcttgtcttttttgatgactttgggttggaagttgattttattagatattagaatggctactccagcttgtttcttcagaccatttgcttggaaaattgttttccagcctttcattctgaggtagtgtctatctttttctctgagatgagtttcctgtaagcagcaaaatgttgggtcctgtttgtttggccagtctgctagtctatgtatttttattggggagttgagtccattgatattaagagatattaaggaaaagcaattgttgcttcctattattatttttttgttaatgttggcattctgttcttgtggctgtcttcttttaggtttgttgagggattaccttcttgcttttgctttttctagggcttggttcctgtccttgtttggtttttttgtttttttgttttttttctattattatcttttgaagggctggattcatggaaaagaaaaatgtgtgaatttggttttgttttggaatactttggtttctccatctatggtaattgagagtttggctgggtatagtagcctgggctggcatttgtattctcttagtgtctgtataacgtctgtccannnnnnnnnnnnnnnnnnnnagggcttgattcccggccctgtttttttttttttttttttttttttttttctattattatcctttgaagggctggattcatggaaaaaaaaatgtgtcaatttggttttgttgtggaatactttgttttctccatctatggtaattgagagtttggctgggtatagtagcctgggctggcatttgtattctcttagtgtctgtataacatctgtccaggctcttctggctttcatagtctctggtgaaaaatctggtgtaattctgataggcttgcctttatatgttacttgaccttttccccttactgcttttaatattttacctttatttagtgcatttgttgttctgattattatgtgtcgggaggaatttcttttctggtccagtctatttggagttctgtaggcttcttgtatggtatgttcatgggcatctctttctttaggtttgggaagttttcttctctaattttgttgaagatatttgtggtcctttgagttgaaaatcttcattctcatccactcctattatcagtaggtttggtcttctaattgtgtcctggatttccaggatgttttgagttaggatctttttgcattttccattttctttgattgttgtgccgatgttctctgtggaatcttctgcacctgagattctctcttccatctcttgtattctgttgctgatgctcgaatctatggttccagatttctttcctagactttctatctccagctctttattgtgtttacttccctttttaggtcttggatggttttattcaattccatcacctgtttggttgtgttttcctgcaattctttaagggatttttgtgcttcctctttaatgtcttctacctgcttagcagtattctcctgtatttctttaagtgagttattaaagtccttcttgatgtcctctaccatcatcatgagatatgcttttaaatctgggtctagcttttcgagtgtgttggggttccctggactgggcgatgtgggagtgctgggttctgatgatggtgagtggtcttggtttctgttagtaagattcttatgtttacctttcgccatctggtattctgtggagttagttgttatagttgtctctgtttagagatttttcctctggtgattctgttaccctctatcagcagaccttggagactagatctctcctctgagtttcagtggtcagagctctctctgtaggcaagctctcctcttacagggaaggtgcacagatatctggcattgggacctccctcttggccgaaatgaaggcccaaaacaggatccttcccagaggctgtgttgctttggccttttacagaagatgttagcttctgtagtacacactctcacctgtacagactactttcggcagagtcccggaaccaagatggctcctgtagatgctgagggaaagccctccttggctgggtggacacctgtcctctggctgggaaggtggccggatgtctggagcccgaaaaggaagcttcctcagaagctctgtggctccagcatgtcccagaagctgttagcttctgtagtgcacactctcacctatgcagactactttcagtggagtcccggaatcaagatcaaaacctttttcttaactgagtacaagatgtacttttatgtatataaaaattataaaatatgtagtacaataggcattaacattgcccatgtttgatctttcttcagaacttggtggattctgagaagaaatgtgccacatattaagacaatgttataactaacaatgctgcatttatgccaaacacttataaaaagaattagaatttataatacatgctagcaatactggagcctggggccagtttttcattcatagaaatggagtagtctatggttgaaaactttgaagatagctctttgcggaaaagtgcactgagaatagtgtatgaggaacatacatgagaagtcatgatcaacacctatgtatggggatggcatattgggtcaacaactaaagtttgtgaaaagggttaatagggaacagtggtttgatgggtttagcaagaaagaggagaaaatacgggtgaggataattggaatgcactgtatatgtgtttggaattgttaacacatataattatagaaaaaaggctagggccaaatgtttctgaaaatggctccataactcctatgactctctgttcctgaatggtagagaacaattgtcttttctggattgaataaataactctttacattctgattattggagaagtataagccagtgtcagcatgaagcatccctaagggtgctggttgttgttgtagctttgttattgcataaaacagagagctctatagtttggtttgagaacttaccatgtgactaatctaaccaagtatgatgtgccctaatagtagtggtggatgctttaaacaggaaacaaatataagcaaagattgtcattaatttaatttaattttttccttctctttcttctttttctatacatttacataccaagtaggtcatgcacgttatttgaggggtacttctccatcatgaattataacttgtattagttttaaacatttgcataagaaaattaaaaatgccatgtgtagtttgttgttcatcctgttaggaaacatatatgtcaggtttgaccggtattcatggatgtaagcattactattttggtactttaggctctttaacttcggaaaaggtctttatgcagagcttgtagtaatggaggagtggttattatcaaaagcttagcatcaattcctttctgaaattttgagttcatctggggacttgaaatattattgttctataatactatttccatatatagactgagtttcttctaagaaacctgagcattaaaatgcattgttaaaatgaaaagcatagtgtgtatggagagaatactttattgccttattcagactaatttttgtcatgaaggctcgttgaagcagcccactggaggcacgcatgtgggtgtgtttgtgtttttctcttttgttttaattatcacttctatttattccatttctgaaaaccaaatctagactgttgctcttctgcttttatgctaagttatagcaaacatagccaggaaatgccctttcaggctggtttctcatcttattaaaaaggtttctacagtcctaggaatttaaaatgcgacttcataggcaaacatgttcatggtttggccttcaatgcttgttcaaaggagaagttggggaaagaggttggatcacgaaggctcaactatatcaaattggtcatccctagagggaatcacaaacctggcatcactagaagttggagaacaagaagtaggtcactagaggcgtgtttttgtttggcttaccttaaaaatagttccttctgttagttctcttcctgccattattcacacatgctccagtcactgtagtgtctgtatcactcataacaatggatgctgatcaccatggactacagcctcataaacctgagcttaagtaaaactttcctccttctaaattaaacatggcagttcttttgtcacagatacaaaaggctgataaacagagttctccagtagacttgaacacttcctgatcttatgcacaatagaaaatcctcaggtcgacctttactttctttttaaaaaaactgttttgttttgtttttcttgaatatccacaatatatttcacttatactcttcttgcccagttcttgtctactaccatatcaaagcagggtcatgtactttccttttttattttttatttttgtcttttatatttatttatctatttatttatttacactccagattttccctcctgatttaccctccaactgttccacatcccataccttcacccctctccctatctccataagaatgtccacacttccgaccccccaccccaccagatctctaaacaccctggggccgccagtctcttgagcattaggtgcatcttctctgactgaacccaaacctggcagtcctctactatattggaggcctcaaatcagctggtgtgtgctgccaagttggtggtccagtgtttgagagatcttgggggtccagtttaattgagactgctgatccaactacagggttgcccttctcctcagcttcttccatcttttccctaattcagacacagggttcaggagcttctgtccattggttgggtgcaaatatctgcatctgactctttcatctgtttattaggtctttcatagtgcagtcatgataggtccttttttgtgagaactccatagcctcattaaaagtgtcaggccttgggacctccccttgagctgggtcccactttgtgcctgttgctggacctccttttcctcaggctactctccatttccatccctgttgttctttcagacaggaacaattataggtcagagttttgattgtgggatggcaacccctccctcatttgatgccatgttttcctgctggaggtgggcttgataagtttacttctccctactgaaggacattttatctaagatccctccctttgagtcctgagagtctctcagcccccaattcttttgtgcaacttcctacttcctgagattgacaattttcattctttctgctggctctcggggcttcagtccttttccctcacccaataccagatcaggttcccctctccccaccctatccactttccctcccaggtccctccctccctcctcccttgtgattgttttcttctccctcccatgtggaattgaggcattcttacttgggccctttagcttgttgaccttcttgagttctggggactgtatctggatattctgtactattttgtgactaatatccacttattagagagtacataccatgcatgtccttttgggtctgagttacctcactcacaatgatattttttttttatttctatccatttacctgtaaaactcaggatctccttgttcttaatagctgagtagtattccattgtgtaaatgaaccacattttctgtatccataccatcagtcatcagacacctggattgtttccagcttctggatattacaaactttgaacatagtggaacatgtgcccctgtgacatggtagggcaacaacttttgtgtatattcccaagatcttattgttgggtcttcaggtagatctatttccaattttctgagaaacctccagattgacttccaatagttgtaccagtttgaaatcccatcagcgatggaggagtgttcctctttctccacatccttgccaagatggcttttcatctgaggtttttgatcttaaccattctggctggcatcaggtagaatctcagggttgttttgatttgcagttctctgatcactaaggacttttaacatttgtttaggtgcttctcagccattcaagattcctctgttgtgaattcttggttttgttctataccccattttttgattgggctatttgtttttatttatttatttatttatttatttatttatttatttatttattggtggttagtttcttgagttctttatatattttgaatactggatatggggttagtgatttttcccccaatctgtaggttgctgatttgtcttattgactatgtcctttgccttacagaatctttccagttttcatgaggtcccatttatcaattcttgatcgtagagcatgagccactgaatataagtttaggaaatttccccctgtgccaatgagttcaagagtctttcccactttctcttctattagattcagtttatctggttttatgttgagatccttgatccacttggtcttgacctttgtacaaggtgaacaaatatgggtctgtgtactttctgtttataaaaatgaatccaaaccaaacacacacacacacacacacacacatacacacacggtttggattcacagaccatatgaagctcaagaagaaggaagaccaaaatgtggatgcttcagtccttcttagaagggggaacaaaatactgacaggaggtaaagtaagggagggacttgggaggaaaacaggaagggaaggtggggaagggggcaggatcaactatgggaggagactggcatgatatacagagagtcaggaatttgaacagtatgtggcaatgggggatgtggttaggcaaggccccaggttgggggatgggaccacacactcatctctaaattttaacccagaatggctcctctaaaggaaatatgaggacaaagtatggagcagagactaaaggaaaggccatccagagatttctccttctggggatccatcccatacacaaacaccaaatctagatattattgcagatgccaagaaatatttgctaacaggagactgatatagctgtctcctaagaggctctgccagagcctgacaaatacagaggcagatgctcacagccaaacattggactgagcacggggaacacaatggaggagttagagaaagactgaaggagctgaaggggtttgcaaactcacaggaagagcaacaatatcaaccaaccagagcccccagagctcccaaaccacaaaccaaagagtacacatggagagacccatggctctagctgcatatgtagcagaggatggcattgtctggcatcaataggaggagaggtccttggtctgtgaaggctagattccacagtgtaggggagtgcctgggtgttgagatgggagtgggttggtgggtgagggagcaacctcatagaagcaaggggaagatgatggaatagggggctctgaaggggaaactggaaagggaatgatatttgaaatgtaaatatataaaatatccaattaattaaaaaaagacatgttttggaagttactcctgaacataggggctccttgaagtgtggtgatacaaccagtgtcactagtttaaaaaaaaattcctccattctgtaggcataaatcttttgcaacttacttttaataagggttcaccctcttttctagcccatctgccagcagaaatagtggaaaagaaaggttattagcatatgggtgaagtagacttgttcagcaatagttctgtgaaggcgagttgaatcttctttgacatgagttcagtcaacaccaaatatgattcagcagctacagcacagtcttctaggcaaacagacaccaggcatgcatcctcagctacagtctagtcctttcatcagcagataccaggcagctgtagttcaatgctgatgaaacctccaggctctccaactggcagaaggaaaggccgcagaagtggcaagctgccacaggaacctcaccagcaattcttggatgagtttctctcaaagataacattaccacaatgtatcaatgttgtgtaaggtaaaccaatacatgtgagtctttagggataaatagtgaggcagagcaaaccaaacgaatggtcagtacacatctcccactgtctgtgagatcaaatttacactccttgattctgggccatttcctgtgtttgctatatccaaacatcttttcacctgtgtctgcttcaggaaaacactctttcatgtttttgctttaccaacacacactttcatctctgtgccccaggaaaacatcacttgacataagtaactgtccaaagaactagaagtttcaacttcatcctgcccccaccaacaaccaccataatctttctcccagcagatagcaattgcaaatagcttcctggggaagggtggaattttatacccacttccctgtccttcatgatgggctttttctagcttgagtttgtgtaggtcttgtgaaaatatatgcatgtatgtcatcagtctctgtgtttatttcagctttgctgtatatggaaaatgctctcttcctggctgttttgctttttttattttaaaaacctcccaaaagagtaaattgaaagatgtctcccctatttgcttattgtatattgatttaagatacattattagagcattggttttttttttctatccattattgaaggacacaacagtgttctttttaaatctgtataaactcaagtcagacaaaaattccagcatggaggaggatgattcacatcaaggctctctcctacctgaaaatgttggtaattaatttctttatggctgtggctatgaggaggcttatcatatcttggcgaatgataatgcagttaacagtttttggctttacaaatgaactccaaggctgtttgggggtttgcctctttttgaaaaggacacaaagtgggatgtatatgcagtgaggggtgaactgggtgaagttaaggagagagtgaatatggaaaataaacaatgtataaagttatcaaacatacatgcatatatatcatagatattatgacatattatagcatatgccaatgctacaggaaataattaagcatacatgcaattttatatttttgatgatttgctttgaagatatatttctaaaagtggcacaataaaatctaagagcagaaataactttctaagatactgtaggctttttgtttgactttagtgtaagatttgactttattatattttatgtgcatatgacttttatcttaattcacctatgtttactgaattgaatccccttcatatgccttttagaagtataaattctttcatgaacaatcacttctatttggaaatttcaatggctttgtttttaacaattagttctcataaaatgtgttatttttgtctctaagaaataccattattggtaaatttgagatttattttcatcttttttattaaactacatttaaaataattattatttaattgtgcctcagtgtgccattgtgtgcaagtgtactttctattagctgcctaataatttattttaaaagtaattttgtcttttcttaccatcatattgcttccaggtaactactcttttattcttcctccattctgtcatattttttttgcaagtctgtgatagattgattcacttctatttgctagtttgatttgcttctcaaaaatacaatacagatatagtacagaatgaacattgatagccattttggctgatccatgtggattccaaaccactttattttgtttgtctcttccattcctgcataactactccctcacaccaatactgcctaatctccaaccccaacggccctcatcccactcatgttcattattctgagtatttggaatacacataaattctcttcttcatactcctcacagctcttctcaaggtaacactttcctttttgcagctatgcccagactaacagctattttccatgagatgataccttgagacccccaggatttcctggcatgtagacacagtctctttaccttaattcagccctagatagaccatgttcctagcatctgtcgcccctgcacacaactctgtactcactgaagggtctgtgaaataatgtttcagtgagcagagagtttctctgtgattgcactcttgacatgaagcatcagcatgccagctgaactgatactaaattttactggaggtttgacttcttatgtctccaaatctgtgctgttctattaggaacaaaagttgaaatgggttttttctttcttgttcctttgcagaatttagtttacttaatttcattagagcctgatacttctgatgtattttaaataaccaatggtgatttttttcatttgatttattctctttttccaactgttagttttatctcctttaacctgttattcttcatctgaaggctcaaataatttattttaaaagactaaaatggccttaagcaataatatatcattgatctaaatgtattcatgcatattctaaagttttattggaattttggcctatgacctttgacctacctgattttaattgtcaggtatggtttgttttttgttaaaatgaattcatgggaagatgcctggtatactcctctagcaagaaaataggagtctgtgagtaacagaagtccatttctgaatcaaaattcatgcataagttgtgggctggtatatgtggtggtgcctcgggggaggtacaggcagggcgttttctgtgattttgaggccagtctgctttcagtagatttcaaacccaggcaatgctacatagtaggactgtttcatgaagaaaaacaaacctcaagtacaatgatcatctgactagcaagtgagatttactcccctaataaactaatacagaatgctttaatgagaaacatgatatgacatctcaggcatgagatagatggggttgcaagaataagcattctttgcagtggtactttctaacttataagtacttttataaatatcatttaacagcactgtcatagcattcctgacttttagaaatatttaacctcatcccacaaactgatacatgtgcttaggcttgccaattcaaatgcctaacccctcatcccacacactgatgcagaaagcctcttgactcttgtcaagggtgcattcacagataaaatctccactcacctacacattattccacaggcccttcaatgaatacagagagggtacatgtctaacttactagctacttcttttgagtatgcactatccaaggtctcatatttgttcctacttttgattcatctgatatttcactcccacaaaataggcaaagtagaaagcagaccagggtaaaatgaatatccaatgaaaaagtgccctagcaaagagaaacagccactacaaaaaaaaatagtgtatgcattctacttcatttttctcagaaatatttttctgcaaatataactgttgaaataaaccataatctgtggagtctgtaaaaagtaatccctatgaaaaatggattatttatattcagcagaaatgaaaaggtttttacttccttggagtcttggagcattcattaaaatgatcccagatttagtcatttctaaagtgggagttggatgttcattcacatgatactcaagcatctataaaagtaaaaagaataagttttaatatgaagtatataccttagtcagttggataatattatgtttgcctattctctgaaaaataatcaaaatatttgctgatatttctggccattaaacagtagatggaatattaatggcagatgaccatggaacttgatagaaataaacacttcatggaatgcctcacaagaaagagactagctagcttcaaatatgatggtatgcatacgatttaactctaaacttactagactgactaatacaatagaaacattcactatgtcatatctaacccagggaactatctctgagtttagtaactctggagctcctttttgtagggcatattgcaaacattacctcatctatttgtcaataattccatagacataaggaggaaattgagagtgccagagctttaaaacacaaagagagaaaaccttccacattattatacatcctgtgagttacagccctaatttttttttttactttaagacagtgtttctctttgtagccctggctgtcctgggactcactttgtagaccttgtaggtcttgaactcagaaattttcctgtctctgcctccccagtgctgggaataaaggcatgtgccatcatgcccggcagccccagacttttgactcagttgtgtctggtagggatcatccaactccataaaagaatgagttatttatttatttatttatttatttatttatttatttatttattatgttggctagtttcatctcaacttgacacaagctagagttacctaaaagaagggaacttaattgataaactgtcttagtaagatctattggagggcattctctcaaaaagaaattgatgtgggaaagcctagattattttgggtgttgccatccttgggctcaaccattcctacatccctacagaagaaaaaaaaaatcaccaaaccttgaattctcttgcttgaggaagaaaatgacaattcccttcagttatatgtgctggagggacaacaaaaaaatatcacatcctgagaagaaaatgaatgtgatcagacctccaacctaaggaggtagtgctaacaaacaagccaacaaaaatgatgtgctgcagacagatagagctctttgagagaaaggcagttagtgtggctcttctcggaataccattcctcgagctcaatagtactaacagtggcattcttcttttctacttaaaaatcacattattcatggcaagcactaaatgggatcaaagctaaaaagaatcttaatttacaccagttcatatttccccatcaccgatgaaccactgaaaattaatgcaacaatatggggagaaaaagaaacttgtgtggccttaaaacctgaaccaaactgaaatattgctgggatttaacagaaaagcttgggatagtgaagaggtgttcctgttattattgttgtttttattttgaagtaccaatacatactttttgcactgtgtattctttggtgtccaggattattaaactgcatgttaactaggttgttccctaaaggatacgtcagaaaacattttgtagcatgtctatcagatgaaaggtatttaagcaaattacagaatttatggacttttctccacttcaaataagatcttaccatctttctcatctactgctttttttgggatagattgtctaacttctatccattattcaaagtctataaaagattataggtcgggagctggttttttttttcaattctatgttcttgaattcaatcttctattattagattacagcttaagaacctatattactttgtaaaagtgatacttcacacaaattgaactgagagtgtgcttgaaaacatcatgctactattttacacagtttcctttttctctgactaggcattccacttcaatgccagaagcccttagatgcagagggcagacaatggtcttagacactggttgttctgccacaatccagtatgttcttttctttcagttcttgacttaatatcaatttgggatttaggaataatgtaacaatcttttttttttcccagagacaaaatagaactttgcatagttgttaaatgtcttgcctagcaagcaaaagactctgatttcaaaacccagaacccatggaaaaataagtgtggaaatttagtcccagtgctgaggaggcagagacaaacagatctgcaggaattctgattgcataggttcgagacaagctctagaccagcaagaatctgtctagaaaacacaaatgtaaaagcttgacagatggtacctgagtcatgacgtctgaggttgttcacaagttttcaaatgtgtatgaacttacagatataagaccacatgatcatgcaggtggggaagcctgcacgatcaaccgtgaaactagtaaaactgatattctttcactaaaatagctgtgtataatactaaactcctagatataataacctttcttttaaaaaaataaaataaatatcctgaaagaaaaaactatatatggaaataattcccattcacaatatcttcaatatatattttggaataaactgcgccaagaaaaaaaatagattaataaaaagtaaaatttaaaattattaaagaggaagttaaaagacactaaaatgtaaaagaccccttatgatcacaaattggaagtattaatatcataaaaatagtaaaattattcaaaattctttacagacttgatatcctcatcaaagtttcactgacaattttcacagtaatagaaaaagactaatgttcatttggaagcactgaagaagagttaaacaggcatcaccatatcttattgtaacatgttagagagaactctagtgacagaacagcatggtactggcacaaaacagacactggggcacacacacacacacacacacacacacacacacacactcccccacacatacctacttatacctactgtcacctcagttttgcgaaagatgaaaagagtttatgtttaaatagtgttttcagaaaatggtactaagaaaactaggtgataggaaccagattgatcagtctgttaaaaaaatcaactccatattgatcaaagaccataatgtgagatctaagtctgagatgtttagagggaaatttaggaaaccccctgaaatgcattggcatagacaaagactttctgaaaatgactctagtagttcaggaaattgaatcaggagttgacatatgaagtgggagtcggtgggtagggtagcagagtaagggggtaggtatagggtacttttgggatagcgtttgaaatgtaaatgaagaaaatatctaataaaaaattggaaaaattgacataagaacttatgtggaattaaaagaaatcaacatcaaaaaaaggcagtcatgtgaggcaacagcccatggagtgggaaaagcagttactaatctacaactgacaatatatagaatataaagaaaatgtttaaaactaaataacaaaaccacttatccattcaataagtaggtaaataaagcaaacagttctctacggatgaagtaaaactgccccgaaaatatgaaaaatgtttaggattcatgaatccaatcatcaggaaatggaaattataatatttcttttcactacaatcagatttgtaatgattaaacagaaaataacagcaaaagtgtttttggaatttaaatgtttatcttcaacacagcttggtccaagagaaattagtctagacactatgaaaatcagcttatgttccaaaactcctaaactaaaactacaatatgattgacatttttgccttcctgagtgtatctgaagagcgttaaatcacaatatcacatcaatgcatacatatctatgttacaccaatagtagccacaacagtatcgttacaatatcagcctagttgtctttcactaataaatggataaataaaatgtgacatatgcacaatacacaattttattcagcaataaagaagaatgaaatgtcttggtaagaaaatggatgtacctggagcttattgtattaagcaaaataatcctgagtgagagagataaatatcacatgataactgtcttttgtggatcttgattttcatatagaaacagaaaatatatttaggatatgaaagtagaagcaagggttggaatgatggcttagtagataagaactctcactgttcttctagagtgctagtatttggatgcaagaacccatgttcagtggctcacaattgcttgtgaactctgactgcaagggatctgatttgttttttctaatctctgccgcaccctgaaaatgaccaatcttatcaagccatttttcttttcaatatatgcttattcatacatatttgggtgtaacagcctcagcttatttataccaataaaaaagatagttaaaattcaggagcaagttatatcccctgccaactgcatttccaattatatccagtcgccagaaagtcaagataccaaaaaaccccatgtgtatacagtgaaatgcctgacagacctgtgcctgtcagagaacacatgcacagcctaggcatgtgtgtcatgcctagaattccaacaactctatctttagtaaaacacacgagagagagagagagagagagagagagagagagagagagagagagagagagagagagagagagaggatttaggacctcagtgggaaatcacatctatatttccattcatttttgattgtctctgattttcacatgtcaaatttctctgagggattatactcctgtcacatttaaagtcacatttaaagtagaaaatacagccaatgtcattgtccatgtatacttactacatcctaatgatctaatagatttgttttcatggcatgttatccaacataatgctctcttaattcttcatataaactgagtcccagtatgaccatgttctctgctttgtagtgaaacacaataaatatctggctatggtgcctcagctatcatgtttgaaagctggtatccattcatatctcacgtcagaagtctttactctatgcttgtattaccattttactagttcaaatgtcaggacagtcagctttcagactcacaggacagctttagtagttggtattgcactgtacaattaaaaaaaaaaaggcaagtaaaaggaagtgcattattccaaaggaactaagcaaaatgctaagtaatggaaggatcaagcttaaagactgttaagacgttatggtggaaaatgatattagacccattagtgcttgcttgggaactttcacctcttaggcaagcatactgcttctgtccaccttgcctaaggcttttataactgttcacaatcactaaaaaagaaaagtttgaaaaaaaaattaacagcttctcaataactatcccagtgctacgtagctaattttttcatcagtaatggctctgtggccacatctttttcttttaagaaaactgaagctcatacaaatcaatttaaacatctatgcctcatcaagcaaaaggacagtttatcgaaatataaacgatcatatattcatttggtaaattaaacacaacacatgcagacccatgacttcaaagtgtcatgatttacactaaaatgaacacatcttgattaggagagaaaggaagaattaagtgtagtatatataatagaaattacttagacttctttgatcaaggcataattaaaatatcctttctttgagcttgtgcattagtttaataatcaactggtgtactatcacagaatatgagagactacctgctcattaagcaatgcattcatatcagtcattttccttgatttgacgtaacctccctctacttatgtcacatctctgtctgtgtaatatgcaacatgaagatgataagataaatgcacaaaattactatcgaaatgaggtgaaaaatactggcaatatgacttgcaacatgactgtaatatagtaggcattctctaattattagctgtctgcatttactttagtagtagtccatttttgaatacttcttgcaggttattactctaaggcaaagattagagaactcagagggatgcctgggaccttcctgcagactgttacagatacttttcaaatggattatgtggtgaaataagtttaggcatggcagattaagcacccatttcttcaccacaagaatactgaaagcttttaataggctaatttccaatgtgaatcttcacaagaggatgtggaattcaacagttctaatgcattttctaaagtagccctccatctcttgactgttttgaaggtttctggtccttcatatatatgttaggaagatttgtagctactctttgaaatgcatgtcagagtgttataaactcccgtggttctgacttattttgaagacttgctgataatcatgtataagatcaaacaagttccttaaatatcaataatttaataaaattctttaaaatactccttgaatatcaatattttaataacttttcccttaagtatccgttttgggaagaccacgttttctcttctttagttcactttaaagttaaattcattatgtgaaataagaatttgttacttgccttgacaaacctcataaaacactgcaatatcttcatcccacgtttgcaaactttctgcacacacacagacacacacacatagacacacagacacatagacacacacacacacacacatacacacacacacacacaagcacagatacactcatctgcccttcctcagtgatcttcacacatcctaccttaaatatgcacactaccatcaataatgtggataggaagactcttcatgcatcctcactggatttctgcacctccatcataaactagagagctgtgaagacaaacaggcagctccagaacttgaccaaaatcagagtatctcaattctttgatcacagttttttgatcaacgatgaacccaagtcaattaagacagtaagagagtatatcatattcataactataatatgaagcaatttaccttgccagttgatcttgaaagagtatgagtcctactgaaatcctttatcctttcctttcaatttttcatgtccaacagttttcaggtagaatttaagggggttctggagctcagaattttttttttttgcattaaaaatagtattgtctttattttatgtgtatgagcatattgcttgcatgtatctgagggcactgcatgcatgcctggtacctgcagaggccacaataggttgatacatcccccagaactggagatataggtgttataagacacaacatgggtgctggaagctgaactctggtcttctgcaagagcagcaaatgcttttaacaacttaactcttagctctaacccttgaatattttcttttctttttttttatattttttaattaagtattttcctcaattacatttccaatgctatcccaaaagtccctcatacccccccactcccctacccacccactcccactttttggccctagcgttcccctgtactgggacatattaagtttgcaaatccaatgggcatctctttccagtgatggccgactaggccatcttttgatacatatgcagctagagtcaagagctccggggtactggttagtgcatattgttgttccacctatagggttgcagatctctttagctccttggttactttctctagctcctccattgcgggccctgtgatccatccaatagctgactgtgagcatccacttatgtttttgctaggccccggcctagtctcacaagagacagctatatcagggtcctttcagcaaatgcttgctagtgtatgcaatggtgtcgtcgtttggaggctaattcagtaaaaggtacatgcatagtactagtaaattttgcctttagatgacttctagctgagattatctctgagtctgtgttttgtcaaagagtaagtctgtaattcttttggctcatatcctgtttaactcttctcattattactaagtaatttctcctagctagacttattttattactacaaactactttttttgtggctaattttgcttttttctattctctcacctaacattatttggtgagacaactctgatattcttattttaaactgtttataaaatattataactggtttacaattaggattgcaaaaatgtttatagaatttaatttgctaaaatttttagcttactctttattagagatttatgttattttaaaaactatatattatatactgagtatggtggcacatgcttgttatcttggcatgcaaaatggttgaaacaagaggcttctctgagttcaaggtcaacttgggtatataataatttccatgacagccttggtaaaatcatgacatcctgtttcaaagtaagttgcaaaccagatggagtcccagcactgaaatgaggaagtggacatgggccctttctcataaccaaaaagtgatctgtagttaatatctatcctatgggaaagaaaaaaatattttctccaatggtgtcccactggatatattaataacactttaggataggtctcttgcccaagagctgtttgtcaacacaaaacaaattcagtggtatttgaccatttgtatgtgtttgtgttgttggttttgtgtgtgtgtgtgtgtgtgtgtgtccttggtctcttgtttgcatattttactttaaattcttgtgtttttgtggggtttctgtgcatatgtgctccaatgtatggatgttctttgtgttttgttggtggtttgctttttgttattctttgtaatttaaacagagaaaatgagcacggagttaagtggaagtgtaaatgggaaaaaagttaaaagagttgtgtggtgagatcagaatacagtatataaaaacatataatttcgatgtgttaactaaaaaaataaaataaataagatgtcaaaaaatgaagactacactaaagttaacatctggcaatgcaggtttggtatgtttacagaagcacgtaagtgttttaaaattccccaagaaataatgacaaatgaaatgtgcttcatctcataccttcctgttcttatactatttttacatgaacatttctagacatgtcttttaatagagcctaaaattattactggaaaggctgaacttcatcctgcattgttatcaggcatttcttatcattagaatttatgtgtttgctctctcaataaaatgcaaaggtaagtataattcattcagggccatttatgaacacattacagaaagaaagaaagaaagaaaggaagaaagaaagaaagaaagaaagaaagaaagaaagaaagaaagaaagaaagaactctactgtagtgacataatgaacttaagattacaagaatacactctgccagaaggtcattcatttctatcagccttcattttttcttgcttttcatttcttcctttatttttctcaccttgtatctacattaataatttgcctatatgcttattttaaaaattgatgtcttatattcccttatgatctttacttttgttttatagttccttttccaattgatttttgtaacaaactttaaaaaaatgtaaatgcaagtattttgtaaaatggcatccagagaaagacagaagtatttttcatgacacaatgagaaggtgaaaatggagcaagaatgtattctatctactgagttaagaggatatgtggtgtacttcattgaataagacaagtatattgagaaatttcacattaactgtagttatttatggaatattttgccatgttttatattgcactcaggcctctggttgaactaactcactatatctttatagtggtttgataaaaatagttacaattattatccttattttatagattatagaacaaggggtttgagaagaaatataacctgtccaaggtggcacaggccatgaatagaagagttggaatgtagatttgtaaactctggcaaatggctattctagactctatatgactcttgtatgatggagtcatcttcagtcctgggatgctctgaatatcaccttcatctccttctacaaccctctaccaaacttaaaaattcagaggctttgattttctttctaccactcctatagtgtaattttacagggataatctaaacttccctctgtgtcctgcatgtgattcaaactcatctggaacaacaacaacaacaacacacacacacacacacacacacacacacacacacacacacacacacacacacaaaagacgtatgaagataaagtaattgtgctcactctgcagtaccgacatggtccctgatgggatggctttgctgccacagccattaccgtgtacaacaaaattcttcccatgttcagattctcaaatagagcttcaagagtcactttttttttcttgattgctttctcactaatatttctgctccactctaagaatggagagagatagcctttctggatggatgggttatctgtataatgtaatcattaaatgcttaaactcagtctaaatttgaaggtgttggaaaattcacaggaggccatttttgtgtgattttgaaattattttcaattacagattggagcacagcagagtctgtaatatcatttcatgaggcataatgcttccctttgtcatgtctctgttctgattgagatgggcaactttaagcagactgacaaattcatgagtacttggcaatcactgattgagtagacttactataaccatgccacaaataactatcaatgaaagaaatagatttttaaaaaataaaatgtgcaaggcttctaatttagatgtaattgaaatgtattcatcaaattttgaattttggctcaacaggaataggaagttagtactggaacactgacttacagaatacttataaaataaaagtcattgattatacatgtatatacagcaaggactgggtcattgaaatatgcagtggctgattttctcagatacagttaattagcatcaaagagcacaatgcagttatattgtgcctgtctgtatacatgtttatcaatatatcaataggcatatgtaaatataaatatgcttatcaacacttttttcaatacatacctttaaactttctaacaaactgtcagcaaatgaaacttatagaattacatacacatctctttaataactctttcaaggtatataaaggtgaatatattgtgacaatatttgctccatgatttaggcattttcagagaaacttagaaatatagactttcttattcttctggtagatagccaaaattaatgcctacacagcaaaaaaaaaaaaaaaaaaaaaaaaaaaaaaaaaaagatgaaaaatttgttttatccattggctcctatcctaagagtgatggtgcaaacaaaggctgaaaaaaaattggcagtaaagatgacaagaagacagaaactgctatggataagagaaagaacaggaaattttgaatgattatcggagaatgattttttttccaaatcaaatgcaatgtaggtaatattagattaaggatattaatgactgtggaatcatctgaatattaatcaacatattattaacttgtcttaacatttagtccagaattaggctacattatatgatagctggttcatttttctacacatagcaaatacaattcatggctagtaatcaacattctattgtaaccaagacatgatgcaatcatgttcaaagtaagacttacgaattattttgtacagggtgacatttcctttcttggaccctcagaaaagtaagaaacaaaactaacaaaatacaaagacaaacaaaaaacaacaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacagagaaatcctgtctcaaaaacccaaaaaaaaaaaaaaaaaaaggataatggagtttctccttccatttttccttttctccctctctttcaaataaactataaggattttcctcctcaacacactttctactaaagttttataaatagttcctaaaaataagcaaactctgtatacatgcctgggagtagatttgctttgcttatagacagtagtaagaatattttcattagaacatatctattattcttttttatcatctgttctcttactgtgaaaccttacttagatgtttattgctttgaatgcacatgtgcattaatgtacatgtatggtcatgtatatgtatttccatgtgtagggtacatgtatgtgtacgtctatgcatacatatgcatggaagggacttagttgatgccagttgtttttctgggttaatttctatgttatgtaattgggaagatttcttacctaatccagagcacttcttttcagttagtttggctagccagcacactctgaggtttccctctctctacctccagtgctctgagattgtaggtggtcaccaaaccaaccttacttttatagattctatgggtctaaactttagtttccatggctgttcactgatctacaccttcagcttcaatttagatgatttcataagttcttagacctatacctatctaaaataaattctctacttttacctattttagtttttgttttgtggtctatatttcttttgtttatttgtagaatttttgatttaataatcaaatttgagattctttctgaaatatcaatcataagaattcagagaagttcctactttttatggtaatatcattgtatttagttaactttaaatatccaaatgaataacaggaataaagttatgttttttattgttaattctttctgtcaatctggagaggactctttagtttccatggttttgtcatttttgcaatgattttgaattggggaatttgtagacttgaagttgtaagatcattcacataggtgaatcacatcagttcttctggtattgtataacttttttctttgatgaggtgaagtcatatgcctgtggaataaaatctaagacaatggttctccagaattttgagttactaaagacatgttattatcaaagtaggtaattccatactttcttgttgcagaatttaccatctacctacctcaatggcagccgtacatgctaattattcatctctatacagtttgaattttctctatacagtttgaattttgtaaataaagggaactggatagcaaagcaaagaaaaatgatgcttagtatagtgtgatatatatatatatatatatatatatgctctgaggtaagagtaccaatatcatcaatacaaagggttataatggcctgggtaaaagagagactcatgcacggttttgatttcagagggcagcagtgttccacaaatagaatgtgtctgaggaaaggaaataaaattgacttttgcctcttttttgttggatttggaagtgaaattaggacttgtgtaccacagaataagggtagatgaatagtttaaggatgtgatattaaatgcagaggaaataaaaaacattgtttttctatgttatactctctctcttttttgcatggggagtctctaacatgtctctgaagtaaatatgataggcctacatttgaaaacatcacatagggctggctgtgcagtccttcttcagtcctgaagaaacaactttagtaactatctctgaacagatggatgcctatctttggagagcagggagacaggagtgagaaccaatgtagaagcagtgtgttggccctgttctctttagaaataatattcattactccactttcttcaaaggtagtagttagatggcactctctcactgtagaaattaggttttcaagtctcttagttcatcagtgatccaggtaagtgatattttagtgcatgattttgtgatggactataaaaacaattctttaggaccacaggttgaaaaaaatcctactgattttcttgtaagatgcatatttgggcgtcaacctttgcaaaacatgcaaagtctgagctctttgatattgctcttataaaagaggacaccgaaacataccaacattaccattccacttgggaattatttgaaaactgaaataagaacaaactaccaactttataaagacaaattggaaaaagcatccttttttttttttagttaccctaatttgactattcaaactaaatctttaggtcagttcaactacagctcagtgacgtattaaaattataatggaaaagataaaattagtatttacatatgtggaataaagaaaaactgaagccttaagtaaatttgtcacactgaaaaagattacaaggaatacatctgctgtaaaaagcaagtaaagaagagaacccagagaaagtaaaagatattaattttataattttgttcccccattgttacctttccaacaaatcactcttagtcccttaagataaaataaatcagtgagaaagttggggaaaaatcgtttctcaaatcattcaagattccacagctgagaaggagaagtgcctaaagaacaagaattatccactgtcccctacacattcttcagccttctctctaatgtaagcacacatttaaaaaggcagtgagagggaagaatatggtaatgccattatttggatttcaactgcacatctgtaggagattgttcaagaccacgcgtatgtcataacattagctgttggtgacaacaaactgtggctgctctaagaaaaggtaactccaacagaaagatcactttgcaatcatatcaataaaatgagagaaaaatagtttctatttttttcaaaatggaacagcctcaaaaaaaatcatagataacaaaagtgaaagcaatagaacactgataacttcttgacacttttgccaaattttgactgttcacaataaccaggcaataagaggcttttattgtttggatttaatttttagtgaaaaaattcaaacagtatattctggtcataatctctcctcccacatattatcttgaagcttctacgtccctatgcatccaactcaataacctttctttctctctttagaaaaacaaaagcaaataatagttttaaaataagaaaaaatgtaatatatacacacacataactcataatccataaaacatctcaggtctctgggattggtcctagaaattgctcccacacacccacctttcaaccaccacaactgcgtattttcattcattctccaggacctctgagcagctctccttctgtcccatacctcatccagccctgctattcaccccttctttctcccacccaggtccctctctctctctgcttcccatgactattttgttatcccttctaagtggaatttaagcatcctcacttgcatgttttaattttattttcagctgatggcagaatttaccaggttgagaagttttaaattattaataattcaatttgttagttcttatctttcatttatttttatgatattagttttaagtcaattgtgtgtggagaggtgttggccatcagtgacaagatagtctaaagctatattttcaggtgattttgagttggcttatgaaggttcagggaacccaaatattatattttgcaaaagtcttatatgctcttaagtactgagccatttctctaactcatttctttttcagtcagtctgttaaacatagagattttatacctgcctgtattatctaaatatttaatttattaacagacatttattgttttccccttaatactactatttttgacaactaaaagtgatgtctttctcttatttctaatttttgtcaactgaactttctctgtttctgtgttagttttttttttttaattttcttaatattttcagtgaattagccttttgattttgtggcaattctaacattgccaattctctacttcatttacttctgctgcagtctgccttctgtttcacagagtttgaatttatattctcttgtattttcagcttccttgggttaagtcaagtcattaatttgagatttgtaaaattgagccgtttatagctggtaacttcattctatgaactgtttacttcacatttcgtaaagtttggtacattgggtttccattttcctgtaactttcgttaacagttcgttcctgatttttcttttggtccatctgttatttttcacctttattactttatgcccacaattcttgtaaatttcctaaattttgattttctagtaagtttacattttccgttgtacatagagattaagctacaccttcctatgactttaaatatagttactgtaatctgcatttgtattcattatgctcaactgccaggctattgcctgaatatggtagaggcatactcaactatgacctccagccctagcctgaagcatgacataattcaaagcctaataactgtaatttcttaaaatgctgattatatgcataatcccttcataagccttcttatctgggattagaggacagtcatagcactaaagtgtgtaagtatattcatatgggcataaagagaacatttcatttcttaaattagttttgaaaaatagaaaaataatgtaagattactaggcttttgtctcttaataagatttattttatttttaactgttctagttaaataaaaatggcccaagtaggctaatatatttgaatgcttggtcattaggcaaggatggcttatttgggtagctgtggcccttttggatgaagtatgttactgaagatgagctttgaggtttcaaaagctcaagtcaggtccatttgctctcaatttctgaaacttatggatccaaggataatgaactaaacccctgaaattataagcaatcttcagttaaatgtgttccttcataaaagttgttatgatccgattatctcttcacagcaatggaacactatgacagctgtataatgaataaatgacacacatctgcagactatctaatacataattacataatacaggtaatatatatgtatatgaatatccattcacactacacatacacacttttactttgtatttagaaaatatagattgatattttatttaaatatcattaatattcaaacaaagaaatataaaattatgctggtgaatttgtttatattctatagcctttgcattagcagtacagtataagaagaaaatagacataaattaacctagtatagctagagctaagaaaggacatagttaatacaattgttttcctcttatcctttattgcacatctgcatgtataataatgaatgatcacataatgatcagacagtgttggctattgatttaattttcttgactaatataactatgaaggcactaaaaattctcccttatataaaaagaatatgcttaaaagataattaaatggcttttattgggtatccaagtaaattatcaaagtggaaattaaactaagatttcttctatttatgccagtagctatcaaagaattctccttggtctgaaacatatttctccagataataactttataccaatctttgttgtttcttcctcatctaaagatatattgttatatttatattcaaatacataatatcaagacatttctgttattttttcttcagagatataatgaaatgataaaatactcagagtcatccaaattcatgcctagaatgaggcatctcatcatggaaccaacgatataattacaagttataagttataattgggcagctaattgtcaaaatttgattctgctggcagttataaaattcttgaccttgaacaatttctttaatttggggaagccttaattttcaacattttaaaatgaaatgcttggagtaagtaattgataaaacgtctttaagaattattttaacttactaatgcaaaaggtccacaaaaggggaaacagtagagttttatttactctgcttgttgccttccaacaagccaagaggtatagaattacttccatttatttgtttttttttcccatttaaatgttttattagttctttgaaattttgatgcattatgtttttcataatatccatctcacatatccttcaagatccttccctaattctagagcctccaatttcagtcaatgttctgttgccatgaagagacaccatgatcacagcaatacttataaaagaaagaattttttagtaatgtgcttatagtttagtccattatcatgagggaagggcatgtaagagcatgcagtgagtcatgatgctggagatgtagttaggagttctatatccagatttagaagcagcacaacgagaaagaaagtgcccaggtttggggttttgaaagcccacattacactgacatacttcctccaataaacccatctctactagctcctctcaagtagtgtcactctttgatgactaaggaattgtatgacgctataggtaaaattttcttttgtttatttatttgtttgtttttaaatttggtggcgtgatgaggcaggaagaggtgactcagcagacccatactgaggcacccatgcacgtgtgctcgcgcgcgcgcgtgcacgcgtgcgcacacacacacacacacacacacacacacacacacacacacacacaacacacacacacactgagatactagtcaaagaggggtctgtataaaatgaagtttctttggggaatgagaagtggagatgagaagagagtggaggctgagaaagacagaaaaggacagaaagagcaaaaagaggagagagaaagaagggaaaaggctagcttgggatatgtagagagagaaagggggaaagaaagatagagtctagagagagaggcaagataaagaggagagaaggaaaagaagaggaggaggaggtggaagaggacaaggaggaggaagaggacaagaagaagaagaaaaagaagaagagagacagagagagagatagagagagagagggagagagagaacacaagcacaaacactcctttaacagcaaaccaagcttatatctggctgttgctaggtaactgttgggcagagcctagaataaatgcaaacagtggggtccttattcaaaccaactgcacatccaaatgtgacaccttactttaaaagaattgaagaccataaatcccattattattggctatgtactgttacatgtatgtccacccactggtttatattagacctactaggaggtgcatctttaaagaaagtaaattctcccaacagctgtcacttaccaatagttccttagctaaaggttgaaattcatgcatatctcctccctccatcctggaattttttctggcttaaacttgagcaggtcttgcaaatattgtcacaactactgtaagcacaaatgtaaaattgctctgttgtgttccaaaaacacttcttccctgtagtaatctactgataatatgtattctgtctattgtactgtccattctgcagtgatcattaagttttgagacaaataggatatagtgtgtgtgtgtgtgtgtgtgtgcacgtgtgtgcatgatattacatgcatgagtatatacatatatgtatatatgtgcatgtgtgcatgtatgtgtatatatgcatatatatatgtatatatatatatatatatatatatatatatatatatatatgtgtgtgtgtgtgtgtgtgtgtgtgtgtgtgtgtgtgtgtgtgtgtgtgtctatgtactctatagtaacttatggatggatgtgtgtttttgtgtctatgtactctatagtaacttattctctgtattgtggcctttagagttctgtctgttatctccattgtgagtagcaaaaattaaaagaaaattatcactgtttggcatgtgtggagctaaatgctctagaaaggacctcaagtttctccagatttgtgtaaaatgtctcttgagtaaccaggagtgtgcttgaatcttaagcacagcattttggaactgtgactgacggaacttgcacttgctattttgtatatatcactggcagtcaaaatttttgtttgaaggcaaaatattttcaaatatgacaaaattatctaaaataatagttcttaattagtttctagacaatatattttctcaatatttttaaagctgtgcacccatatttaatatttatttcttaaatcatggtctcccttcaggtttgtcttactagggtagaatacccaaggcaatgctgaaagtaaaaatgaaatctttagttttcagttatgaactgaaagcctaaaatgggaccatcctacttatatagtctatgataatagcctcatggtgggtgagtgtagtcacagcaggaggctgttatcatagactatatgaatcaagaaattgtaacttgagacaggaaggctaagagtaagtcaagtgtcaggttggctcttacagttaacactcaagggaagtaaacaaggacaccatgagaatctctttaatctttgccaaaggcagcaacctcagtgaatagtctctagactctaccccttaaggttcccaaggacagtgcctataaccagttgaactccggaggaaactacttcttaatcacagtactgagagatattcttgtttatgcctcccttaaaagtaacaacagccaaacttgaagctcaatttattaagaaagccagactatataaaggtcagtggacattattgatgagccttcaaattcagacaatttaattcagataaaagttcaaccaatggtaaaagaagcaaatacacatttaggtaaaaaagtgatattagtggtaatttttgtatttctaattctttcttttattattatttatctaacagctataggtaagactaactatgttaaaatgtagtatgtactatgaatgtagtaattagtatgtatcactgaaaaattattagttaagacaagattgttctagtactaaaatttttagacattaataagtaaatcaggaaatagttaaaacaggcactggtaaaaacatgaaatctggagtcacatattcactactatgtactgtagaattaatgtatgatcttatattattagatttatcatctgaaaaatacttgatactttaaatatttattaatttattctctcatatattacattctgatccactccctatctcctctactttgccacggatctccttgggaagggaaaatagaatagatcttggtagtggactggagtgggtgggcacaggaacaggaaggataaggtggggaaagaatgaggggaaagaatactgggagaggcaattggaattgggagggaattgaaagacaagttagaaacctagggcaatgcaaactccaagaaatatattagggtggtatattttcacttctcatccattctttctcctatttccttaaaaaaaaatgaaaaagaaaaagaaaagaaaaaggtaggccttcagagatatcaaccaaacacgacatatcaaaatgcaataaaattaagaacctaacctctttttattgacagattgggcaaaccaggaagagacaagggtgacaaaagcaggcacatcatcagaaacagccacctccccctctcttagaagtccaataaaaaacactaggctgcacacctataacatatatacagaaggcctcatttcaacccatatttagaggctccatgactgttggatcagtatcagtgagcacctaggtccaggtttgttgattttgtgggttttcttgaagtatctgtaacccctctggcttctacaatctttcctccccctctttaacaggattctccaaagttgcctaatatttggctgtgagtctctccatctgtttctatcagttgttggatgaagcccctttaattatcatttggataggcatcaatctatgagtatagaataatatcattatgtaccatttcacggatttggagggggtggctatactatagatagctgggccatctagattgtagtttctggtcctctaggcaatgtcaatgatgggctcattcttgtgacatggatggtccagtaattggtggcaactcccacaatttctgagccacccttacaccagcctatcattttgacaggacaaaatgtaggtcaaatgtttatggctgggttgatgtaactactccctacactagaaatcttgcttaattgtaagagatgatctgttcagtctatcccctattcctctaggagtcttcattggggtcaccccaatatattccttagaatttccattgctctaggtttttaacttagccctgaattgccccccccccaatgcaattgcctttcccagtactgcctctccattctctcccaaccttattcctccagttcctgtccccccaccactccagtcaaccaacaatgtctattctatttccccttcccaaggagatccatgcttccgtgaccttggacttctccatattatttagcctctctgggattgcattttgattatccttttctttacagttaatatccagttataagggagaatatagcatgtttgtttttcaggatctgggatacttcattcgggatgaaggtttttttctatttctatccatttgttcttaaatttcatcaagtcattgttttaacagctgattagtaatccctcgatttaatgtactatattttctttatccatttttagttgagggacatcttggttgtttccactttctgtctactaaaaatatgttcagcaattgagcaactgtttttgtggtaggatgaaacaagctttagacatgtacagagagtggaatagctggctcttgagctaaagcgattttatgagaaacaaccatattgatatccgatgtggctgttcaagtttacactctcaccagcaattgagggctgttccccttgccccacattctctctagcatgagctgtcacttatgtttatcgtctaaacaattctggcaggcatgagatggaagctcagagtccttttgattttcagttccctgattgctaaagttgttcaacatttcaagtgagtgtttttttggtcttttgagattcttttgttgagaattttctgtttaaatctgtatcatattttttaatgcaattatttggtttgttgatatctagtatatatataaaatatacaatatatatatatggaaattagcctctgtcagatgtagagttagtgaaaatattttcttatcctgtaggctaccactttgccctattgattgtgctgttttgcactgtggaagattttcagttgaatgagatctcatttgttaattgttgatattagaggctgtgtaatagcataaacattatctaatatgaaatactgtaaatgtacctagtcccctcaatacgtttgaggtaatgttatttattttatttctctcaggccctcagtgatttattttttccaaatcaatgtttttaagcacaattttttaatatttaacaaaatagcataaaaataacattaagaattacattcatgtaatatctgtaaaaccgaattgcagacagactgtaggcattttcgatggaacataatgtattggtcatccaatattttccattctttttttattgcatattttctttatttacattttgaatgttatctgctttccatttccatccctccacacccaagaagccccctatcccatccttcctccccctgtttctatgagggtatttctccacccacccacccactcacacctccctaccctcagttcccctacactggggcatctatggtaccttcataggaccaaggacctctcctcccattgatgccagacaacaccatcctctgcaacatatgcagctggagccatatgtactcttgttgatggcttagtccctgggagctcttgggggacaggttggttgatactgtttttttcttgtgaggttacaatcacctgcaactcctccagtactttctctaattcctctattggggaccccgcgctcagtccttctctgtatgtttaaggctccagcatggcctctcaggagacagccatatcaggttcaattcagcatgaacttcttggcatccataacagtaactatatatgggatgaatcccagatgggacagtatctgaatggacttttattcagtctctgctctgtatttcatctccatatttgctcctgtgagtattttcttctccttctaggaaggaccaaagcacccacattttggtctttcttcttgaacttcatgtggtctgtgaattggatcttggttatttagagcttttgggataatatccacttatcagtgagtgcataccatgtgtgttcttttgtgattgggttacctcatcagtatgataatttctagttctatcaattgacctaagaattttatgaattcatcatctttaatagctgagtagtattcattgtgtaaatataccatattttctgtatcctttcctcttttgatggacatctgggttcactccagctcctggctattataaaggcagctatgaacataggggagcatttgtccttattacatgttgtagtgtcttctgggtatatgcccaggagtggtatagttgggtcctcagatagaattatgttcaatgttctgaagaaatgctaaactgatttccacagtgattgtaccagcttgcaatcccaccagcaatggagcagtgttcctctttctctacatcctggccagcatctgctcttacctgagtttttgatcttagccattctaactggtgtgaggtggaatctcagggttgtttggatttgcatttccctgatgagtaaggatgttgaacatttcttagattcttctcagccatctaatattacttagttgaaaattctttgttttgctctgaaccccatttttttaaaaagggctatttgattttctgaacttgtcaagttcttcatatatattggatattagccctctatcggatgtatgattggtaaagatcttttcgcaattggttggttccttttttgtcccattaacagtatcctttgccttacagaatctttgcaattttatgaggtcccatttgtctattgttgatcttagaacataaaacattggtgttttgttcaggaatttttccaatattctcatatgtttgatggtcttccttgctttttcctctataagtttcattgtctctggttttatgtagaggtccttgatccacttggacttgagttttatacaaggagataaaaatgggttgatttgcatttttatacatgctaaccaacggttgaaccagcaccatttgttaaaattgctgtcttttcccactggttttagctcctttgtcaaatatcaagtgatcatatgtgtgtgggttcatttctaggtattcaattctattctattcatcttcctgcctgtctctgtaccaataccaaacagttttttttatcactattgctctataataaagcttgaggtcagtgatagtgatttctccagaatttctattattgttttacttatatatctattatatttttcactatcctgagttttttgttattccaaatgaatttgaaaattgctctttctaactctatgaagaattgagttggaattttgataggggttacattgaatctgtacagtgctttcagtgagatggccatttttactatattaatcgtgccggtctatgagataggagacctttccatctcatgtgatcttcttcagattctttcttcagagacttggagttcttgtcacacagatctttcacttgcttggctgtagtcacaccaaagtattttatactatttgtgactattacaaagggggccatttttctaatttctttctcatcctgcttattctttgcgtagaggaaggctactgatttgtttgagttaattttatatgcagccactttgctgaagttgtttatcaggtttaggagttctgtggtggaatttttggggtcacctaagtatactatcatatcatctgcaaatagtaatactttgacttcttccttttcaatttgtatccctttgacctccttttgttgtctaattcttcttgctaggacttcaagtactatattgaataggtagggagagaatgggcaaccttgtctagttcctgattttagtgggattgcttcaagtttctctctatttagtttgatgttggctacagttttgttgtatattacttttatcatgtttaacgatggcccttgaattcttgatcttcccaagtcttttaacatgaggggatgctgaattttgtcaaatgctttttcagcatctaataaaatgatcatgtggattttttctttgagtttgtttatgcagtggatttctgttgtggtaaatctccacccaaatatgttcaggcaatgaaaacacaactcaataagaataaatactgtgcccctagattgggcagatctaccactacactaccatcttccatatctatgagaccccttataacttgcagtttctccaggtgttggactttttttttttttttttggacagggtttcactgtgtagcactggctgtcctggaattcactttgtagaccaggccggccttgaactcagaaatccacctgcttctgcctcccaagtgctgggattaaatgtgtgtgccaccaccgcctggcttggacatttcttttttaagtgctccttggccattcaagattcatttattgagaattctatgcttaacactgtactccatttttaattgggttatttggtttttaagagctcataggtgtcagggtgaacataacattaaaaaaaaaaaaaactaggagccacaaaagggttgcttctctgactgtcagcaggtgaacatagagtgtaaagatacaggagaaatatctaaccacgccctttccacatttccctttcgtttcctcattctcctgaggtgaacctgaattccacttgggttacttgtgggatctttcgctattgtcttgtctgtacttacatttaattcttttataattgtgactgctctcacaaatattttccactactacctagggtggactttgtgagctttaaggcagactctatttttaattgcacttgaaatggatgttaaattccttgttatgccctctccacaatgaaggctttttcttctgaaattatagtacaaccaatgggaaagaatctctgagaacccaatgcaaacggaacaacagtcacagtccttacatcatctattcccttttactctgtactctcttaaaaggcatgaataccaatcccataatttacctgattgtgaagaatatagactggatatgtaattctgattgaacacttggtgtggaaattgcttgggtggctggacatagtagttgggatatctgctctatactgcctctgaaaatgcaacccatgcagccacagtctgagcaacatatgctgctcattggctgccttgttaccctgactgggcccattaatataaagcataaacaaagcctggatgactggagctggccattttgttacaacatatggtggtgatgtcctagatatttttatcctactcccgcccagatgttcagatctcctgatactcagtttaagcttgcaggcaagatagtagagaatgcccttgtgatttggggagaaatatgttggattttaccccagtgccttgcaaaaaataggtggtggacaattaataagacacctaatgctctctttaaatatattgtcctatttcaaatagagcagtaaatctccatgaatttatcattaattttctttagttgtctttccttgaaattctgtaataccaagcaaagtgaaatgtgctttccttttccttgaaaagatatagttaagccaaacgtaatatttcagccaaggcaacccagatgatttacttagctttctctttagctgcacatgactgaatgcagagccccattatgttcaagccatggcaaacttgaagaacagcagcatggtatttgtgagagcatcacaacagccagagttctatcccaagtggtctggcttgttagaccagcattaaaaattgtggactctcattacctctaggattcccttgaaattttcgtttcattgtttactttcatgacattctgaatgttctctttccctttctcaggactgagtcttgccattcttgactctctctgggacacgaaaataggtcttagattttactattttgcctcatttgcaaggttaacagttatcacactctaccagatagctggagaatagtatgtcctcactgtagtccctgtcaaagccctagggtagctgcgaaatcagcaatcctctaataggaaaaggaacagtgctgagtataatagtaatgtgccacatccaagtggagcttttcatcctaagatgcctaggctctttgccaacacccttggcactaatcctgagtggcatggatgattatgaacattttgtaggtggaaaaccagaagagtgctgggcaagacacagtccaaacaaataagatcatagacaagagacttgttgaatttccaactgtacagccagaagaagaaatgagaaaagaagttgtttacttctaattttatttactttaattactcttgttattaccatttgagtctgtaacttttagaattatttaatcatgcattgattaaagtttccaaaaaattatcacttctcatgttctccctaaatactcagagattgttattccttcctctccgtggatatttcatttacaagatacctattgttttataacttgctgcttagaatctttattttctcagtcttggtgtacctggaccaatttttgcatatagttttggttgtgaaatgccatgaatgtatagacaataaaagtgaacatacatctacgttcatgtatatgtatgtatacttctcttttctgtaagttgtcaattcttgagagacatactttgggcagaaatctgtgaggtttgtctccaaagtctggaggctctgaaagacatcattggcactatagttttcatgtaaagaaactcaccatcccagtcaaatagagtatgtgattaatttgtgtcttaaaatgcatttttcttctctattttagatcagtgatagctatgcaagtttatactttgtttctttttttactacagaatatagtaataacaatcaatgccattaagtactcatagtttaacacatttgaaaacagagtgccatgaaactagattatctataaagctcggtgctaaaagagtttatggaaatacagctgtgtaacataagtattagcgacatattaaatgacaaaaaccctaaaacatatgtgtgtcacatgatatgccatctggtgtttgctgtgtctgaatgtctgtagttggagatatttggagtatactaattcaatatttactttgtagctactatttttattcatagtgttcacctatatttttacaatagggttatgctatttattatgtgtccatttaagatgaaaacatatgagctaattgattttaaatttaaagttgatgtaatcccatctattagtctaagggcaattcattttatcggaaatagattctattttcaaagtccttattcaatcagggggtttactaatttatgtacttatttggacaagacaaacattaattgagggcacttttattctgtaaaatgcctctgcctgcctgtataaacataaatcaggtgataaacgtaagattaagaaaggcagatagaaataaaagattaaattccgagaaaactcagagatgctgaacattgttttggggaggttcaattcatcccaaatgcctggtaacttttctttaagtcttgcatttttaaaaaattgttacatttacacacacacacacacacacacacacacaaacacatgcttttttatactcaatatttccaccttctttcttcttaaaattcctgctatctctccacatatatttgaaaatacctagcgaattcatgtctatttcttttgttcttcttatccattcaagcctgatgagctcagcagagggctctaaggacagtaattcctcctgtccaccaatctattgattgtcatttttaaaacagaacatctattgataccaatttgaaagtttctaatatgaagttagaatcaccattctttgatagctaattgaccatctccattaagtgataataatggaggaactaaggtaaagagctgattctactggaaataagacaagatgggtatggtagtataaacctggaatatccagcattggaaataggaacaagacttcaaatcagccttggcttttgagactctgtctcaaaaataaataataattatatttatttatttatttatttatttatttatttatttatttcagaagggctgaaattagtcagctttccaggttagttacttctcaggttctttgcttgttctggctgatgaaatcctctccatctccaaaggaggaaaagattaattaaatctgtataagaggaatttacatgagatgatttcactatgttagattctaattacctactctgcccattgaaagagctagggttacttaaaatatttgtttttttttttttttttttgtaattcgctccactctgcttcagactgtattgcatccctctgagaaaagtttcttctagaacagtgataacctttgtcaacaaagtttccatttccattcccttctgctcctactgagattccttatcaggggctgcctgctgcctggtgatttttgtgctaaccattctgttatgaaaactgagaaaaatatttcaagaatcccattgaagctttgattgatataaagtacaataaaaacacccctgggattagtgacaccaagctttgcttttgactttaacattgaagaggagggagagagaagctttgtttagtgttgacccgtgcaagtagaggcaagatgaatcagagtgttgtttgttgaaatactctggagcaataagaacatttggaaagtaatgaggatagtgcttagattaatggcttaggtcatatttcatccattatacttaacacaggaggaaaaagacccaaagcaggaagttggcacaatcttcaaaattctacacatattaccaatcaaaggtcatggtttaaagttctttcaaaaatccaagcaatgctaattaacagctttacaaagcaccccatttctcctataaattctttcaacatctcataaaatttggtctaaaatactgttttatttttcaattattcaatggaaataaattattttattttattttttaattaaattataagttgaaaagttaaagtttttaaagagatttattagttttctccaattgtttgtttgtgttttcctggctttctttgaagaatttgttcacttcctccagtttgtttgtttgtgttctccactatttcttaggggaattcattcataatctcttaaaggacccctatcatattcataaagttgtttttaaggttgttattatgtgctatgactatgttggaatactcaggatttgttgtagtaagtaggatagctgagctctggtggtgacattttaccctcgatgttgttgattttcttctaacactggtgtctaagtatctgggtctggggtactattgttcttggttacagaacatcttaagactcaaaataatactacatgatttttgctttagagatttccatctctttatgcacagttttgcacctaatactaaggtgctctgacatccattttgaatccttagcacagtaagcatagactgagaggccccacagtagaacgcatagatatcaaagaaacccaaatatgaataaaaacacaaacacccacctcttcgaatggtgtaaagatataataaatacaaataaactactaattttgcctgcctgaatctcaataaatattatttattgttgttgttgttattattccagtagtttgaagaacagtagaaccttcaattttatgaaatgaaattgtcttatttaaaagtgtcactaacagtgcttgccaagtatattgttttaaattattaatttacaaattgcaaattgaatttgttacattattaaattatattttgttctgttctcaaaatgaatattaacaaaatattaattcaccataatgcaaatgtctttttcaagtttagtgacatgtcagttaatcatgagagaatatgtttgtctccatggctcctttgtcctttggctttgagtttttttcttctgtttctgtgtttgctttgtctcactctggtgtgtggtttttaattttctcttattttactattatttttacaagcctatttgcatttggataagagagatggagagagaggatgtggatttgaatgggtaggtgaatggagagaatcttgtaggagttggggtagggaactgttgatcagaatatgtgtcacatgaaagaaaatctattttaagtaaaaatacaattttatagaatatttatcaatacttaaaaaacagcttttaaaacatttacttatttgtttatgggggtatgtgttcttttgtgagagtgtggagatcagagacaacttttgtccttcagttacaagggccctgagtctcagattcaggttgttaggcctgagttacctcaggttgttacctgctgagttattgtgctaccttgagaaatgttttttataatcaaaagataaaaggcaatcacttaatattatagttatccagtcaaggagtgaagaagtcactttttgaaaagaaattccattctaataattgccccagttataaacaaaatgttatgaagaagtataacacacacttccactgtgtgtttgtaaaatgtgacatatttttgtttatttactcagctaaacttgtaatggattaatggatcagttgacctgcatctatgtgtaccttgcgtgttgttggtgcccattctatggtacacacatctaggccagaggaaaccagatttggttccctccttccatcctttatgaggatctggggtttgaactctaggtttaggatcaaataggaagcacccttacctgcagagagctatctttctgggtatgggacatgaattttctaaaagtagatgtcatatcccagttttaaaagttgggacacatctgcaacaggatgtttattaaaatatttctttctatctatttctataacttgccttcaaggccataggttcactgatgcctacaaggtaaaattaaaatgaacactttaaagaggacaaactagctttgatgtacttatcctcagaagttgaaacaccaggagctggtggacattctgcgcttttgatcctatgacatgtgacacatgctccagtatatcttgggataaggtgatcaaagactgtcaatgatgctttattaagccagccatcttctagatttcattctaccctgtgtcccatgtgatcattaaaaaatcgtggtttataattcagtacacagacagcaatatatatccttctccaagtgcttaacctctacattactctttcccagtgaaggtctaaaaatgaaattgtcaggttacagactcttggagccatggcttcttataatactgtttcctgcctcttctggacattattgatttttccataactctgcttgaaactgtggacataatttacagataaagggtgaagaggacctttcatgttattgctgccttagagagagacacaccatgccctcttctttttcaaacaataccacactttacagtattatttcttggaatgtaatataattccctggaattaattatttaatcaggtttagcttagaacatgttttataatataattcctagtgaatgcacatatcagtttcatttcagtttttcttgctatgacattttatcttgatgtggtatttctaatgtgggcatagtagttccctggtttctttgtcttttggtgccttgtattctatgaatggtggtgatttagtatgatttagtattcacggtgtagagcagagacctgagatgaagaggtgcctaggcaagggatggtggtcagggcttctcagaaaactttttgtgtgaacaaaaaccatacatactggagaaagatggaattaactgattcaacgttacaataatcatagaagcaacagcgggaaactgctcttaaaagttattccatccaaacttgttttgaaccattcttatttcacagagtttcagatagatgaatgtgtttgtccaaggtcaacttggcagtaatgaaagagacttcctctctaggtctcatgctctgagacaaaaggttatacataaaacagaactggctttagttctcagcattacaagtttctggtctcagcaactaggaagccagaggaggtacattcaccgcctgctgagaactttcaacttcatttccaagaggaaacctcctgcaaagggtgtgcgactgacttcataattgcacttctttggcctgcagtgctagtgttctaagaagatccttctgaaaaccttcatacttaaagcagtcctttgtactcattagcgatttattaactaaggagagcagtttgaccgcaggatatctactacttgcttcaagcccatcataatatatagggagagaagctctttgccttcatttacattttagtacattttctcccactctcaggtagattttctttccctgcttaaatttttgatctcctctcagtgcacctcctccactggatggaaaaaaaaaaacaaaacagattcataaaaccatccagtttcataaatataactgcataagtgtgccctgggcaagggtcacaccaacagacataccaaagtggatgggggaactcacacaaggcttcaatcctaccaaaaatactataggcaactaaagagtgctgagagctagagaaataatcttaaaccaggaagagtacaccagtgagttttctaataccaaatggtttgctttgacacatatatccagaaatattatgcaaactgagcttattatacttcttcatataaatgtatatacatatatgcatggaatctcaaaattagtgaaaacaaataccatgaatttggaagagagaaagaaggtatattacattgtttggagggaggaaagcaaagagggagattatgtaattatttaatcataaatatgaaacaaaacaaaacaatgtaaacagatttttcccaggaaacatttacatacagagcagtggcattgcacacaggattttaccctcagtcgggtggggaatccttgtatcatctataggttacttttgaaagtattaaagtattagaaacaagtttttaggatcagttattctaaattaacatttttatattcaagaaaatcgaggctcactgaagccaaagccatacgacaaatttaaaccccgtctagagcaaaaccaccacagttgtgcaatttaccaaaagtttcaatatcaactcagggggaagcattgtatgtgtaatgtaagagtgtaaactaacatcttaggaaaaggatgcaataacagttcagaaacaattggtttcagggtagttcataagctacattcctgagaataatcctgactgatttaatcctgctcttatctgcattgacttgaattttaatctttaatgttcagttttataatgtttaactacatgtaagtgtgtgtgtttgcatgtggcaatgaatataagtgtaagtacctgcagagaccagaggcttctgttatcctagatgcagacttacagatggctacctgactagagtgctggtagctgaacttgggtcctctaggcgagcagcaatagctcttaacttttgaaatatttaggtagccacccaagttttaattttagtagggtataattcttgagaatataattattctaaataagaaaactatgtaatatattttagatatttttactatatatatacatatatatatatatatattagagttcttttggataatattaaaagggtaacagtttatcaaaccaatttaaaacaagtcattttttggggggaaaaacttttgattcaacttctctttaatatattaatgctctcctactttatccatctatcccagaatgtctagactatacctggattcctctattcctctatattattatggattttagtgtcctcaagttttatttgtctaccacttagatatttcacatcatggtaaacaatgtctgtttctacaggtatatatgagaaagaagtggggagaacctatggataagtaaattttgggatatatattttttttccattttttattaggtatttagctcatttacatttccaatgctataccaaaagtcccccatacccacccacccccactcccctgcccacccactccccctttttggccctggtgttcccctgtactggggcatatgaagtttgcaagtccaatgggcctctctttgcagtgatggccgactaggccatcttttgatatatatgaagctagagtcaagagctccggggtactggttagttcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgtttagcaaattgtatcttatatcttgggtatcctaggtttggggctaatatccacttatcagtgagtacatattgtgtgagtttctttgtgaatgtgttacctcactcaggatggtgccctccaggtccatccatttggctaggaatttcataaattcattctttttaatagctgagtagtactccattgtgtagatgtaccacattttctgtatccattcctctgttgaggggcatctgggttctttccagcttctggctattataaataaggttgctatgaacatagtggagcatgtgtccttcttaccagttgggacatcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatccacacaagcatctgctgtcacctgaatttttgatcttagacattctgactggtgtgaggtggaatctcagggttgttttgatttgcatttccctgatgattaaggatgttgaacattttttcaggtgcttctctgccatttggtattcctcaggtgagaattctttgtccagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttgaagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttaagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaactgctctgtagtaaagctttaggtctggcatggtgattccgccagaagttcttatatcctcgagaagactttttgctatcctaggttttttgttattccagacgaatttgcaaattgctccttccaattcgttgaagaattgagttggaattttgatggggattgcattgaatctgtagattgcttgtggcaagatagccatttttacaatgttgatcctgccaatccatgagcatgggagatctttccatcttctgagatcttctttaatttctttcttcagagatttgaagtttttatcatacagatctttcacttccttagttagagtcacgccaagatattttatattatttgtgacaattgagaagggtgttgtttccctaatttctttctcagcctgtttattctttgtatagagaaaggccattgacttgtttgagtttattttatatccagctacttcaccaaagctgtttatcaggtttaggagttctctggtagaatttttaggatcacttatacatactatcatatcatctgcaaaaagtgatattttggcttcctcttttccaatttgtatccccttgatctccttttgttgtcgaattgctctggctaatacttcaagtactatgttgaaaaggtagggagaaagtgggcagccttgtctagtccctgactttagtgggattgcttccagcttctctccatttactttgatgttggctactggtttgctgtatattgcttttatcatgtttaggtatgggccttgaattcctgatctttccaaaacttttatcaagaatgggtgttggatcttctcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcaagaattttattgaggatttttgcatcgatattcataagagaaattggttctgaagttctctatctttactgggtctttctgtggtttaggtatcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttactgtttttaatattcctatctttatttagtgcatttgttgttcctgattattatgtgtcgggaggaattttcttttctggtccagtctatttggagtctctgtaggcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtgttctgttgctgatgctcgcatctatggttccagatctctttcctagggtttctatctccagcgttgcctcgctttgggttttctttattgtgtctacttccccttttagttctagtatggttttgttcatttccatcacctgtttggatgtgttttcctgtttttcttttatgatttctccctgtttggctgtgttttcctgcttttttttaagggcctgtaactctttagcagtgctctcctataattctttaagtgacttatgaaagtccttcttgatgtcctctatcatcatcatgagaaatgtttttaaatatgtgtctagattttcggttgtgttggggtgcccaggactaggtagggtgggagtgctgcgttctgacgatggtgagtggtcttgatttctgttagtaggattcttatgtttgcctttcgccatctggtaatctctgaacctagctgttttagttgtcactgttaagagcttgttcttcaggtgactctgttagcctctataagcagacctggagggtagcactctccttagtttcagtgggcagagtattctctgcaggcaagctctcttcttgcagggcaggtacccagatatctggtgttcgaaccagactcctggcagaagttgtgttccactcactagaggtcttaggatcccgtgtggaatcctgtgtgggcccttgcaggtgtcaggcgactcagctggcaaggtagcccggagctcgagtggagcagaaggggtttgtgccctacatcaagcccgggtagcctgcttccctatgtactgcagtctcaggttccgcgagattggattggggcaggcgctgtgttccactcaccagaggtcttaggatcccgtggggagtcctgtgtgggcccttgagggtgttgggcaagactctgctggcaaggtagcccggggctcgagtcgggatatatcttaagtacttttactacttatttgaattcgatttcctttcaatgaataatcttttttaacttttatttttctacttgcatattacattctaactggttctcccttcctccannnnnnnnnnnnnnnnnnnntgggccagtcccacaagttctgtgccacagttgcccctgccaagtatttgcaggagaggcagattgcatctgaagatttcgtggctgcgttgatgggctccatattccttcttactaggagtctttgctaggattgccttaatagatttaaaggagtttccactaccctaagtttctacatcataccctgcagacaaatatacacccatgttctctctcagtactctctctctctctctctctctctctctctctctctctctctctctctctttctctgtgtgtgtgtgtgtgtgtgtgtgtgtctttgtgttcctcccacccttaacctaattactcttgttcccttcctaatctgtccccaatcagttgcataacctattctacttttcccttcccaggaagagccaggcttcgggacttgagccctcatttttagttatcctatttgagtctgtggattgtaatgtaattatcctttacttaacagttaatgttcacttacaagtgagtacataccatgtttgtctttataggtctggattaactcaatcagaatgcacctgtttagttctataaatttgcctgtaaatttcatgacaatattattttaacaactgaataatactcggctgtgtaaatgtaccacaaattctttatccgttcttagggtgaggggtatctaggtcatttccagattctgactattatgaaacaggaagtgaaatgactgaactttagccatcacttgagatttaagttctgagatgattgaaaccccccttctcctacagaaaggtgaaatgtctttatttttcttctgaatatagtgtttgcaaagagctgctgatttgcatcatagcatacacattgataacactttgaaaatgaatgctatagtggtttcctgtatctgtgttcataaagcacaaaaccagattttcttggaatacttatttagggtgatccattttttcgacatacatttacaacagttcttgtgtgttgaaaacagacacaatataagtaaatataaataaaatataaaatacctcaaaataaacccccttgagaagttttgccatcaatcagcaattgggaatgaattctttaaaagaattccaatggttagtcaattgaaattcactagaactgtttaaaacataacatttgaaccatgaagaatatcttaggttggtttgctctcaagaactcagctgttttgattttccattttattatttcaaatggtgcaaaaatttcctgtatttacattttctgcaccatttatgtttcttttcaaattacagaaatatgttagaaaaatagcaaactactctttaaactatgtggtctgaaaaaatttaaccactaactggaaggcagagagctatgaattatatatttttttcttgtataaaagccagattataataggtcaagggtatagttagtgaattaatgtacaaaacatgtggggatatagttcttgataaatttgaacaccctctctatcaggagatctttgttagttcatgctctatgcaagcactagtctataaaagatgatgttttaggtttctcagctccaatttcaataaggcccacttcagtttcagggatttatgtaaaggttaattaaagtgatttcttaacctctctatgatgagtatacattgctgcgttgtaagctcctccataatatgatgttaccacagtagtgatttcctgataaatgtctaataattaagtttaatgaccaaaagaaaatatacaaatacatgtttctaataaattttctggttataaaaatgcagattataattaaaagctatatacgtatgtatgaacctatttactaaagaaataattaaatattaaccatgatatattaaatttatgttattaaaaataaactgattttcattaaatattattactttttgaaaaattcttattaattttgacaaacatttacaaaagaaaactatttcattatagtaattaatggcacaaatgtttggttcttttatttaattaaaaaaatactgagtttttctttattagatgtaccatttacagtgtgatgccatacgtgagaacacactttgaagtgtaatctacatcaatactttcttcatcactgctttaaaaatacatgaattaaacaagatgtcagccctaaatttttagcattttccaatagtcacagtagagtagattataaatccccaaggagatcttaatacataaagagtatagtaagagaaactgcacaatgtttcttccaaatacagccagaagaaactggtaatagcacaagtgtgcaaataattagaagttgtaagtcttaatatgcattactttattatttacatagctaatttaaaattttatttgtctttaattatggttgtacatgaaactgacacataaaattcttgggaattgaaattgagtttgggcttctgcaaaagaagtaattactcactattgataattatctcatcacttgcaaagcactcactacactaagaactgtcccagagtggttcttgagtttggtggcataatattcacctcatgtgcatcactataggttcagtgtacagtttgctaaaatggcttcgatttgctgaagtattgtttagtcattatttataaataacagaaaagaatgacctacttttagcaaattttgtgatatgagcaacattctaatattcaacttcttactttaaagaagtgattctgaaatgatgggtgtaaaatacccagtggagagctgtgccacaccttctaacaagatatgaacattgaacatgattcctgcaggaaataaatgtatattttcctaacttaatccaaagcttagagaaatgaaagtaaaacacttcccattgctattaaaaaaaaaaaaaaaaactgaaataagaagtcattaaaggtcattttggaatgtcaatcatgtcccagcagtgcaccttggcccattaacttctgcctcctgtccattctatcagggagtgacagggcacataagtgtccttggagcactccgtgtgtgtgtgtgtgtgtgtgtgtgtgtgtgtgtgtgtgtgtgtgtgattgtgtgtgtgtgcctgtgtgtgtgtgtgtgtgtgtgcatgtaatgtttattagggagtatttataataactttctttacttctcaattctttcccagtgaatgtcattcttatcttcagccctaccttcatgaactaaactatgtgcttgggctgaatatccaattgaaagcaaattagatgagccagcaagagtcaccttgctagtgactggggagggtttccaccacacagccagggcctcactgaagtagcatgctggctttgctgtggctcactttcacctccacaggaggatgactttgcagtttctccacagcattttgctttttatgttttcctttaatggtgtgacatcctatgacaattatcattattttgggtccaattttccctctgaagcagctttgacacagatcaatgcatctcagtgtcgttttttatggagctgcagcatcagaatctgacagctggaaatcttaattggtccagtgacagaaaatataatgactgctcacagtgacttattttatctgaccttgtgtttaattcaaaggtaaattttaatctcactattggaaatgggaaagttgtggggcgataagtgaggcagatggaccagagaaaggcccttcatttagaaggaaattactactggttgtagggctgttattaaattagtgcttaagtgctggctttgaatgatggacaccaagggtccccatgactatttgaactgccaccctttctactgtggctgtcattacaaatggcagtaggcacagaatgtagcatgggatgatggagacaagtgagtggctggaggcattatcacaaaggccaccagacagctgtcatacagactggcatttgatcattactgccttggtccagagcccagtgacactgttctagagacaaaaaagttttccatatataccctccaagttaattccatcttcctaatcctacaaaggaaactgtttctaaaataagaaccttagatttgttcacttgaacaaattaatccatgatttcaaaggtcctattaaaactttaatgtatttagttaatttaatacaatgacataccacgacaagagggtgctgtgacaagctgatcaacactatgattagatttacaggttaactgtgagtgtcacttcctggatttgtctaattaactgcatattctgagaactaagtggtagagtgtgtgtttaaatgcttggatgacttcatgatgattagaaagatgatagggtaattgtggcaaattaaatgttgtattgtatacaatattcatataggtttagtatccaaagagttgcctataacagtcttaccaatggtatttaaaagcacaaacatttatttttgaacaaatacagtaaaaacaatgccaaggttttgaattttaattttgaccccaatagtcttgaactagcaagtcaaattatatgcacacgtgcacacacacacatacatgtaataattattatatatatatataaacacatataaatttcaaagtaaatatgatattattcattatggtatactatacattctgcataaagaagataattatcatttgtaaagtacatggtttgaggaatattttcttagtgaagtaatgtaatgtcagaaaggcaaatacagtatgctctaactaatataatgacccctaagcagtgaaactactcgagttaaagaacacattggcatgacgtggggctgccctttatgggaatgaggaggtaatgcagaatgaatagaacgcttggtcctgacaggaagaaaatgtttccaaggatgacacatataactaataaatatgtattatgcatcccaccatcactaagtaaattgctgatatgctcatcataaaactattaagtacttgagatgctcagtgtgttgattagcttcattaaattgcattatattaacaattaccacatcttgatctggagaagtggcttaagacctaagagcactgcctcgaccagcatagaggcccaggttgagctgtgatcctagcactccttgtaacctataaaaagattaatgtataacatttaacacagagaacctctgtaacataatgtggttgaaatgattaaaagaagagatgagaatcacgtagcttaatgcttaatatatttcaacatgtcaatactcctttcaaatcaacaaccccaaaagattttgataaggtttgtcatgcagtagtttagttcctgtactttccatcccaacattggaacctttaaagagaaaaggagtctgttcagaccactctggaaaatgactaatgttgggcccttgacattggtataactagtagtagtcacaaattctatgggagcaaagtgttccagggaaaaagaaaagccttagttattcttagtctcatgattcttcacacacacacacacacacgcacatgcacacacaccactcatcacttttgtatgcagcactttcattccctctagggttttatatactcagattcctcttcctgtaactgttgccatgatgtttggacaaacttgacaccataaacatggcctaaggaagctacagaaaggctactatcaagttgtttgacaaagttggctgtcaggagaatcccttgacctccagagattggctagaagcagcttgagggaactggtggcatacattttatcagctgtatatcctagaacaacaagttctctaatgttgtaagtctctgatgcatttccatggccagtctgtttccttgagataccgtgattattagaatctgtggctaattcactgactcctttaaatcaaaattgtttcattcatagaatttggcggttagctccaggatctagattgtgtttactgcttattgattcccatcattttgttgttttctattcttcctaaacagttaagaaataaaattcatttcatttattcactcatcttccccgggcaggagaatcactggaaaccaaccaaccatcaggccttggtggatcacttttcagtccactgacaaacttagctaatgtaagaaatcctagctggaatagccatggtcctttactcatcgatgctttcagacactcgctttcttaaaggaatgctcgaagctacgatcttgataaagttaagcactgagttagaggcatcatgtttctctcggtcccatagctaccgactttttttcctcatgcaaaattcaagccactcatcagagctgatcagtatacttttcgtgttcttcttagccacatattctcttctccatcaagatttctttgtagtaccaggtgaaatagaccttaccttgtgtaggaagctttccagcgtctgcctttgttcattcataaaaaaaaaaaaaaaaaaaaaaaaaaaaccaaacaaatgatgggaagtcatcaagtgagtctgtggatgggttacattaaaggaggatggcattatttctccacatgacagatgttagggtgtagctaaacacctcagttaactttcagagtataatagagtagctgtctaccttgcttgaatttcagaacacctaaaacccatgtcatgccctcaaaaccttcctatttctagaaatgaagatcatagaatcatttctgttaggagaccttttgtagtcaatggctcccttctcagaaaagattgtcagaagtatgaataaatgaacaagttcgtcagaacatctggaggcttcagaaaagtattcattttgcttcagatttctattttgctaaagaggaaacattttgtacgttgagataattttttgctgagttattcctagagtaatgaaaacttaactgctggtagtaaatggaggtaggttaagtggcaaaaatgggaggaagaaaatggaagaggaaagtgttgtaattgtgtatacacacacacacacatatataaagaaagagttaagcaaaaggaaacttttggatcaagattatattggttaaaaataaacttaaagttttcaccgtctgttttgctcatagttctaggtgttgttggtgatttgagtcccactcctcgggagggaggtaggcttgtactaaatatccaaagtcacttggaactccctgtatagtcctacttcattttaaactcctcatcctcttgcgcttaggtctctgagtgctggaattacaagtaggaaaacaacctttacacttttaatacttcatttaaaatgagcatccactagttctcactgtatacagaagccttatcagaatactgtgcaagtccctgaaagttatgtagacacaatatatttgcaaagtaagactcacccatatcatacattcaggtagtactcagatcctgttatgtagttttgtgaaaagaacactgtactgcccagagagaagtccccatccacactctctgcttctgggcttgtattctagttctacacacaatgagtgttcttgttataactggtataggcaaattgtatagcccaaggcaaatcccttagtcgcatatatcttagttcaagagagaaatctagctaattgcatttggttgtctctctctctctctctctctctctctctctctctctctctctctctctctctctctctctctcttccttttccatttttcttttaaaaactgttcactgttgaaactaattttgtggaagtaggtgttggacccagatgagttagagttaagattaaataacaaaagttaactggaactgtatgtgaaaaatcttgagtgccataatagtaatttatagccaatgaagctgtttaccattaatataaatataaaagctgatctttttccctggggaatagtctgtggttgatatatcttaccactaagagtaacataatatagtcattgatagtattgtattgcccctttcccaaatgttgggcattttggctaatttggagtacaattattaattagctcttctttgaaagtttggtagaactctgcactaaaatcatctgacactggactttttttttctttttttgagatttttaatgatggtttctctttcctaagggcttattctttaaatagttcacctgatcttgatttaacattgatacatcggaactgtctagatcaattcaatcaatttcaactaatttttccagttgtgttgactaaggtttgatgatttttaaaaaattgtcctcagttttttatatattatcttccctttcctttctgattttgttaatttggatactgtctctctgcttttagttggttccactaagggcttatttatcttgttgattttcacaaagaactagcttatgttttgttttgttttgtttattctctgtatagttatatttgtttataaatggttgatttcagtcctgagttggaatatttactatagtctactcatttttggtgtgtttatttctttttgttctagatcattcaggtatgcttttaatttgctagtatggaatctctgcaatttctttatgaaggctccgaattttcctcttattactgctttcattgtttcccataagtttgggtatactgtgtattaatttttattccaataaaaaagaaaaaaagaacaatcttttcattaaattctagaaagcctttaatacttttctttatttcttccttcagtaggttaccattgagcagagagttgttctgtttccatgactatgtgggctttcggttatttatgtagttattgaagaccaaccttagtctgtggtgatctgataggatgcatggaattatttcaatcttcttgtatatgttgaggcttgttttgtaactaattatatatggtcagttttgcagagggttccatgtgtgctgaaagaaagttatattgtcttgttttggagtgaaatgttctgaagatagctattaaatttatttggttcataatttctgttagtttcactgtgtctccatttagtttccatgtctatgacctgtccattggtgggaattggttgttgcaatctcctactagtattgtgtgaggttcaatgtaagttttgagctttactaaagtttcttttactgatgtaggtgcccttgcatttggggaatattcagaattgagacttcctcctggtggatttttcttgtgatgaatatgaagtgtcattccccatcgcctttgataactattggttgaaattctattttattccatattaggatagctactctagcatgtttcttgaaacctttaatctgtggtagtgtctctatttgtcactgagatatatttcatgtatgcatgcaacacgatgctgaatcctgtttatttatccagtcttctggcctatatttttattgggaattgaattcattaatgttcagagatagtaaagactgatgattgcttattcctgttatatttgttgctgaaggtggcattggtgtgtgtgtgtgtgtgtgtgtgtgtgtgattctcttcttttgggtttgttgtaaaatgtttagtttcttgtgttttattcggtgtaattacctttcttgttttggagttttccttccactatcctctgtagggctggattaggagaaagatattgttaaaatttggttttatcatagaatatcttggtttctccatctatggtgaatgaacgtattgctgggtatagtagcataggctggtctttgtgttctctgaggatctggatgacatctgtctcagatcttctagctttcacaatctgttgagaagtcttgtgtaattcatatgggtttgcctttattatgtcttttgcccttacatcttttaatattctttcttcattttgtccatttagtgttttgattattatgttatgagagaattttattttctgtttcaatctgtctagtgttctataggcttcttatacatttatgttgatctctttctttatgatagggaagttttctcctatgatcttgttgaagatgcttcccggccctgttaactgggaatcctcaccttttctattattcttagatttgaccttttcattgtgtcctgaatttcctggatattttgggataggagcttattgcactttgtattttctttgactgatgtgtcaatatcttctatggtaagttctatgcttgagattctctcttctctctcttgtactctgttggtgatgcttgcatttatagctactgatctctttcctaagttgtccaactccagggtcttccatttctattttctttattgtttctatctccatttttaggtcttagacaattttgttcaattccttcacctgcttgattgtactttcctatatttctttaaggattttattggtttcctctttaaggacttctacatttttccctgtgttttcttgtatttctgtaagggagttatttacatcccccttaaattcttctatcatcttcatgagatgagttcttaggtcagaatcttgcttttcaactgtgttagggtatccagtccttgctgtggtgtgagacatgggttcaaactgtgccaaattgcattagtttctgttgcttacctctcaccatctggttatctctgtgtcaactggcctatgtgattacatgccttggaggcatgtagagctctgtgacataggttagatccagaatcctaggaatcaggaagtgctctctctgattaggtgtagggtggtcctatgtgtcttgttagagcaggcatcctgtgtccctgattagggtgaaacaactgggttcctgattcgggcaaacctcctgggaggacagacaagctttgggatcaaagggcaggatctttctcagttgcaaatggggataaaaaccagaaagactgttcccttggctaaggcagatatccagtgtccctagttacagcacacctcctgtgtccctcattactagagacctcctgggagacaggcagggtgtaggatgtctgtggctatgtggcccaggttaagaagcagaccagaaggaagataatgctcactgtgtgtgtgggggggggggagctctttggatgtcccaaatgacatggttatttgagcaggagtcacacctgtgtagacctcctgggagacaggtagactgtggggtatgtgaggttatcatgtcctgctgatttggtctgagtggagaaacaatataaaaatgatattgtattgataaccaaaaataaaataaaatataatataataaaaataaattccctaaattaagtatcaaaatggataagacattttagaacaaaaagggctaattgtttgtttgcctgcttgttttattttactttgtcaatgagtaaccaagttaaatattctaaaactcagtaatttttacatatttgtgatcttgaaaaagttatgcaattcagtaaatctgtttcctcacctgtaaaattggaaaactattgtaattaaactcattgtggtgttgaaaagattaaatgcagtatataaaatattttatatgattttagtccacaagatacccccacaaaatctagcagccattgttccattattactgcagctttaatttttacctactgtgctaataatctttgcatcactggataaataatcatatgagtagtgagaactcatttttaaggtgatatataagatatgttttatagccaaagtcacaatgaacttaaattattcctttagaaaaactacagtagtcgcaaaaatgttttatcttatgctttcatgtagtggaaatattggaactaatttgtatgctttttaaatattcagtacttatagttcacataatccatttggcactctaggtttgaagcaaaagttataataaaacaagacagtacaaatggctaataatgaggcaggatagttggttcagagagtaagagtgcttgcttataactcttaggacatgggtgctagccctagaatccactactggaagacgataaatgagtcctgcaaattctcccttgacctgtaaatatatggcatgaatacagccacatgtgcatgcacactgcaccacacacacacacacacacacacacaaacacacacacagagagagagagagagagagagagagagagagagagagagagagagagagagagagagagggagcacatatggaatgagaagagacacacatagagcagcacaccttcagcttgttaggatatccgagcccacggaaatgagatggtgtttttgaacacataaatgaattttttctttaatggcaaacacttttgatgtgtttagttccatcttaaaatctgagataatttttactacattaaaacattactatgtaattagagaaaactgtaaaatcacagcctgtgaatgcaagtcacaaaacataaacaacattgacttttgtgagttcctccagtaacaatttgtttcacattttattatttcttaatgtgcaagatgctcagcaataatttttttaaaaaattatgtagtaaaatagtacaaacttaagtcaatatgattaatttactttgccacacaaataaaatggggatactgacttatttttattatagcaggaaaatacagtcctgcttgtcaatcttaaatgttacttgtagttgtaacttctgaatcatgagccacaaacaagaaaacaaagagaaagtgttgcatgaatcaggtacactcatatgctttaattacagcacattcaaagagacacagaggtgatatttttctcatgggcataatgagaatcaactgtgaaatgtggttgccaagaaatctaattggacttagactaaattaacaataaaatcatctataaagccaaagagatgacatttatccttggtctaaaatggaaaggcaatacctagattgctgaatttagctcataattgagaactgtaagttcccactttcaagattttgttaccatttttgtgaacaaacaccatactcacacagttacttacttctgttctctaatcatccattatgccaaacataaaaaacaaacaaacagaaaacaagaacaaaacaaaaataaaacaagcaaacaaacaaacaaacaaacaaaccaaaaccaccattttcagatatgcaactctaaaatcttctgagtttctcgtgttgtcattttttagcagtgactgatgcttatttttacatttttatcttactttttttttcagtgcatccgtacttttcttctctcttttggtacctcggcatctgagatgcttttggtacctcagcatccaacaatttattcttgccataacagtgttctgaagttctgagttctgagccttttctaatgcattgaatctatttcatgttgatatgtgtgcatggtgtcagagatcagtcctgttaattcttctccatataggtctctaattatcccaacaccatttccggaagagaatcttcattattctcatatgctatgttgttggcatcattgtcaaatcacagttgatacatttatttctagacttattttttttggtacctatacaatctatttttttaatttttaaagtttatttattttatgtacatgagtacattatggttctccttgaacacaccagaggagggcattgaatcctactacagatggttgtgaaccaccatgtggttgctggaaattgaactcaggatctctggaagaagaaccagtgctcttaaccgctgaatcatctctctagctcctatttttattttttataatttctctaaatattttataattctcaaagttactgtgattttaatgccttctgtttttatatcataaaatgacattataaattttgtttctcattatttaaacataaatgagaaattcttttgtatttaaatcaagctgctcaagtaattactttctaacctttgttttctgctttatcctgcatttatgagcgttagttaatagtaaaattactttagaattaccttttaaaaatatggcatgtacagttttgttagaggtgagtcctgctttttaagttttaaatgagaaaataagttatacagtttatagcttagccaaaatatctgagatgaaactagataagacatgaataggctgtcacttaaatatcaattttctagattctaggagtatttaaataaagagtattctgaacatgagtttttaaacacaacactaggtatcagctaaaaggataataacaaattgctttaatattctaagtatatttttttgttttgttttctattgtaatactttaactctgttttgcctatattggggaagcaaactcagcacaaagtctctgataacagtgccatatttcggttatggaactagattattgttgataactactgaatatcacaagtccagtgaggacattctcagaaagatgggatctgattgactattttcacggtgatacaattgtagctgagcttaaaaaaaatgatgttatcaaaaattggttggcataaaacttttctgtggctataacatgtattaataatgaatcatctgctatttatatgagcacatgaacagttgctatcaatatttaggccataattttcataagtacttctcccaagtttgtcttccctttctcatggccctttaacctcttcagctgactttgagctacagaatggaagctgcaattatttaagtttatgtttctttccttaattaattgtatcagtcactaatggatcctttatacaggctgaatttgaatttgtgtgtttcattggttaaaattacccaaccatatttcaaggttaaaagccaaggtatgtcaaactattaattctgcattgctgttgtttgaatgatgtaggtagttgaagctacatcaggagattaaattaatatctgctgtttcatagcccagatttctctatgtttaatgcatttgtgacatttgtcctcattccaggatgaggaaaactcatcagaatgagtgactgactggtcctcattaaactgatgacttccagggagacttcttttatacgcatgcattgaaatattattatcctgaagaatgactatagcaatgagaaatccataaccgaatacacaaacctccatcaatcaaaacaacctaactatttcaaggacgaaaggatacacctggaaaattatctttgttctctgacagagtaataagtctacgctactaaggtccttatgccctgagcaagattctccaatagatgctttagtttctgaaatgtacatggcgtgtgcattgactacttaggtgtgtatgctagaagacagttttaaatttttctgaattcaataatcaactcctgtgcatatgtcgtttatactaaaccaaaagttttccttaaaatttctccacagtataaaattttaattgcaaaacaatcacagtcctaaaagcatttacagaaccttaggtgggaagtaggagataatagactttgtgaagaaatgccaagggaatatatataacatacatccatgacatatgttactaatgtttttttatagagacaggatgatggcatatgatttaataatctctctgggctataactgcagactggacttatagtaattgacatttccttgctaatagcctagacacatgattgtcataattagtatatttttgttttatctcagttaatttctctacagtcaaaattttaaatgaacttatgtatttagtaaatattttagataaatttacacttttgtttcatgttttgtgactataaaattaagattccctttaaagatcataaacaatacattgaaaccagcagaaagaaagaaatgttagtcatgtatttatttattgaattcttatatgaaaattttatatgaagatatcttttgggaaaacaatatggaatttcagtgatggtttgctgattcatagaatttatcataaaccttaagagataaactattgcgaaaataacatgacttatgcctcaattgaatgagtgagattgaagacttggataatgggaccattatccaagatgtgactgacagcagaaaaagcgttatgggagcagtgttatctcagattactcaggagatagagtaactactagtctgacaatgatgacaaagggtcagggagaatgggagccagaagcagagctcaggtggacattctaggtagcaaaaagagttttctgacaacttttgtttggataccaaagaaggtgtggtgtattcgtaatcagagtatcaagtgtattatgatccattggaaaacaatcaacactaattagtattggccagtataaagtaaaaagtacccttatctatagtattgcaaaaagaatggatatttgagaagattgtgttagctctaggagtacagttacataattgagaatctgtgtgtgtaggatctacacagtccagcctagcttgggttgcatgataaggctaccctacccctcctccacagcaacacacttacatgctaataaaagcagagcttctttatcacatgcaacacacatagcgatgaagataatactgtaagaagacagtactgctctatcttaccactttatgggtcaccctttcccaatgtttacatagttagctcatccaagttaagtcacctccactaaaatggaggatctagacaacaggattttatttgagaacctaacaagaaattgtgggcattttaaatcacttagtcacatgaccactttgaaaaatatctcagatggatgcctttacaagagttgcaagggattatgaagaaaaaggacagaaaggaaaaagtttgtctcactgtgatgtatgagttttatttaaggacagtaaaatgacatggaatattttaaaataaagtaacagaattatagactataattgttgatcacacctttgttttttattttggttttgtggctggctgagttcaatcagggcaacctttgtggaatttatggacttttgtggaaatgtccattggagttcgattaactcaacagtgggttatcattactcaatcattactgaagagaatgattgtctcatcaatccttaatgacaatagcttctctgagcatgtccatgacacagcaacctcttccaaccaaaacctgaaagatggtttcctccatcttttgaaggctttgtttgggcaagtgtatctgctatgtttttacaagtactagggtcatgctatatccataaggtagtatttcaaaggatatactcccatacagatcacccttacatccactccaatgttcaggagcacagcataagaagtgggaagaatgtttagaaacaattcctttgattctcctacaactctccttttatgaacagaaactgagctctgactcaagtgtgtgtcttaacaccaaccattaattttcccagtagattcaaagagatgttctgtagtttcacttggtcaattaccaacaagatgaattaagttttaaagtaagaaaaagttaaaatccaaattaaaatttcaaaatcactgcatgctctccatgatataaaacattattgtgaaattatctacaacaagtatttccccagctatcaggatattgtatggtaccaccattttcttacattagcaaatgaaggagaaaaatattcaatgaaacagttcttttactgaaatcccaaaatgtaatttgcttttacttttagatatatattttaatcttctttctgttcagtgttcttttctcaaatatttggctaaagttttaaaaagtattgaaaccaactatagtttaaatgtctccatcttattctgcttcattctccaacctatttttccacatcccataagctcatctcattcttgtctgtaggtcacaacacagatacttatttttccatatacaggctgacaaaataacaacaacatacccccaagaaaaatatatacccaacaaaaactaaaaattatgtttgttgtatgtattaaattatcatactgtgaacaagcacacagtgcccccatatgaaaaatatcacaaatcattttcatttcattatttttcacccttgctaccagctattttttcagacagtttgctatagaaggcaaagcacatgtgtaactttgcctcagttagaagaaatgtactgtccatcttgctttagatttgatgcgttaccaatttgtgagagtttcatttcaatttcattacttggcaagcagaatgaattgacagagaaagcaatcaacacatgatgcacacacgggaagctataatccagaatggtggttgcttctgtcaacacaaccaattaccaaaggtactcactcggaaggtgagtgatagcctagtaagtcacgtggtgctgtgaagcacatcctgcatactggtaatgaattcatagttgacaaagagtgacagtctgcctgtcagtgtcaaattccaggttcattcctgtctccattgagttctcaatgaaaacacaaatgtttgtggtaaagcaagagcttattgttgaagatagtagtgtgtgtgtgtgtaagaaagttagagacagagagataaagacctggaaaactccagagattaaaaaaaaaaaaaaaaaagactggttttataatgatatgagcctacaaaagacacagcaggaaaacttttcttttttcttttttttttaatctaatctttcccactgtatggattgcatactgtgctggagaatgagtgttaaaaagacaagtctgactctgactcctaggagatcattgatctatactttgaaaataacaaacactcagtcactttttaaaaacaactattcattcctacaaatagatgctcttttctaagtaatgcaatataaaattaatgaaatatacatgatccttgtcttcatggaatacatagtttggtaaaacaagaagcaaactgagaaatatgaactgttgttgtatgagacagagagagtggaggaccttatagctgtgttccaggtattgagagagtgaaaatattaggaaggaatgactggtaaaccaagtatcaacctataagtccttgttagctagagaaactgggtttcagcgcttcctactcaagtaaaaagatgatagaaaagagcttcatacattttagacatttagaatttctttagggctgtatgtattatgcagttgggtttgggaagactatagaaaacttttgtgctaaagaagtaaacatagataagtcacttttggtacagcaatgaagtttttcctagtcagtgctgacagaataatggcatgacctatctagataagacactgtaaattctagtagaagattttgaggatgacatagaaggacttgcagattctgagtatattatgatcttaaaataattaagaagaacataaaggtagaggtaaatatctaaagtacttgatgacatatttatagaaaatgcaacttaaattttactctgcatcttttagaaagggctaccctctggattggacattgagtgataatgtagctagcataagacctagcttcaagcttgcaatggggaaatctgctcatgctctggatagttgatgtgggtttaccaggtagtaatattctgcttgacataaattcctgcttctgttacaggataagggtcttgatttgtttaatttgctcagacttacaggtagcaggggaaaaactttgaatacctgaaacaggagcaatgtgaaccagcagttgaagaaagcaggttttattgagggtaatgattcacatattcacacaagataaaatgaccctctgcaaagcagaaaggggattcagagagccaaaaactccaggcacttctggtgagcttacttttttcttcctctcttaatttagggctggtaagtttgatgaaagctgggatgcttgattggcccacactgttgtgtgtcatatcctgagcaagcatagaacttgtttaatttgtcaatcagcagtgattggggtactggttgaaaacaaagctaacaaaatctttattttatgttgcaagaccctttactccagtcaggagggtaaggaagaagccaaacatgttggatattgaccacctttattacataaccatggcctatcaccctgtctgcctaaaagagaatgtgtaactcctagtgtctctcaaaaaatatgaaatgatttcagtgagaaccatagctcacttcacctttatatcatgatcagagggtggcctgagacattgaaagttgggacatcaatttgatatgcaaaaagaatcaaatttgaaatcagcggtttgcatagtcataaaatgttcgtctatatcaaaattgaagaaagcaggatgcagaagccatttgaaatgaaaaaccaataattgtcagattgccagttaacacatttcccatcttagttgcataatttaaggttatatatttgaccaccagtgatctactaagaacccacatcaaagaaacaatattatcaacagtatgttcttattatgtccttggtatgtgccacactgaaatctgtgattatttaaaccaaacaagccacaaaacacatggagcattcctacagggagcagaaattgataatttagctgaggaataatattttgccagttaatgttatttaccaaaaatgtaacaaaatattgatacgctggatatttgtctgaataatctttttgtagaatatttgtgtatttttgtgtaattaaatttttagcataatcttcttatcagcaaaccatcactacatcttcttttcacaatagaggcatctttctgagtggatgtgtctacacacgttattggcaatccatgctccatacttttatcattcttactaaaagtcttttttaaaaaaattcatacaatatttactatgctggctaggtttatcctaatgtgacacaagctagagctatcgaaaagaagggagtttcaattaagaaaatgcctgcttaagattagactatacatgagccagtagacatgttttttcctgtttttctctcctcctcctcttcttgctccttcacctcctcctccaactcatcctcctcctgctcctcctagtcctcctcgtcttcctccccttttctttgttagtgatagatgggggagggcttatccctttgtgggtagtgccatcctctggatggtgtcctggattctataagaaaggaggctaagcaagccaggagaaaccagacagtcaggagcactccttcatggcctctgcatcctgcttctgggtttctacactgtctaagttcctattctgacttctttctgtgggcaactatgatttgaaagtgtagtccaaataaactctttcctcctcaaccttcttttgatcatggtgttttatcacagcactagtaatcctaaacaggtcatataacttttcatattataagtattttaataacaaatatccttatagcagtatctatgcacatatattatttgttacaggagtttagtttccaaaagtgttttaaatatgtcttgatacataatgaaaattactttctagatttttgtgttttaactgtttagaagtgttttattcattgagctgatatatgtatctgtgcacatgccactagaatgtggaaatcagatgataacaagcaggaagtagttcttgcctcccatccagcagttattagggattgaacaggtccatagatttggtgggagaacacataactgcctgaaccatctaaccagccctacattttaattgtacagataagtctaaaatggtgtgtgacatgtctgacatttctagttgctgcaccttttactgtctggctcatgtttattgccaggaggcttctgtcagacatcagctgaacactgacacagccaggaacaactgccttcattcaaataggttcaatattgctctcaattttttgtctctatgaatagcttctacattcagggcatgttgtatagccccaactgtactatcgccttaacttccaacttttcaacttctaccttcaatgcacaggtaaaaaacaaatgcattataacagttgttgattagccactataaagagaggaggaccgtgcacaaagcttccattacttgagtatataaatttcactctctaagtttttttttaatataaaaaaaattaaaagcagcagaatacttccactttctttcctttacttaactcccaaattgaagtctaggatggctgccaatgatattatatcatcccatatgttttgcttaattatactatttcctgatttcaatttttgaagttaagtttttttccacctcatcatcaaaacattatgaacactctttgtcacactgagattagaagataaaacatcttttaaagttgtatctatttgaaatatttctagagttttggaaagataacgacttaacactctgatcatttaaatctatgctgcaaatcacaaagtatcagaatcttatggtacatagaactgagttaatttaataggcaaacacccaatgtgttccagcaaggtttagatgtcttttcaatttgaagtacattttcaatttatagtatgataaaattcaagatattttctctaataaattgatcttgcttctatgcatggttcatgtatcagtataagaataacatctacatcatattaatacctgtattatacagaacattaagatgcatcataagtcatccagtatgccctctagggaaccttataattcttttttatttttatatctttgacaaattgttaatgatcttgagatcactggagtgtatttgtttacatatctttaaaaatacattctagatggtaaatgaaatatttgctaacaaaaattacgtcacagctttcctttttagtttaactctaccttcttttatttttaaaatgtaaagataaagtaagcagcattaatattttcaagttgtgactatacctatagattaaaaaaccacagttaatactttcaagttgtgatattttcaagttacataatgctatttgaatttattaatagatttttctctttaaatattctacaccttctctactggtttggtatataacctacttccctgtatataccttaaattcctttccatcatttatcttctcaagtaactctttctatttgcataactatgaataccaagaaaggagagtaaggatagtgacaatggcactgaaacctcttagcaataaagtgtgaaagaatgtaagaaaaaaaatgggattaaagaacctactcagcaatctcaagactaaagattcttggaagtgagtgttttaatcaacttggggaaaataggagcaacacacacacacacacacacacacacacacacacacacacacacacatacgtgtgtgtgtgtgtgtgtgtgtgtgtgtgtgtgtgtgtttatattatcctattatataaccacctcctgaatggctctagatgttgagaataggacagcctttaagcaccgtgtgaataaaaagggtttctaacataaattgatttgaggcagaagaaatctcatcttaagttcaaggaattcacacttaaatcaacatttcagaaattattaaccatttgaaaaaaacacaaataaaacgctagactaccaaacttcaaaaagtattagtaatatcataaagaataaaaccatccatgatctcttgaagccccacaaatgatctttgatatccaatagctgatgattctttttcttctttctcttttcctctttctcctcgtccttcttcttcctccttctgctacttaatcttaattcttcccctccaccactttgtgaggcagaatattttgtagtacaaattggttctttgatcatcttgcctctgattcctaagcttcaataaatattttgaaaattatataattaatatatagtcatgatttcttggattttatatttaacttcagattgttaacttttttctaattataaaggtatatgtgtgtgaaagaaagcatcttgtataggatgtgacaacaagaatacactgtgaagtactcagaaaagccaagtgactaagctaatctatgtagcatgggacttcatagagttctagacgatagcctcacactttctagcactaattataaacaagcactgtcaaatatttatttccaaatattatgcacagggagcacaatgtgaactgcaaggtatttgaattacctatgaacaaatgcctcagctacacacatcccacaacttaccatgcatcattgataaaaagcatgttgtgttgggactttttgtattcatctgtgacttatttatttatttcactacacaatatacatgtaataattagaagtaaatatagacagagatcagtctccttagcataacagttgaatgatgggtaaatgctcaaagcttttattgagaccatccaggttgatgggagatatgctgaaaaaaattagcaaggaattacatgtccccaaatcacagcttcctttgcataatctggtttgacttgtccgttaagggcaaagcacatttgagaaggggaaccatgctctgtgtttaatgtcactccttccctccacttctctcatatgttcttctgcatctccgttctgcttcatgctttccattattgtatgtaactcagtcacaaattcaaggggattctctatgaactgtagtgcatctttgggaacattggatttaggataggtaaaggaagaggtctctgggtcactataggagttcatccaattggttattttatctgaaaatattagagaaagacattgtaggcttctggagtctgctgtggaaggactgcttaagaaagcctctgtcacagagaaaaatgaaccactgactctcaaaaggaggatttatttcttaattcaccaggtcttcaactaaaagccatctcatttgtcctggctccttgaagataattcttcagtgaaggtcagttgcttggtcctgttcccttaggaagaaaaaggttactttgccaggaagattcattatctgggaaatggagagagagagagacagagagagagggagagagagagagagagagagagagagagagagagagagagagagagagagagagagagagagagagatgtgttcaccatataggctcctgggatgtgacaagggtatatttcatatttacttttatttttctcatagtcatcctatttttaaaactcccagaatcctagatgaatgatggctagaattgtctcatggttattggacattatcttaattgggaattcctagccctccccttactgatttctcctcaagctctatgattttcattcttctctacttcatttcaatgtactctacctttgctgtcttctgactcctgtcttgccttctgctaacattttaagaaaaaaaaattaacaaacaaattttgtctctgattcagtctttcttaaagccattctgaatcccactcatactgctgcatgtctgtacagaaacatactttcgtttacatcccctaagtcatccaaagaacatgcaatcaagtcctgagaaagcccttcttaaagacagtttcatatgggagacagaaagcagagttctgatctgatctggttctgatggtttgtgacaggtattgtgtagctttcattcaatggtcattgctcctgtctttttcatcagctgtgaaatccaacttaaactctgcttatgatgtctctctttgggttttgctatctactcgaggttcagagttagagttcacatattttgaaatttaatgttctatttttgtatatggacacatactttcttcctttcctccagtgaactattatataggtgctttgctgtcttttttttttcaggctcttacactgtatattaaattatccattacaaaaagaagtggagctgaaagatttgtagtgcaatcaaaacagagcttattcttaatgtgtcaatattcatttccactttctcataaatctcctacttctcttacaaaatctatttttcttacctggatattttaaagaaaaaatgctattaaatcaagtacctaaatcttacctaaactgatttgtaatggaatcatttagttccagacaagcatcaaacacggcatattatctgagaggtagcaaggcatccatctcctttatagattgaagccttcacttcttccagggctcatcccattctattgaacggactgtatgtagcagttaggagggctgtgagaagagtctaagggatatttgggttattttttttctaagacatgtctctctcacaaagctatatgctttataatgtgtctttcttctgtttttaatgacttgtgcacacatacacacaaatactaatgtgtagagtcaggtagagagtactgtagtatgtatgttattgacacctcctttccatgattggtggttagtagagtctccagaacaacaggtagccttgtttctttatctgtcataaaactcagggtgatattttatgaatacttgacaaatacttttttacttagaattgagtctagagccagtaatcatttcctagaggtgatcctctaggaaagtatgccacagagtgggtagtaaacacatcatagcatttatcaactttttcttcttctctatcctactttctggaacaataaacctacatatattttctttatctttgttagtattttaaaatactcaaaatataagtaactattacatgcaatataagaagaattgttagaatgtttttctttaacatcttatgtctttttaaatgaagtaaaattatttcaatttataacactctttctgctttccagcccttcctaacttcactctctctatacttctatgcttgtccccaccaacctgctgacactttctctgtcgacattacatgcatacatgtatacatttttatgcatgaacataaatactgcctgctgagtttctttttattttgtttttttttgttactatttttattgtattattcgtttcttattgttcttgctgctgctgctgctgctgctgctggtggtggtggtggtgtgtgtgtgtattcagggctgatctgatcattcttcaatgaacaatcagtaaggtaattgatactgtgaaaggaaattttcccaggattactaattcgttgtctggaattctttttctaaccatgtgaccttgtgaaattttcctcctttgcattaacatatctgtcgatactgccaatattctggtcttgcttattcagctattttcatgagagactaattcagaacagacttccttgtattctggttcttacaacatttctttctctttttccatggaattccctgatccacagatgtaggagctgtgatgtagttgaaatttgaggctggaatttcctatgatctattgatctctgcattttgtgtactcttggttttcatttgctctaaagagaagcttccttgatgagggtaggaaacaccaattatctatgggccaaggaatgagttttagaatgtaatgagaaattatgctgttctagtaaactatcagtaagagatttttttttttttttaggttcatgacaccactaaaccaggaaacctgactaaacatctagtagcaggcatgattttcctcctgttgagtgagccttaaattaaactagagagtgctacttcttgtaacgttgtatgtattttgctactctagacattattatagttcatagtctttctgactttggtaaaacaaaatctcaatatgattttacttgtattttattaatttctaaagatgatgaacatttttgaggtatttcttagttgattatctttttaatttttattgataaccctctgtttaaatcccaagcctatccctttaacaaaatttaatgtgctcttaagataaaaaagacctagaaagactaaaagtagagggactacacatcaatgtaataaggcctatagatgagaaacttattggcaatattctcatacgtggaaaaaaatttgaatcatcacattaaatgaaggcagggatacctactactctccttttcagtacagtactaaaagctttagctcaagcaaaatccacaagaaagaaattaaatctgtacaaataggaaaaggagttaaattatctgtacttgcatttgtataaaatacataagtaaatgatcttaaaaatttccccagaatcttctagaaacaacactttcatcaaattggtaaagatgcaaaattaacttataaaactcaatagcctgtattttcatcaacagcaaacacactaaggaagagttcatgagcattctcccacttacaattgcctcaaaatcaatatagtatcttataataaacctaagcaaggatggagaagatctctactaaaatgaaggcttaagatttcccaagtagaatattaaaaaatacaatgaaaagtagaaagatatcccatgttcatagatcagtaaaatttaatattgtagaacatcaccatgttaccaaaagcaagttacagatataattacccctgcccccccaacaatctcagagcatgttttgcagaaattaaaaacaaattaaaatttttgtggaaacaaaaaaacgtcctggaaaactaaagcaatcttcagcaaaagaatatctgaaggatggctgttacatacttcaaagtatattatagcacattaatagtagaataatatgatactcgtagaatacaggtagaaaatacacggatgcagaaataaatacaactaactacaataatctaataggggggaagacactggaggaaagagattaccttcaaaaattatagtgagaaaattggatgtctacatgcagaagagtgaaaatagttctatatctatcacattgctctgaaattagattcaagggaattaaaaatcccacaaaatttctaagataaagtataagcagtaccctataaaattcaagtgtagagaaggactttgtgaacatttaccaaggaattaatgccaacaattgaaaatggaactcatcaaattaaaaccatctttggttcagctaaataaacaatcaagtgaagaagtaacccatagaacagggttttcttgtcttttaaaacatcaattcaatgaataaagctacataccaatatttaattttaaagaaaatgagagaatttttaaacaaaatttatagaaaaaatcccaatgatagcgtccttcctttgcacttatattctactgtatactattttctcatgctgctgtttatattcaatctaccttgtaaaagacaccttgatcaccttccaaactggaaactataaataaaactactaccaatattcacaaagatgtttgaatttagcattgaattatactcctctgagtaaatttttattgactccttattttagtatttttaaggtacaataggaagtaataaattttaactccaaacacagagttcaaacattagtttcttttcacatcactcatggtcctaaaattctgcatttgtatcagttctataaccttttttcagactatattggtggagaaaatagtgataaaatatataaagtgtttaaagctgtgactaacaaaaaacttatgctctattatagggatcactatatagtatgaatgtttctatatgaatttgtactataaatgaggctggtattgctaacctggtattcttccagaacaaacaaaaaatgatatctctacatccttgctcaataactagttatgatttgttagcatgaggcagttgaacttaatatgaataatcaaagaccatatccagatactatgaagagtattatttctatgttgaatgagggtgttcagcaattgctttgggccacttgcaaacatacacttgtttaatagaggggaatgctatcatcatgaacttaggtcaaactgggatccctgtctccatattcatgtagaaactgctacaggttacttatcacagaaaatttaatctaagttataagctgtataataacatttatatactaaaggaggaggtggattaattaacaaaattaatagcaaataccaagtaagagctaaataagtatttgccattttctattaatcgctggatattcatgaagtggtgtaaataacttttaatccattgatcactgacttctcagattcccagcttgtgtagatcttagctttagagaggcaagcttaggatacactgcataactcatgagctggggatcaacagttcagaagtgtatttcgaattcagttaattcagtttaacactcacgatttagctgaacttcttgttttatttaaggagacatgtttgatgcttctgtaactgtcttgtacagctaaacactgacagaagcgtgatgtctaaattaatgccagccatactaatcaaaggttatttgctttactgtttaaacagagattattcatggcaggagctgatgtgttttgatttttcaacgtgtcagctataagatcagagcagatattttagccttgtgatgattccctataaatagaggcataaaaatcttaaatgctcattgatgtagttataaatcttcatttgggatacgttgatccaggcaaaatgaccctgagctaacattactctagaggtaacttctatttccaaactggtgaattttaattatgaacctgaaattcttggttttgagatgatcttatgtttctcctggtaatttactgggagaattttttttttaaagttagctaataattgttgctctcaataccctcttgtaagccagcttcttctactaaagttctgcttgagatcaaggaagtaagcagcaataaggccataatgaaaggcagaagggtagcaaaatgtaacaacttctattagaaggcccttcattcttgtcacttattaacaatgtactgagcctagagtaagattttgctcctcatgaattaaaacctcatttctgccgctcacaaaatgaaagctaacaaaaagttattgtcttgaaaattaataatttaagtctattttctagatatgtaaaatgagaatcacagtgatacacatattttggatgcttatctgatacaatgtttatgcttccagtacttggaaaaggaccctttgcttcccaggctattatcttattataactggatgacaaactagccatgggagaatgattaaatgtagggctgagtataaagataaagatgtcctgtcttttctcaagggggcagatgcttttctttttccttttctttctttctttctttctttctttctttctttctttctttctttctttctttctttctttctttctttctttctttctttcttttacagtgtgatgaaagatcatactatcactttgtttttggatagtttctgtacttctttcaaatgtaatgtacttactgcgggatttaaaaataatcctttaaaaagttctcctccatcaagtctctgatacattaggcttatcttctctcactgaggcttgaaaagactgccatagagactcagctggatctctagtacatatgtgctgggggtcattttccagactgtttatgttcttttggtggctcagtctctgagagctccccgggttctatgttggtcttcatgtgagatccccatgcccttcggggactttaaacctcccttcagctcttccataagagtttctaacctctgtccactgtttggttgtgggtctctgtatctgtctgagtcagctgctgagtggatcatctcggaggatagtttagttaggctcctgtctgcaattaacctgctctgtgggaaggagaatggggcagggggataaaggggacatcctctcagaggagaaaagaagggaggatgtggggagggacttttggagggggaggagcagttggatgcaatttaatacacatatgcgtacttaaaataaatatatgagtaatctactgaatcaacgttcaaattcacttaacatgatttaagtggattcaaatctcttataaatagcaagaaaatatctattaaaactatagaaaactaatgtacatagttttttatttacattggtaactggctgaaacaaatagtagtttacagtataaataacacattattgcagcctgtttatacacatgtaatgcatccctggcatttcataattagatactagacattcttagcactgtgaaataatcctgttcataaatataacctctaccaaaactttcaaattttggaaaaatattttctaattcaaaatttaattttcaaaattttcttaaatttagtttccatattgaaaacaagccatcatttacaaaaagattcaaatatgtttaaatagtatatataaacaaaaatgaacaatttctgatcccatttaaccccagactcttgcagttagcggtaacagaggcccgttggacatgcatactttacatctttacatgccccagtacaggggaacgccagggccaaaaagtgggagggggnnnnnnnnnnnnnnnnnnnnagcaaagctcagggagagaatgagaaatttgaaaggaataaagggtagaaataacaggactgctaagcattgcttattcatcttactttttttttttttagcctcatagtacattgcaatctagcaaactactagaacacagagaagtagttaacttgagtagccaaccccactagatagtttgctagccttctttttaataaccgctattatcctgaaaggtaggtgttttttgcctgcatgttatagataacacacaaaactttgggaatcattagtgaaataatcccaagaccaaataagaaactaagagacagtaaacttggaaattgactccaagttgacatatttcttgtcttgtccccagtgaaggcactagagacacacacagagagactcatggctctagctgcatatttagctggtgatggactagtcagtcatcaataggaggaaatgcccttggtcctgtgaaggttctatgccccagtataggggaatgcctggaccaggaagcaggagtgggtgggttgaggagcagggggagggggatagaaaaggggatttttagagaagaaactaggaaaggaggtaacatttgaaatgtaaataaagaaaatatttaattaaaagaataaaaataaagaaaaataagataaatctgccttattttaagtaccttcaaaaactaggtggttttaagattttggtaaatacatgatctaaatgctaagaaatatctctacatgtttatatactacctgtagcatttataaaagttactcttgtagtaattattatggatattatgatatatgtagaataaactgggttaggtacatggaaataaaagctttttctatacaactctaatacactaagcttcccctactttagtgagcatttgtttattaatgcaaaattccatgaagtgggttaatttttcactaatgagaagaatgaatcagtgaactcttagatttccttctgtatgagcgaacaagcttctcacatcatatccaannnnnnnnnnnnnnnnnnnnaggaggagaggtgaagggaaacagtattcttttttggtacccaaagacatcaaaattgtacaaaggatgtaaaacaaattaacatgactaaagtagaaacgctattacagaatacttggttctttaaaatatggacttagaccgaaatagacactgtgcagtactttgcctttcaaacattcaaaaaaaattatcaattcctaataagttcatgcaaaggtaacagcagacaaagaggatttgatggtacaactaagagactcttattgattcagcaggcacactaaattaattgggcctatttgtaaaattctgaaggatcaatctagggtgactcccagatagactggttaacagattgctattaataagctcataaaatgcaagcagcagaatatggtacctcaatagcggttgatgtcttttgaacatataatggtattgtctctctcaaccataaaactgccagcagttgatgaggtttcccactgattcctttctcctacaacgtgttcagttgggagtttgtatggtttgggaatatttaccaaaaagaatgccataaaggttttcatcatcccaagcattactaaaatgcccagccctttagcccagacaataaaaacttctgcagctggcattatcaatctattgcacatttgtagtatgcataggaatgctgtgaactcagtaaagccagatttcaatttcttatccaaaggaaatgtcacattatgaaaagacctaaaaacttaccaatgggtccagatccaaagtgcctaaagatacgtgttgcttcaacttcttccctgcctctcaaaagactcgaggtgtctaattgagaaaacagtttcgcttttcagatgaaggttaaagaagtcagccacactcggatgaaagcagatcgcttgtaggctgcctttctcgatgcatattttactatatatataaaatctgatgaagggttgaggaggtttattggggataaaatacctttatgatatgccatatttcttccttgagtcaatcatgctataatgagcacgaagcacagtaggtaaaatgaaatggaatgtttgaggccaaagaaaatctccgtggaaattagcttggcctccaaagagcctttaaaaaacaaaatgctgccagcagcaaggcagtttgactgcagatttgaaggtcagcattcgaaaggacaacacatgcaaatattacagaaatcactacaaagttactaacttacagggagaaaaatgcatcgattcaactcagtccactgtgccaattgccagtagaaatcactaatttgtttgcccattgtgttactgacatatgtgaactatggctttttaatccaaataccatcttaagtctgaagaaactgtcaatttcacagaaatagctgaccctgggtttgattctgtgtctagagcaattaccacaacttgaccccctgttaccataaatgggagagagatataaacagaaaacaacgtaaggagaaaagaacgagccatttactcactcttattatttgctcttgaagtgctagctggctgtcttataaacacaatttgaaaagggcacagggctggatccatacctcatcaactgtttcaagattttggttgagaaatcccccaaaaagtaaagaatgtcactggaaattagtgagcatcttagtatcataaaagtggaataactaattggaagtcatgaaccattcgagtctggaccatattgcttacttttctttttaagtagcattcagaggttttatcccatatgcactctatatcaatatataaaaatagatctaaaaaataaaaatgaaacaaaattaatggaaaggatatgcagtaaagtgacccattttatatgcttttattcctgcaatttcccattttatcttataactacattcagcactatattttgaaagaaataaatattgccaaatactaacctcagcatctctttggtactgataaaatgtgagtgttggttgcacactgaatcaaaccattgggtcaatagacaccgatatatatgacataataaagtagagtgcttaattagccccagtggaacttaagggctttgaaatgattaacctaaggaagcatcgtacattaaaattatggatgtgttcttcccaattaaagaaagtctgaaaagccccatctggcaggagacattttgttattattaccacatatttgtttattgcacttatatagaatttttactccaaaaagcttagagtgttgtactgagtgtttggcacatctgagatcataaaaataaaagtgagcaaagctcagggagagaatgagaaatttgaaaggaataaagggtagaaatagcaggactgctacgcattgcttattcatcttacttttttttttagtctcatagtacattgcaatctagcaaactactagaacacagagaagtagttaacttgagtagccagccccactagatagtttgctagccttctttttaataaccgctattatcctgaaaggtaggtgttttttgcctgcatgttatagataacacacaaaactttgggaatcattagtgaaataatccaagaccaaataagaaactaagagacagtaaacttggaaattgactccaagttgacatatttcttgtcttgtccccagtgaaggcactagagaaagtacccaaggagctgaaggtgtttgcagccccctaggaggaacaacaatatcaactaaccagtaaccgcaaagctccctagactaaaccaccaatcaaagaaaacacacagagagactcatggctctagctgcatatttagctggtgatggactagtcagtcatcaataggaggaaatgcccttggtcctgtgaaggttctatgccccagtataggggaatgcctggaccaggaagcaggagtgggtgggttgaggagcagggggagggggatagaataggggatttttagagaagaaactaggaaaggaggtaacatttgaaatgtaaataaagaaaatatttaattaaaagaataaaaataaagaaaaataagataaatctgccttattttaagtaccttcaaaaactaggtggttttaagattttggtaaatacatgatctaaatgctaagaaatatctctacatgtttatatactacctgtagcatttataaatttactcttgtagtaattattatggatattatgatatatgtagaataaactgggttaggtacgtggaaataaaagctttttctatacaactctaatacannnnnnnnnnnnnnnnnnnntttgaaatgtaaataaagaaaatatttaattaaaagaataaaaataaagaaaaataagataaatctgccttattttaagtaccttccaaaaactaggtggttttaagattttggtaaatacatgatctaaatgctaagaaatatctctacatgtttatatactacctgtagcatttataaaagttactcttgtagtaattattatggatattatgatatatgtagaataaactgggttaggtacatggaaataaaagctttttctatacaactctaatacactaagcttcccctactttagtgagcatttgtttattaatgcaaaattccatgaagtgggttaatttttcactaatgagaagaatgaatcagtgaactcttagatttccttctgtatgagcgaacaagcttctcacatcatatccaagtggctgaggtgcaaatctattgtccacaggagcgtacattagtcacctgtcacagtgaagtccacctgttgaagttaattcccggttcttcctcccagccccatcctttcagaaataagattcagattcaaaatatatttacacataccttcttcatatagctaagatttactctgactggatcatatctaaaataatccaattattttatcatacatttttccagttggctggttacttatgcccaggtaccatgtgtctgccttatcacatctttatggtggacctggctctatcccagaaacctttctcctcccacatatcccaccttcatttcctgactaacccaaagcccaggctttttaattgacagatgattcatctattaataagtatcatgttctctgtatgtctacctctacttctgaagacaacttgaagtgtcttgctaaatatttctactgttatacttgtgaaatatgagttaatcaaatgcatttttaatggtggggtcaatatttggaatatatgtccagtgatcaaaatgattgtactgaatttgggaacttttcattattggcttgcttttgcctgagaatttatagaatgtatttaaaagtgtcccatagaaatgcagtagggtataaattatccatagagttatatcatttcaaaaatacaataaatatgcacaagtggatcccattttttaagaaccccttgtaatggtaaaaaggaaataatgaccaaaaatatcctaagttcaatatccatagataggaaatgtcaacctgaacgacaagaatcaagaattaagaagtttgttacttcaaagggtttaaaagattgattctataagactctaagtatacttgcaagatgattctcttatagcttaatatagttacaacaatttaaattcttaatgtagcaagcgtgagtttcaatcctagctttgctattgcaggcatataattttcaaaaattagtaatctaaattattttatttacctatccaatagggttaataatagtatgataaaattgaaaaagaacacatacacaagaattagtacaattttcagtacttaccaaggatattactataattattgataatattcttagaaacagtattatttctgtgttgtttgatttttaccacctcttttactcaacttttgtctaaaattttctgctctttagctataatccctgcagtatcaccccactacgaaccaaaatcatctctatgtaatttacttaaatacatcattattaaaattttaaaaaccttcaataaactgatttattaggtaagatatgttaacaaaagcacaggttttgaaaagaaaagaaatagttgggacaacacatttacaagaaaaagaaaacaaagaataaaaacaacaagaaaatcaaacaactgaaaagtacctggaaagaaggctcagttgttaagagcactttctctccttacagaggcccctgggttcatttaccatcacccacaggactgattataatgttatataacatcagggcattcaatacattcttctggcctctgtggaatgaggcaggcaaacagcgtacttacataaatgaaggcaaaactattggaatattaaaaaattaaaagtattaaaaaatattttagttaaaaaataatatgctatgtacagaatgaggtaaatatctagaaattatatatgttgatatggttgatatccaaaataagtaaggatatcattaaactcaagtgcaaaattacacatatagcattacacatatatctatatcatctatatcatatcatctatatcatatcatctatatcatctataccatctatatcatctatatcatttatatctatatccatatccatatcaatatccctatctatctatatatatatatatatatatatatatatatatatatatatatatatattacatgcatatatgtatacacacacatataccatatatacatacacatatatgagcctcatcataattagttaacagaaaatggaaattaaaacataccttgcacttgacaataatcatttttttataaaaatgagtcttacaaggttatggagaaatataagcatgtatgtacttggtagaaatataaaccaggaaagtttatacaaaactttatgcaggttcctcaaaaattaaaaaataatagctggagatagcactccaaagttaatagtatgtgtgaggccctggttcaatctctgtatgacaataaaaataaataaaaattacaaataatatgagctctggtaaaatcacttctgagtactatttcttttatatatttttattcactttctaccaagatcacagtgctgcctcccttctcttcttccagtcccactcttccaacccctgccccattgccccacccattcttctcagaagaggggaacctccccttggctaccaccccatctagatatctagtcccagcagaactatgtgcatcttcttcatctgaggcccaaccaagcagtccaggtaggaggaggggatgcaatggcaagggtcagagactgagacagccctcactctacttgttctaaatgaagagcaagctgcacatttgctacaagtgtgtagggggtctagatccagttcctgcatgcttcttggatggtggtccagattctctgagcttccatgagtccaggttagttgactctgtaggtctccttttgttgtccttgatttgtttggcttgtttacttttgtctgcctcttttctccaagactccacaaagtccacctgtctttgcctctgggtctctacatctgcctacatctgctgctgcatgaaacctctcaggagacagttatgttaggttcctgtctgcaagcatagcagagtaacattaatagtgtcagaggttgtctctcccacatggaatgaatctcaagtttgaggagtcaatggttggccatttcctcagtctctgctccatttttaaccctgcatgtgttagataggcaagaaaatttggggtcaaaggttgtatggatggaatgatgccccctctctccaccagaagtcatgcctggccacagggctctctatatctccctctagtagagacgtgagaatattaacctgagtgagttagcccagagagagaaagagacttatggcatgtacttacttctaagtaaacattaatggtaaagttcaggataaccatgctaaaattcactgacctaaagaaactgggtgataacaaggttccaagggaagatacatgaatcttcctcttgagtgaaaactaaataatcatcagaggtgggtgggaaaatgtcactgagtgggagaagggatggtgatcaggtatgcggaatatatagacaggagagggagaggtgtgaaaatggaaatctgtggtgccatctttagtgactagctagaagcctgggacaggaaatgataagtggagtctatggggtgaccgctgccacttctgagttcttattcaaagaaatttaaatcgcagtctcaaaataaaaatgtatgcattgcaacataatagttgtgaggtggaatcaagctaattgtctgattgaatagaatttaggaaatttgtgtgggtacatggctcatttagtatagttttggcaatacaaatatggaaaccatagtattagcatttcctctaggctttacccaatagttgaaacagccagataagtgcattgctcacttataaaaatactgttctctctctctctctctctctctctctctctctctctctctctctctctctctctctctctctnnnnnnnnnnnnnnnnnnnntagggacagacccttatccaaaacaaaaaccaaaaaccaaaaagacattctcccagttttgcaaagtaaactgtagcgttctcagtacatatccagtgtcactggttaaaagttatagataaattattttcaaatttaaaatgttgctaaggggatgaattttatcatataataattattatagttcaaatcataagtaaagaatgattgaggaaatttgaagatagtagatacatataacagtgatggtttcaaatacgtacaacatttcttttttaaacttaaaaaagagtatttagtttgtaacataccttgtttcatttttacactgataactagcacagttaagtcacagaaatgaaacattttccttatggatacaaaggtattgatgcagctatatatgatggaaaactgactagaaaaaaatatttattcctactcttttctctgacacacagctttaatttctactttatattgtttctttagaaatgtctcacttccctgacctccattttttatgtatgtgggcatacttgaaaatatttcaagtcatagtcatatgactccattgcttgtgggcaattgaaaatgcaggagcattttggaagaaagctgaaagtgactgaagtgactgatgacagccagaaagcccaaaaactagatgagaaagtagacaagaagggataaccataaaaggcacagccctctgacccgtatatcctgctccaccctgcctattttgcctatacagctaagagttcatcaatggatgtactcagcagttctcaactaatgagtcatgattcctttacagatctaacgactttcacaggggttacatatcgaatatattatgtatcatatatttacatcatgatgcataacagtaataaatttacagttcaaaagtagcaaggtaataactttatggatgtcagtccccttacatgaggagctgtattgaagaactgcagcactaagatagttgagaaccactggattaactcatctaataactctcaatagcatcactgtctgaaaagaagaacgtcaacacacaaatcttctgaggaagtttcagttatataatactgggctccaggaaattatattttcagtgagtcctcaggtgaggctaacactgctgaatctgatatactatttaaggactgcttgtgtatcaatacacagaaacacacacacacacacacacacacacacacacacacacacacacacacagagagagagagagagagagagagagagagagagagagagttcaccctgaactctttatcttagaaaatgttggtttagttagaaaaagagtgaagttataagaaaatccttcagaagccaggtgtggtggcgcatgcttttaatcccagcattcgggaggcagaggcaggtggatttctgagttcgaggccagcctggtctacaaagtgagttccaggacagccagggctacacagagaaaccctgtctcgaaagaaaaaaaaaaaaaaggaagaaaaaagaaaaaaaaaaagaaaatccttcagatatttcttcacttttggttttctgaacaagttcacaattgaggatagggagcagaaaaagagactctcatcttacatctaaaaacaacttcagatacgacttgtctgttcatgtccttcaggtgtcctgactcatttatttaaaagataaaatgaagactttattggtctatggttgaatgccaaaggcccagggctcgagactcagcatctcacaaataagaatgagaaacatagtataaatctagttccatggagaatattttggtaagagttggtgtcaacacataaaacatatgccccagtacaggggaatgccaggtccaggaagcaggagtgggtgggttgggaacagggtggggggagggtatacggcgccttggggataacatttgaaatgtaaatgaagaaaatatataataaaaattgaaaaaatcccatgagaatgttatagaaacatgaccgtaaaaagtagttccatgttattattaattaaataattagtatttcttaaaaagtaattttatcttctgaagtatagtgaggctgataggccttgtttaaaaggataaaataaatagttgagtagatatagtgcctgtagcaattatccttctcaaactttttgtgagattttcccacagctttaattaatacctacctcaacatacatttaaatctggatttaaaaaaattgcctgtatacaaatggttttaatttttaattatatttactcatttcttgggaagggtacatgtcacagcgagaatgtggaggtcagaaaaccacttgtaggagtcacatggcttactctatcatgggtcctacatatcaaactcatttggccaggcttgtcaacaagtgcctttatcataggagccatcatattattcatgtccagatggcttttaagggagatgctgttgctattaatttcactttaatattactttatgacacactatctatcttgatattaagttgaattttaaataccagtctgttacaacttaataaatgaatggatattgtacctgtcaaatacctattggtaaagaattagtatgtatacatttgcaattatgtaatttatttctaactcatatgtatgggtacacatatacatatgtaaatatgagcattaaataaatttgctttgaattccactatgcaagtgtgacagggaatcaatagaatataggcatgctttatgtgtctttctgaattctttctcaatgaagaccacaaaatcagaatgcataattccatctttgaagaggcatctttgaatttgtaagtcaaatctgacatttagggataagctgccagtacagtgtttgttcaagtcaagtgatgattcagtgtctactatagtagtaatagatatagtagttgtagtttaattaattaaggtcataataattttgataaggcatgtaaacatttataatttcaatggatactcataaaatttatcataatcatcattcttgccaaagaaattaaatattccaggtaattaaatacaataagttaatccagtagttatagaaaacaatctacatttgtcacacagtttacttagtttgcattagttcatttagaaatatatggtttcattacagaatgttttttagcttttctatgccccagtatagaggaatgccaggaccagtaacgggagtgggtagactggggagaagggggagggggaggggaaactaggaaagggtataacatttgaaatgtaaataaagaaaatatctaagaaaacacagactaaaaaatgttttaatcactttttacagttcagtcatttatctcctcccagtccacactcgggctgtttcttttcccaaactttgtccctcctcatctccaagaggatgtcccctttccaccacccccacctcaccagatctccccaccccctgggtcacaagtctcttgagggttaggagcatcttctctcattgaggccataccaggcagtcctctgctgcatatgtgtcaggggcctctcatcagctggtgtatgctgcctggttggtggctcagtgtgagagcaatctcaggggtccaggctaattgagactgctgatcttcccatggagcccccttttccttcaagttcttccagcttttctctaattctaccacaagggtgtcggcttctgtttactggttgggtgtaagtatctgcatctgactttttcagccccttgttgggcctcttggcaggcagtcatgctaggctactgtctgtaagcatgccatagcaacaataatgtcaggacttggagtctcttcttgagctggatcctaatttgggcctgtcgctggactttcttttcttcagtctcttcttttctgttcctgcagttcttttagacagaaacaattctgggtcagagtttttgactgtgggaaggcaaccccatccttccacttgatgcactgtctttctcttggaggtgaactctacaaattccctctccccactgtagggcctttcctctaaggtccatttctttaagtcatgagattctttcacctcccaggtctctggtacattctagatagtatgcccctgtctacatcccgaggttgcctgtttccattctttctgtgggccctcggggcttcagtcctgccccactcccccaggtccctatctcccactgaccgcatgattgctttcttctccctcccaagtaggattgaggcatccacacttggcccctttggcttgttaaccttcttgataactccaatgtctcaggctctaagataaagaattgataaatgggaccacatgaaactgaaaagcttctgtacaggaaaggacataatcaataggacactttggcaacatacaaattgagagaaaaaaaaactacactaacctcacatctgatagaggggcaatatccaaaatatataaagaactcaagaagctaagcaacaaaaatcaacccaatcaaaaaaaggggtggggtgggggtatagacctaaacagagaattcacaacagaggaattttgaaggactgagaagcacttaaagaaatgttcaaaatccttactgatctgaaaatgaaaatcaaaacaaccatgggattccactttacaccaattagaatagctaaaataaaaatctcaggtgacagcgcatgttggtgaagatgtggagaaagagaaatactcctctactgctgttgggattgcaaactagtacaaccactatgaaaatcaatctagagggtcctcagaaatttggaaatagatctacctgatgacccagctataccaatcttgggcatatacccagaagacacccctccatgccacaggggcatatgttccactttgttcatagcagccttaattgtgatagccaggagctggaaacaacccagatgcaccacaacagaagaatggatacagaaaatgtggtacatctacacaattcaatactgctcagctattaagaataagagcatcatgagttttccagacaaattgatggaactagaaaatatcttcttgagtgaggtaactcagacccaaaatgacatgcatggtatgtactcagtaatcagtggatattagcaaaaacgtacagaatatccagaactcaagaaggatattttaaaataaatctgatatcctatgaagtgaatttagatgtgatgttcaataatcttacaggtcctgatttagcctaactctagtcactgcactttcagagtgctttgtgtcttacaaactcttaagaattgcatcagaatttcataattattcaccatacagaattcacaacccctgtagtagatacatattacattaaataattatttatttttagataagtactcaattcattatgatcatcttgaactatatctagcccatacacagtaatgctaaatgtattgtataaataataacaactaaaatttccccacactttgataagctcctgaaatggtcatattactcctggatgacagcaattctgcccaagaatgaaatcctcctttattatctgttcttttttaaagatttctgattgttttgtaatgctttgttttctcaataaactttcagaagattatgccagattttctaataaaaggaaaaacaataagagcaaaaaggaaggaggaaaggaaggataagggaaagaactctaatctgtaggagatcctgttatataaaatgacagaaaggaagattgaagtgacaaagatataagttaagaatttgaaaatggagtccaaattgtccacctcctgtagctaggaaaggcttccaatagaggtttggggacaccaaccaacccacaaaacattctatttannnnnnnnnnnnnnnnnnnnttctttctctctctcccgctctctctttctccgacccacacatgtttctgactggcctcttcccttctttctctctcctttctccttacggtctttctctgtcccttcttactctactcccttccccaaagcccctttcccatgtcacaaataaactttattttatactagaccagttttatggtcttatggctgaaacctcaggcaagggatgtcttagcatgggtctgctaaggaactacctcctgccacgtcatgctgccacattacaaaacatatcagtatggaaccccaaacccacaagaaagtctgggcatggcaactcatatctgtattcccagcactgggaagtgaatacaggatatactccctggagcacaaagctcagggtgtctagtcagtctgtgagcaccaagtttagggacagaccttatcaaaacaaaaacaaaaacaaaaacagaaacaaaaacaaaaagacatctccagttttgcaaagtaaactatagattctcagtacatgtcagtgtcactggttaaaagttatagataaattattttcaaattaaaatgttgctaaggggatggattttatcatataataattattatagttcaaatcataagtaaagaatgattgaggaaatttgaagatagtagatacatacaacagtgatggtttcaaatacatacagcatttcttttttaaacttaaaaaagagtatttagtttgtaacataccttgtttcatttttacattgataactagcacagttaagtcacagaaatgaaacattttgcttatggatacaaaggtattgatgacagctatatatggaaaactgactagaaaaaatatttattcctactcctttctctgacacacagctttaatttctactttatattgtttctttagaaatgtctcacttccctgacctccatattttatgtatgtggacatatttgaaaatatttcatgtcatagtcatatgactccattgcttgtgggcaattgaaaatgcaggagcattttggaagaaagctgaaagtgactgaagtgactggtgacagccagaaagcccaaaaactacatgagaaaatagacaaaaagggataaccataaaaggcacagccctctgacccttatatcctgctccaccctgcctaatttgcctatacagctaagagttcatcaatggatgtactcagcagttctcaactaatgagtcatgatcccttgccagatctaacgactttcacaggggttacatatcgaatatattatgtatcatatatttacatgatgatgcataacagtaataaatttacagttaaaaagtagcaaggtagtaactttatggatgtcagtccccttacatgaggaactgtattgaagaactgcagcactaagatagttgagaaccactggattaactcatctaataactctcaatagcatcactgtctgaaaagaagaacttcaacacacaaatcttctgaggaagtttcagttatataatactgggctccaggaatttatattttcagtgagtcctcaggtgaggctaacactgctgaatctgatatactatttaaggactgcttgtgtatcaatacacacaaacacacacacacacacacacacacagagagagagagagagagagagagagagagagagagagagagagagagagagagagagagagacttcaccctgaactctttatcttagaaaatgttggtttagttagaagaagagtgaagttataagaaaatccttcagatatttcttcacttttggttttctgaacaagttcacaattgaggatagggagcagaaaaggagactctcatcttactaaaaacaacttcagatacgacttgtgtgttcatgctcttaggtgtccgactcatttatttaaaagataaaatgaagactttattggtctatggttgaatgccaaaggcccagggctcgagactcggcatctcacaaataagaatgagaaacatagtataaatctagttccatggagaatattttggtaagagttggtgtcaacaaataaaacatatgcccaagtacaggggaatgccaggtccaggaagcaggagtggccgggttgggaacagggtggggggagggtatacggggctttggggataacatttgaaatgtaaatgaagaaaatatataataaaattgaaaaaaaatcccatgagaatgttatagaaacatgaccgtaaaaagtagttccatgttattattaattaaataattagtatttcttaaaaagtaattttatcttctaaagtatagtgaggctgataggccttgtttaaaaggataaaataaatagttgagtagatatagtgcctgtagcaattatccttctcaaactttttgtgagattttcccacagctttaattaatacctacctcaacatatatttaaatctgaattttaaaaaaattgcctctgtacaaacggttttaatttttaattatatttactcatttcttgggaagggtacatgtcacagcgagaatgtggaggtcagaaaaccacttgtaggagtcacatggcttactctatcatgggtcctacatatcaaactcaaatggccaggcttgtcaacaagtgcctttatcataggagccatcatattactcatgtccagatggcttttaagggatatgctgttggtattaatttcactttaatattactttatgacacactatctatcttgatatcaagttgaattttaaataccagtctgttacaacttaataaatgaatggatattgtacctgtcaaatacctattggtaaagaattatgatgtatacatttgcaattatgtaatttatttctaactcatatgtatgggtacacatatacatatgtaaatatgagcattaaataaatttgctttgaattccactatgcaagtgtgacagggaatcaatagaacataggcatgctttatgtgtctttctgaattctttctcaatgaagaccacaaaatcagaatgcataattccatctttgaggaggcatctttgaatttgtaagtcaaatctgacatttagggataagctgccagtacagtgtttgttcaagtcaagtgatgattcagtgtctactatagaagtaatagatatagtagttgtagtttaattaaggtcataataattttgataaggcatgtaaacctttataatttctatggatactcataaaatttatcataatcatcttcttgccaaagaaattaaaaattccaggtaattaaatacaataatttaatccagtagttatagaaaacaatctacatttgtcacacagtttacttagtttgcattagttcatttagaaatatatggtttcattacagaatgttttttagcttttctatgccccagtatagaggaatgccagtaccagtaatgggagtgggtagattgaggatcgggggggtggggggggaagactaggaaagggtataacatttgaaatgtaaataaagaaaatatctaaggaaaaaaaaagaaaaaaagactaaaaaatgttttaatcactttttacagttcagtcattttcctcctcccagtccacactcgagctgtttcttatcccaaaccttgtccctcctcatctccaagaggatgtcccctttccaccacccccaccccaccagatctccccactccctggggccacaagtctcttgagggttaggagcatctcctctcattgaggccataccaggcagtcttctgctgcatatgagtcaggggcctctcatcagctggtgtatgctgcatggttgtggctcagtgtgagagcaatctcaggggtccaggctagttgagactgctgatcttcccatggagccccctttaccttcaagttcttccagcttttctctaattctaccacaagggtgtctgcttctgtttactggtttggtgtaagtatctgcatctgactttttcagccccttgttgggcctcttggcaggcagtcatgctaggctacagtctgtaagcatgccatagcaacaataataatgtcaggacttggagtctcttcttgagctagatcctaatttgggcccatcgctggaccttctttacttcagtctcttctcttctgttcctgcagttcttttagacagaaacaattctgggtcaggtttttgattgtgggattgcaaccccatccttccacttgatgcactgtctttctatcggaggtgaactctacaaattccctctccccactgtagggcctttcatctaaggttccttcctttaagtcatgagattctttcacctcgcaggtctatggtacattctagatagtgtgcccctgtctacatcctgaggttgcctgtttccattctttctgttggccctcggggcttcagtcctgccccacttccccaggcccctctctcccacttccctcaatgatttctttcttctccctcccaagtaggattgaggcatccacacttggccccatttggcttgttaaccttcttgataactccaatgtctcaggctctaagataaagaattgataaatgggaccacatgaaactaaaaaacttctgtacaggaaaggacataatcaataggacacttcggcaacatacaaattgagagaaaaaaaaactactctaacctcacatctgatagaggagcaatatccaaaataaataaagaactcaataagctaagcaataaaaaacaacccaatcaaaaaaaggggtggggtgggggtatagacctaaacagagaattcacaacaaaggaatcttgaaggactgagaagcacttaaagaaatgttcaaaatccttactgatctgaaaatgaaaatcagaacaaccatgggattccactttacaccaattagaatagctaagataaaaatctcaggtgacagcgcatgttggtgaagatgtggagaaagagaaatactcctctactgctgttgggattgcaaactagtacaaccactatgaaaatcaatctagagtttcctcagaaatttggaaatagatctacctgatggcccagctctaccactcttgggcatatacacagaaaacacccttccatgccacaggggcacatgttccactatgctcatagcagccttaattgtgatagccaggagctggaaacaacccagatgccccacaacagaagaatggatacataaaatgtccatctacacaattgaatactgctcagctattaagaataagagcatcatgagttttccagacaaaatgatgaaactagaaaatatcttcttgagtgaggtaactcagacccaaaagtacatgcatggtacgtactcagtaatcagtggattttagccaaaaaagtatagaatatccagaactcaagaaggatattttcaaataaatctgatatcctatgaagtgaatttagatgtgatgttcaataatcttacaggttctgcttagccaaactcaagtcactgcactttcagggtgctttgtgtcatacaaactcttaagaattgcatcagaatttcataattattcaccatacagaattcacaacccctgtagtagctacatattacatttaataattatttgtttttagataagtactccattcattatgatcatcttgaactatatctagcccatacacagtaatgctaattgtattgtataaataataacaactaaaatttccccacactttgataagctcctgaaatggtcatattactcctggatgacagcaattctgctcaagaatgaaatcctcctttattatctgttctttttaaaagatttctgattgttttgtaatgctttgtttcctcaataaactttcagaagactatgccagattttctaataaaaggcaaaacaataagagcaaaaaggaaggaggaaaggaaggataagggaaagaactctaatctgtaggagatcctgttatataaaatgacagaaaggaagattgaagtgacaaagatataagttaagaatttgaaaatggagtccaaattgtatacctcctgtagctaggaaaagcttccaatagaggttttgggacaccaaccaacccaaaaaacattctatttacaatttttcgtgccttatagatgtgcagatataaagatagagcaggtattaaggggatagacaagggatgactgatccaggtgagacctatgccctgagagttagtctactactgatactgtaaattacactgtgaatgctagacttgtagataggggcttagcataaccaatatcagaaatgcttcatgcagcaaagacacatgctgcagccaaaattagacagcttggagaatcctgtagaagagggcaggaagcatttttggaatcaaaggggtcaatgactcaaggaaacccacaaaatcaaataacctggcaccacaggagccaacaaacacttagatgctaaccagagaccctacatgggagtgacttagaatctctgcacatatataacagttgtgcagcttggtcttcaggagagactcccaccggtaggagcaggggatgcctctgactatgttatttgcctatggcatcctttctctctgcttggatgcctcatgtaacatcaataggaaaaggtatacctagtattactacaatttgtattccaagcctggttgatatccatgggaggcattcacttttctgagtagaaaggaggagaagtgaatacaggcacaggggaaagaaatgggagaaggagaaaagggaagataaactactgtcagggtgtgaagtaaattaattcagtaatcaatttaaaagaattttaaaattatcaagcttgatattactctttattctctgccatttataaattaaccaaatatttacaaatatctaacttggaagaaatgatagtagcccattgagaaattcccatcaacattaagaaagaaacaaaaccacaggggctatggagattgctcagtgaataagaatgcttctccaattacattgttatataatctctagtacccacagagaaagctaggtatggccataagtgcttgcaacccaggtgatctggaagacagggaaaggattcttcagacttgcaagctatcagtctcactccatcttcaatgagagaccctacccccaggaaaaaggcagacataaaccaggacacttgatgtctctttctggcttcctagtgtgtgcataagcacatgcaagtgtaaccagatttgtatatgccacacataattatacaaagcacacaagcataccaaaacaaaaacaaaaacaaaacaaggcaaatataaaataatggggaagacaaattccaaggaaataattcattgttggttcaaaaggtcaccacacactagtactaatccttgacatgaatgaactagtacattcattttcctctcaatagtttgattatcaatgacttttcttttgctttactatttatggaatattaaacacacagtaaatgattataagtattattacggaaataagtgttcactggaaaaaatctaaattgataaaataggacaattgcgtctgtttgtctaagtgtgtgcttattctgttgcttagggaatttccttatttactcctgtggcttctcttagctatacatttagtattatagttccatataaggaaacaacactgtgtgggcaatagacacctgaaaccctgtctttgtctctgtttctctgtttctctgtttctctgtttctctgtctctctctctctctctctctctctctctctctctctctctctctctcacacacacacacacacacacatgaacacatacacgtgcatacactgaaatgttcacactgtctctgtttttgtctgtgagtgctaagaaatacttgcaaactcctgtgctcacttcaaagttgataacttcatcaagttcttgcatgccagcaccaggatacagcatctggctgcaaagctgtttaatccccttgggagtttattggtttaaatccatgactagcaatcatataaaaatatggaaaaaccagatgtctttaaattcccgtagtatttttttttaagctggagttagtttctttccactttctcaacatttctgacaaacccaaagaaattcgtatatatttcttccttgcttcctttttgtttctctatggaagcactagggaaccagatctacaatataccaagacacctacccaattttctgacctgaaaaaatttttaaaagttactgtgctctaggcttttagctgtagcaacatttcaatcatagacaggttgacaagagaggctctcacaagcagatgttatattattttagtcttgtttctttaatgtcgactctgtatttgtgaaaatatatgaaaatagaatattgcaaaatatgttcttaattgctctgtcatattataaataattgccttttaactattgctctattttcaacattatattaattttaacattatcagacagattgtatttaccctgtaatatgagcttcaagtagttcttatgtaaatgatacagcaggattaccacttagatttagttttactttaatttttataacaatacttgtgtttattgaataatataaaccatgtaccactgataccattttacaagtatattggttagaggaagtctgtgacttcaaataatgaaatagcaaaagctgagcaatgaggagttttgttttcaatcatttgtggtataaaaacaagaaatatccagcttctctttgtccttcacatctcagacatatttatcacttcgtaaactgcaataaatttccactgaaagttttctcttaaaatattatcttcatttatctaaaaatattttattagatattttcttcatttacatttcaaatgctatcccgaaaatcccctataccctccccctccccttttccccaacccacccactcctgcttcctggccctggcattcccctgtactggggcatatgatcttcgcaagaccaagggcctctccttccattaatggcctactaggccatcctctgctacatatgcaactagagtcacaagctctgaggggtactggttagttcatattgttgttcctcctataaagttgcagacccctttagctccttgggtactttctctagctccttcattgggggccctgtgttccatccaatagatgactgtgagcttccacttctgtatttgccaagcactggcatagcctcacaagagacagctatatcagggtcctgtcagcaaaatcttgctggcatatgtaatagtgtctgggtttggtggttgtttatgggatggatccctggatgatctgagacagaaggtagttttacttttaaaatgacagagaaacctagagattaggtgacttggcaagcattcattattaggaagagatgtctggtatttaaaaccaggcaaacttatagagattaaatacttaatgcttttggtattcctaaaccttctaatagtcaaacagtacagtgtagtcagagactatggctgcctgtcctcatgccatttatctatgtatgttactctgcacagtctagttcagaccttagaaactttaaaaaaaaaaaaggcatgccaacactaaaatattaggtctttaaaaacttgaacttcattaggacctggaacatttaaaggcctcaatatttgtatctacctggttctagtttgatagtctttcctagtatgacatatttggcaaaaacaatatttcatattacttacagtagattataaatgatctacctcatttcttttaaatgtttcaaagtaccaggaaaggtattttgatgcatgtttggtatcatttctttcaatttgcaaagacaatgctcattttctacatgggtaggtctcacaaaaactcaagacctgccctatttggagtgtgctgcgcccattccatttgtaggaagcccttgacactttaatcactgctgctgagaaaaggatattggagtgtctttgttagtaagattgtacactgataataaaatggaagtgtatttctatgtatgactgaagtgtattctagtcaatatttgttattctaatatttaatatttctaactctgctagatacataagttagaaaccaatctgttttcttgtttccattaccaggaaactatgctccattgaaaattaccttaaaatctagggatttatgaggacatatcatacctttttctgaaaaattaatatgcaatgaaagtgaaggcttaagatgtagtcacatatcaactgagggacattgaaacacttcctcagttaacttgtattaccgtttgcctgatctgggaaacaagaggattcaaaaagtggtcttaaagtatgaatttctctaatataaaaattcaaaggatattgtgattcaatgcttggtgataaatgcaatagttaaaggggtaaagataatacgctgatttctaatgtcagcatgccttgtacagatgggagcctaacctcatggataattagtaaattctctcccttctgattcttctgctacgtgttatgtaggctgggtaagaaaagaaattttgtggaagattttctagaatttgagtaaaattaataccaaaatataaaagaatctgatgagattattatactcttattcccctgaacctattattttgatgaatattgtctttttcctggttcagggttggttctcaaaaattttgcacattaatacttatgatcctacccgatatatagagaaaagaggtacagtgattatttgagttgtggattttattgattattaagcaattttacatgagtagtatgactattttcactctcttctttatcctcacagtataatccaatatctggaaaagaaagttaattaatgtacattaagtgattggttaggactactatcaacatgggagtcagaaatggaataattaagcactcctcttccacccaaatgtaaacattcttccagaaaatgttttgcttcaagtttgatattaatcattgctctacacattatcacaaatatgtctgtaatcttttatggttttaaagaagttaactgataattatcgtgatctacctacctcctttccaatgtttgtttttattaaattggctgccctacttgaacgggagattctgttttctcaccattgtcctgggattactatcaggaaactttcacatgaattgtgaggatctgagctctactcctcacacttataagacaagcattgtacctagtgagtcatactcctccttctacttgctagcaaccattaactaattgattgattgattaattaattaattaattaatgtgttctcagagatttgccttaatacatgtctatgtactacatgcatgcatgtgatgcctgacaaggccagaagaagttgtctgataccctggacgtagaataaaaacagatgattgtaaaactgccattttgatgttagactaatatccagatctgctgatccatctctttagaccctctctcatcttttatgattttaagtgctgattttgaaaagaaatatatgggttttcttatacatttgttatgctagaaaattacctcaggatttcacccaagctaagtatactttctttatagccatacatctaaactctgccaaaagttttagtacaaattatattcattgattgtgtattgtaaaatgccttctgtcatttcaacactttatttttgcttgtagactgttctcttcattataagaagaatttcttagttttaacaaatttataacaaattgtatcctcatacttagatatgtaagattgtcagtctaccctacatttatgaaaatgctcttctgtgccatctcattgatgttttcatttttacatttcagttattagcttctttctgcatacttttgcttcaattacaggctataaaaaaatctttatagggaactttgtactgacagacaaccagtcctttctccttcattggtactagtgtgtgtgtgtgtgtgtgtgtgcgcgtgcgcgcgcgcgcgcatgtaaacattttgtcgggggccggggctcttttttatttttttaattttcttttcttttttttttcttttcgagtcggattgcttgtttgtgtttttcctattaatttttgaggctttttaaattattttgtttttgctttttaattgcctatttcttcctaaagagagaaagaaagaaagaaagaaagaaagaaagaaagaaagaaagaaagaaagaaagaaagaaagaaagaagaggatgtagaatttgggcgtgggtaggtaggatgggaaatgggggaaggacatcggagtatctgagggaatgtagacaatgatcagagtatattgtgtggaaagaaatcaatttttcattaaaatttctgttctgtttcttaaaagccaatctcctatgtagtgaaattagaagttccgttcatacagaattttgatacaaatggaaactaactgtcataaccaagttcattgcttgacctaatataattaaagacaaatgcaaattctctggtttatgtataaactacagtgggcctgcctgaaatctatgctgaagttaatcattctatgcccaaatgtgcaaccacgtttcatgattaaatggacagaaatgttgatgaataaacctaatgactaaactacttttccagcaacaatacactcaccccagtgtaaatcttacatgaaacttggctctgtcgccacatagagaaaagccaaaatccccttacaagtatggcatcaaatacacaatctggtaattgtggtattagttgaatacatctctctttttactaaatatgtttctccctcactatctaaaacttgtgaataaattaaattacatggcaaaagataatttgcatatgcactaagattgcatacttcaaaaataaacatggcatactgcattattgaaaaaatattaatcatggatgttcacaagtgtaatgaaatatttggagatctgatctcacaacccagcctgtggcattaattctgagtcatctagtaaccttttatagcctctgcactgcactggcaaagtgagtctacctgcatacacatgcatacataaacactcatgtgtgcacatgtgcatacacacacacatacacacacacacacacacacacacacacacacacacacacagagagagagagagagagagagagagagagagagagagagagagagagagagagagaaactttcagaaatcttccacagtgctctgtataattttccatggccatatcggatgtacgtgatgtactcctttagaatgataagttcttctacctatttcatacttcttggatattaaatgttgctttactactcagtcatacacatgcgctgaccaggcaagcagttccctgtacagcacagcaatcaaggtaattcatacctattattccagcacttgagaggcaagaagattgtcatgtgtttgaagccaaccagcctcaagtaaataaataaatcattttaaaatttaaaaaaatctacttaatctatttaatattgagaacccaatgtcacaactatgttgttactgttccatttgttttagaacattcctcttatctgttcaggaatgcttctgacaaacacagctacagtctcccatttctccacttcctagccccatcctcttctgtctacctaagtgtgatttttattaatagacccggaacaaacaaacgaacaaatcccccactattttcttaagatacactgatcataggagccccagcatttgctgcctcttccttccctttcatatgcctcccatagtctcactgaactgcttctgtagcactccttacagctttacatgtgtctgggaatttctttaaatccagaaaagcgaaagtattatctgctttgtcttatatattcatcttctagcacatgactttgcaaagagttgcaagccccataaggacttactgagcccaagatggtatctgaaatgataacgtgtccaggagctaacttaactaacagtggcctcaagtataaacactaacagtctaaaatggtctacagtcatttatagttttgtgagagagtttgacaattgtgtacttctaataaatgaatctatccttcaactagtatttagttatatgagttaaagccgcgaagtccgtatgttcatatttaaacaaaatgttgtcacagaagaataattatctgaaattcaacttctcagtatttcagagaagatatgtcaatgttataaaatcatgtatcaacccaattatgaaaatacttagattcttttacaaaataaaatctagtatcaaaaattgggcttgcagccgttatgtgtgtggcccaggctggcctcaaacatatgcctcctgcagcctcctatgcgttgggagtataaggtagagccatctggggcatggttggggaaccttaagaacaagtagactgcagcttaaaatattggggaatcacttgtaattttaaaaattaacaaatccagatgcaatcatctatggaattttttaaattagaatgtgaacagtgtgaaaactaatggtgccacgcttcagtgtttggggaaaagtgccgataatataagtggtttcaaaagtgttttcatcaacgtttttgtgagctggcaagcagcacttctgatgtgaaagtgagtgtctctctgagggttgtatttagcaaaggtcctataaaaaagccagtgtatggtggcaattaaatatgactcattccacattaaaactttagaatgcatttgctgaagtaagcttgcaaagtttcatttgaaaagctgggcttataaaaatgttttgacactgcaatgccttgaaagcagattttatttattattattattattattgcaatttattatacttagggatatttttattttattttgaaatatacctatcttttggaaaataagatcctggtgagtaacatgtgaacattcttgttctattaaacacactgcaaagaaactagaatgagtttatgaaaatattttcctaagaagtctgtcagctgtttcacctcatgttgaaagtgggaagtgacctcacagaagctagctcaatatgtttctctgataatgcggccttgggtctctgagacacaccgttgtgagcctgtgctttaataggctggtctgagaacttgtatttccttcctgaatattattcaggttctttacagtgtgtggaaaattaattcactttgttgatgttctattttgtttgacccttcctacttgcttatccacctgctatatttggctagaatctacaaattgctactttcttttaaaataatttctgtttttctatacaagaagtataaatgaaataagaaacactcatcgatatggaaagcccataataaatgctataagcataccatgatttttcttttacttatttgatatatattatcttgttttaggataaaatttttagatataatatatacatttacttcaactgtttactcagctgtctgtttaaagattaatgtcttattttcactataaaactaataaatttaggagttaaacataaggatcaatacacctgttaattatctcaatatagacacttgaaaatgtatacttattttttaaaaaatatgcatgatacatagatttctattttcagatattaatttcaaaactatagaaaaacttagatcatgattgtgaataatagactgtgaatagtagactggggaaaatgaatcatgaccttttaagtagatgggacatgacagaaatttcatagcagattcagtactaatgcagaaccatttgtatgtgacttttttaaagggagctgctttttagcttggcctcagtttcattccatctgataccatacctactgtgaatctatgtctatatctatgtctatgtctatgtctatgtatgtctataatacaagatatatagtcaatgattaataggaatctattcaataacatcagtaaatcagagcgccactgtatttatcttacaataacaagaaaattatttatcatcttttagctataaaacattttgtaagacacatttgttaagacagtgtacattcttaatttacaatatcaaattattcaagatttctcttgaaatgagtataattttcctgctattattgattggacaattgtatctcagactactttaaagacttgttcaagatagcacagcaatggaatgctagaaatgaattgaaaaacctagatttctatgtacaagctttcaatataataaactgatttgcataaccatttccaataacagtcatctttagagagcaaagcatctcttcaaaaatgtgtgtgtgtgtgtgtgtgtgtgtgtgtgtgtgtgtgtgtgtgtgtaggtgtgatgaatatttatttgtatgcaccatactcctaaaaggagaaaaagccagaaaaaatgtcagctctcctataactggaaatacagtcggctgctctgtgaattttatgaaccaaagccagattctttgcaagtgcagtaagtgatcctaaccaccaagaaaggtttccagaccaaatagttcactcagtatcttactatgtagctatcttttcctggaatacacatatagaatatgatggacattaagtcacagaaatcctcctgcctctgcttcctggtacaaaatgtatttttaaaacatttgtagacagttaaaagagaaaatcatttgaattttctcacataaacaagtggaccaacaaaaactatactataaaatatgaaattaatgggctggagtgatggctcagtggttaagcgctccgactgcacacccaaaggtcttgagtttaaatcccagcaaccacatggttgttcacaaccacccattatgagatcaaacaccctcttctggtgcatctgaagacagctacagtgtactactgaataatactaaataagtctttttaaaaatgtgaaattaaatttatgctggtcactagaagggtggtagatagtggtgaccaaattacaactgtggcagagagattagttttttaattctacaaaataatgaggtaattaagatttacaaaaatgtatcatgcatttaaagggagtcatttggagtatcttgactcacaaaaacatgttagatgatattaatactaattacgcttattttttttcattacatagagtatacgtgtatccaatcatcatgatgcactccatagaatgtggtcaaatattatagtgactgaaaaagtagaattggcaaaaaaaattacagtctaaattctatgtttagaccctaaataatataataaaacgggttgctaataggaatcagtagactgagcaagttaaagatcacacaaacatacacatgtatcagtagactgagcatgttatattatgacactcacgtgtatgtgaatatatatgaagcacaaaaaaatatgtgcatgaatttgagagggagcatgagaaatacatggtagtggttggaagaagtaaaggaaaggggaaatgatgtaattatatattttcatttttattggttattttatttatttatatttcaaatattatgcccttctaagtttcccttccacacactcctaatgccctccccctgctccctgattctatgagtgtgctccccaaaccacatacagattcccaactctgcaccctagcattccccgacactgggtcatcaagccttcacaggacgtagaggctcccctcccgttgatgccagataaggcaaccttctgctacatacccagctggagccatgggactatccatgaggactctggttgatggtttagtacctgggagctttggggtgtctgcttggttaaaactgttgttcttcctatggggttgaaaaactgtgctacagagcaatagtgaaaaaacaaaaagcaagaaacaaaacaaaacaaaaatctatagtctatagtattggtgcagatacaggcatgtagatcaatgtaatagaattaaagtcacagaagtgaacccacacacctatggtcacaaagaagtcaaaaccattcagtggaaaaacacagcattgtcaacacatggtgctggttcaactggccataagcatgtagaagaatgcaaattgatccattcttatctccttgtacaaaggtcaagtccaagtggataaaggatcataaaaccagatatgctgaatataaaagaagagaatatgtaagaaccttgaatacattggcacagggaaattttttcctgaacagaacaccaaaggctcagagtctaagatcaacaattgacaaatgggacctcaaaattgacaagcttttgtaaggcaaaggacaacatcaataggacaaaacatcaacccacagtttgggaaaagataattaccaaccctacatctgatagtgggctaatatccaaaatatacaaagaattcaagaagttagactccagagaaccaagtaagcctattaaaaatgaggtacagagctaaacaagacttctcagctgaggaatctcaaatggctgagaagcacttaaataaatgttcaatatacttagtcatcagagaaatgcaaatcaaaacaaccctgagattccacctcacaccagtcagaatggctaagatcaaaaacgcatgtgacagcagatgctggcgagaatgtggaaaaagaggaatgctcctccattgctggtgggattgcaagctggtacaactgctctggaaatcagtttattgcttcctctgataattggacatagcactactgtcagatcaaacaatatcactcctggtcatatatgcagaagatgctccaacttgtaataaggacacatgctccactatgttcagagcagccttatttatattagccagaagctggaaagaacccagatgtcccacaacagaggaatggacacagaaaatgtggtacatttacacaatggactactatgcagctattaaaaacaatgaatttatgaaattcttagacaaatggatggatctggaggatatcatcctaagtgaggtaacctagccacaaaagaactcacatgatatgcactcactgataagtggatattagcccagaagctcagaatacccaagaaacaatttgcaaaacacatgaaactcaagaaggaagaccaaagtgaggatactttgatccttcttaaaaaaaaaaaaaaaaaaaagaagggagaacaagctaggcggtggtgacgcatgcctttaatcccagcacttgggaggaagaagcaggcggatttctgagtttgagaccagcctggtctacaaagtgagtttcaggacagccagggttacacaaagaaacctgtctcgaaaacaaacaaacagaagaagaagaagaagaagaagaagaagaagaagaagaagaagaagaagaagaagaagaagaagaagaagaagaagaagaaaaagcgggaacaaaatacccatggaaggagacaaagtttagagcagagactgaaagaatgaccatccagagactgtcccactttaggatccagcccataaacaaccaccaaacccagacactattgtaaatgccaaaaagagctagctagcttgataaagctgtctcctgagaggctctgccagtgcctgacaaatacagaagcgaatgctcacagccattcattttacaaagcacagggtaaccaatgaagtagctagagaaagtacccaaggagctgaaggaattttcagccccataggttgaacaacaatatgaactaaccagtatccccagagctctctgggactaaaacaccaatcaaagaaaccacatgataggactcatggttctagctgcatatgtagcagaggatgacctagtcagtcatcaatgggaggagaggcccttggtcctatgaagggtctatgtctcagtataggggaatgtcagggccaggaagcaggaatgtgtgggttggggagtatgggaagagaataggggattttcagaggggaaagtagtaaagtataattataacaattataatttaaataaagaaaatatctaatgaaagagaaaatctaaaaaaatagaaaataaccagtaaaaaagaaaatggaaataaatatggtacatttacacaatggagaactactaagctagtaaaaacaatgactacatgaaattcacaggcaaatgtatagaaatagaaaatatgcagctattaaaaacaatgaatttatgaaattgttagacaaaagaatggatcaggaggatatcatcctaagtgaggcaacccagtcacaaaagaacacacatggtatgcactcactgataagtgactattaggaaaaattcttggcatacccatcatacaactcacagacaaaattaaaccaaagagtaaggaagaccaaagtatggattcttcagtcctactcaggagggggaagaaaaggaccatgggagctagtgggaggaggagaaaaaaaggagggcaggatcaggtgtggtaggagaaaaggagacgtacagatggtcaggaatttgaatggaggtgtgtagcagtgggggattgggaagtaggggtagtcagtagaaagtcccagatgccaggcatccaagacattcccagaacacaataaaggtgacattagctgaaatacccaacaaagtggagatagaacctgtgaagaccacatccagttgatagctattaccccaggtgagggatggggacacccagacatctcaaaatattaatccagaattacttctctcaaaagaaaatggaaggccgggcgtggtggcacacgcatttaatcccagcacttgggaagcagaggcaggtgaatttctgagttcaaggccagcctggtctacagagtgagttccaggacagtcagggctacacagagaaaccctgtctcgaaaaaccaaaataataataataataataataataataataataaatttaaaaatgcaaggaaaaattggagcagagactgagcagagactgcaatccggagactgccccacctcgggatccattccatttgcagatacccgaacccaggtgctattgttgatgccaagaagtgcttgctgacaggagcttggtatagctgtctcctgagatactctgccagagcctgaccaatacagatacagatgcaagcagtcaaccattgtactgagcacagggatcccaatataggagttagcagaaggactaaaggaataattatattttaatttcaaaaatatatttataaaactgatattagatttcaggaactgcatttttcttaagagttaatgagaacacatgcaacaaaatattcaataatccaacaaccatgtgtacaagtttagatattactattatgtgaaattcaaaatattatatggaaaaacagtgattcagccttccatgaagtttccatgtactcaaatctgattaattaatcaatcaactgccattaagttaaaaacattctaagtctgaattttctatctttcaaagattccaatcaagcaatgccatccaggaaatcaccttggaaaataagccaaaatatgagcccctccatgattatttctttacttttatttcatccagagaaaaagagtccatgtgtgtttatgttggaaatagtggcttcctgccctctgcaattattaacaatgtttgtataacccttaaaatgtacctgcattgatctagtctgctgtatgaacagcaaggtttatgaaacacaaaaggcaacatgaaactgaagtcatgatttacaaagtgagccaggtgtgaggagaatgaagagatcagcataatgagtgttcataaatttgaatatttgttgtgaaaggcatttaatgaaagactagggatgcattacttaaaacaaacaaacagccctcttcctgtataaagcttataatccagcagcagccatcagaagaagaccaaaaacctgcattatgctcactatcttaaacagtaatgactgaagagaaaggagaaacagcaaaggcctgtaggaatttgtcatgttaagtagagcttttagaaaacatctatttgaaactacgacaaaattcacagaaggcttgaagcaggagagaactggagacacagagatctacattccaagaattgggaagttcatgtctttgaacttaacaggcatttcagcttctaccatcctctcatgcttctccctctatctgacactgcctgaactgtgtcttaactctatgctaatgactggtcacactttaacaaataacacagatgtaatcgcaatataagtggatataaaaaccacagaaagaatgcaggagttagagagattcacagcatccattttatacctatggttttccgattctcaatctgaaagctgtgctgcttccccgtcttaggccatggaagtaactccttggcagagaatgagagaactctccctactattcaaactcatctagagtattaaatcctcatttggatttattgctaacaaatctgacaatatatgagacttgcctaagatcatgagctttataattaaattttaacttgaaatgagaacatctgggtactgtttctgctataacagaccactgtatctatcatcctttgtgttcattaacatgacttaatggaaaagtatgtggatgtatagaatttaattttgtttcaccaagtgaaaagtaacatgtacagtaagtagacagtgcaatatattatttataataagcacatggaactggaaatttagctcaaataataaaggagttgtcctgcaaagacaggacatatgtatgatccccagaatccacatgaaggaaaatgtcctggtagtattgtacacgcttctaatcccaattcttggaagccagtgtcagatggatcctttgggatctttgggaaactaacctgccctgggttttcatgtgtactacagatagacatgtacacctcctcccatgcttcaacacatatgtgcatacccacacatgtgtgcactcacaggaacatccacatgcaaacacatacacacatggaacgtacaaatgctacatatatacatagaaacataattctgataagtcttggatatttatttaatattggtgatactctttcacgttttctcaggaatcttactatctttcttatttgtgtcctatattttcagctgactgtgctcctgtcataacttagaccttgaatgtcaacttctctaatgaatctgtaatgtaaatatggactgacaataattatccagaagtttgaacctattataacttctgcaagtatccccatgtctggctctttgcacataaagagcattttgtaattaattctgagctaatatattataccaatataccatactacttatataattagaaagcatattattaactgtttttacactgttactagtacagttttgtatacaaaaattagaagtttctaacaattagaaatgtccttaaaataatactctttagaatcttcattttgcattttgcaaaatgtttaaaagataaaagtagtcttttacttttggtatgtaataaaaatacatggttgtgttgaaattaaaatcctgtttaataacattgtttattcctatattgggtctatttatatttaataagtaaaataaagtttacatatgtatatgaaagtatatataatgtgtattttcatatgctgacataaacttaaaatagtgttggtagtatgcattgccctgtaaagccagaatataataagcacaggcagaaaggtctacaccttgtacaacctactcaagaactttaaatagaataaatatttgaaaaaaattcatgagtgacaatggagtcaattgttctcgtcatgtcaagattgacatttatattctgcatcatgaatatgtgacaatcatctgcttgagtcaccaggcatgacatttacttcttcccttaacacgctattgtgaacaaaaaattaaagattatctctcaccactcctttgagtaatacatctacataccctctaattaagaacctccttgacggaccccaccccagttttgcataattttctcatagaacacatatgacaagagtttgtcaagaagtggagttaaggtttatttgcaaataccgagcatctgtctttgcatatgagaactagagtttcactgtgataattacacaaccacaaataaaacttggcatctgacctcttggttgactgtatgttcccatctagagacgaagtgaagaggaagtgtgaaacatttgtatgagaattgaaatctattttttcacatgtattttagagattgtcatgcaaaggtagggaattacatcatttttcaatccatctcttgtccctctaattccttccatgtcttttctctaccccctcctaaactcatgacctcttattcattcattattattattattattgataattattattattagtagtagtactagtgtcagtattagaggtagtagtagtattgtcaatttgtgtgtttgtgtgtttacctgcgcgcgcgcgcgcgtgtgtgtgtgtgtgtgtgtgtaccatctcctgtgtccaattagaattactcctgtctgtatatatattttccccttaccacttgacaatgaacaatcaattaggcactcatacctgcacaagaccaattcttctctagtagctatttattgcctgtagatcctcatctattggttgagccttaagatttttctcatctatattattttgccaaattgtgttgatcttttaaccaaaggttgagagaacattgtagaagatagagcagaaaatatgtgaatattttaaaatataaatatgtgtgtttcatagaccatgattctttcaaaacatcaactaaattttacaacttttatagagacagcattttccctgcacatttacattccctgtacatttcatttcatggattcctttaacctttcctctggtgcccatctcacagtgatgagtatgctcagatcttatagtttttaaaatgatatattttcatactcattttggaaaggaatagttttgctggtcagagaagttaggttaactgttcttttatgggggtgtatcttgatttgtaagtacaataaggttatgaataatacttcatgttcctctttcttgaattttctctcctaaaaaatattccagttgctttaatcattgtttctttgaagagatggctcatctttgtctgcatgaggacttaatatatcattactttgcagcagtaacatgatgtgtctatgttctcttctgaatatttctcagagcttttgagttagttccattgatgactttgcataagagtttttattatgcttgaaatttttcccattattgttgccatcattagttttcattctattccataaaaatatcaaatttatagtttaacctatgcccattttttccttgtccatatgaatttggtcctttcatctggatgtctatgggatagttttgttgttatggagtcatgttgagtttacagcacctactctgttttcaatgctgttgagtattatttttcatcttatttaatactctttcatttaattggacgtattttacaatctacaatgtttatcttgttcattcctttcctctaattttattgaatactccctctttctcatataaagtatatcaagactgtaagacttttggctactttatggcttccttttcctaccatccttctctatccctattccaccatttgaacctccctcccacccctgcaacactaggtgggagataaagaaggctagagaggaaaagtgacattgatattagtagactacttcttgctaattaggggtgtcacattccttagggtaagatttttcttcaaagttagcatatctaatttcttcttattatttctttatgcatgactacttgataaacagtggcaacagcaaggaacaaccaccagcagcagcagtaacagggggagtagcagcagccacagcctctttttatatatcctttgtgagtcctcagaatcctaacagtcatacactcagaaactgcatggggctgtcaaaattacaaccctgctagagcatgaggcaagtcatagtcagctgctgagagcaatcaaaaacacacatatatcacacagctaggattaaacacaactataacattgctgtgtttttaaagaaaccagaaaaccagaattcttactatttgtaatcagtgcttaattcttttatctattacttcctttacggaggacagcagtggtgctgggacaatttatctttgccaatgctactggagcaaatgtccaattttgtataagtcttgtgaagttaatgatggctatagtgatttcactagtacaatggctgccatgacaagagtatatctttttgttaccagtcttcccatcctgtactcttacattctttcagatcttcttttgtaatgtctcctaaaccatggggaaggtgttaattacttctatctcagttcgatctgaactttccatcatcacataagtcacttacgtcagttatggttttcaaaattggtccttgtctgctgtagtaaggagcactaaatgcctttccacccatgcttgggacaagtagcaataattaaactcaatgaggcaaacacaaaaagactttaattatttttatttttcatgggagttaggactttcttattatttaccaactttagcagtgttcgtgtgcgtgtgcgcgtgcgtgtgcacatgtgtgtgtgtgtgtgtgtgtgtgtgtgtgtgtgcgtgaatgcatctatgatcagaaatgggctggaagaggtgaggttgaattgagtggactgactcagaccacagctactttaaacgtaacattaggaaatgtggagtaagtcctgtaggtagtgggaatctaagaaatctagaaatggatggatgtttccctaacatgtgtgtgtaggatgtttgttctgcccatggaacaaactcagctgggaagttatgaggccatgatccttaagagagcagggtttatcataaatataaaaaaaatcctgtgataatttttagatctcaactaggtggagacaaggattaggattgccactgacttaacactggaaataatgaatggcgccggggaaaagaaacttttgagaggtgggattcatatcactgaaatgtccaaatttaggtgacagcttatttcccaggggactgggatgttccaggtactcctagcatctggaacagctgttcatatgaaaggctgcctgtctcttgcacagaagacagaatatccctatgcatagtctaccaagttggggtgctaaggaaggcagcttggttgcactgagaaggtgcttccctccagttttcatcacctacctggaactttgccaaggggaggaacagcaactttgctaccatcctctttaatatcatcgagatttaggatggagggtaaatttattcatttgttcttgattcttgagtgacaacgactcaatctacctaaggaggcagggacacctttataatccgacagggtctagagaaagagtttaagaccaatctggactacataaagatcctgcctcacattaaaacaaaagaaattaaagtcaaaacaaaatagaaacaattaaaaatggaagttcattaagtcatttttttaaaggatgagaattctaaaaatctaattttctggccatcctggatcccacaatgttttattgctaactgcgactgccaggccatgtactatctctggatccttgccccaaataccttacaaactgagctgagcatcccctccaattttactgcttctcttttcctgagcgacttatctctccaactgtgacatgaaccagtctgttacatggaaagagattaattaaactgagcggttaagatgataaaagtcattatccagcagagacgttatggttgtgtgggaagaaggcggggcaggagaatgggtagaaacagaacagccaccattagcccagatgtagaagcttcacctagacaaaaataaatcaaaatcaattccaagttgttttttttttctttacttttttattagatgttttctttatttacatttcaaatggtatcctttttcctggtttcccccatgaaaatctcctataatctcccccctcctcctgttcaccaacccacccattcctaattcctagccctagcatacttctatactggggcatagacccttcacaggaccaagggcctctcctcccatcaatgaccatcttctgctacatatgcagctggagaaacaagtcccaccttgtgctttctttggttggtggtttagtccctgggagctctgggggtactggtttgttgatattgttgatcctaatatggggctgcaaacccctttcatctccttgggtattttctctagctccttcattggggaccctgttctttgaccaatggatagctgtgaacattgtttttacaagactgagtctccagagtgctccctatcaaaagcagagtctcaaattcagagacactgaatcagaaagagagatgtttgcatgttcaaagatgattatctggaacatgtgcatgtttgcatacacttgggatattgtttggcaacaccagtgactatgaacatgaggaactgtgatagtaaccaatagtaagcaagaagcctgttacaaaggacaaatggcacaagagtagacaggatggatttgtgccaaaatgaccaccaactgcctgaatgacccctagttaaccctttttcctctttaagcctcacttttacctccttaaaaatgagaaaggttcactcattttggcttaatgccaacctcttatttagttccattctttccttcatgcacaaatccttacaacattgatatgaacaaggagaaaattcgtagaacttgggtttatctgtgtaatatactatgaaagtgacactcagtatggcaagagaggatgtaggtagagagaaggaaaagatgggagagatagagtccttatggttttgataagatacaaatttatgaagactctcttcttctttgctgggtaatggagttttgcacgaggaaataaatgatttgtgtctattaaagaagaaagagcaacaaccgcacatttctgagagcctcattaaatgtgttctgtttcccacactgtcgctgctcatttgggtgagcactgaagtgcacaataaaaggctgaattaagtgcagggctaaatgaagcaattaattctctttctctcttctctctaatacaatgaaggtgtgaatcagaatgtagagtagcctgaagttgacccttgctatgtctgcttcttgccatatatcttctggcaagtgcacaaagcactgtttctctccatctcagactggatatatgcctattcaaatcttaaaaaatagcttcatagtaaaatgtgactttatagaatagtagccataatgaataaatctctgaccagctttggtaattaaattttaccccctcagtcaaataagtttaagtttgggctttacacttgtcagtgcttaaaacgaaaaaagcataatttggtacataattttagaaaaataaatctttccatgactttaggtatgactagtagataggacacagattacttgtagacacttgtagagttcatggagaagtgggttttattaatgtgtgtacatgctcctgtgtgtgtggatgcacatgggtgtgcccatgcagacatcaaagttcaacaaataagtatttatatcatcctcataaatgtcattcagtcttattttgttcagaaggaaagaatttatttggtcttacaggttatagtgcatcatcgtgggaagccaagtcaggaactcaaagcagaacagaaacttagtcagagaccatggggaccgctgcttactagaggaagctcactttctctggatgttcatctagcagttctacatagtccatgcccatctatggagggatggcactgctcactatggtatgggccctccgccattgtcttgagaatcattaaaatatgacaagaaattcatataggccatgaagacagtctatcaattgaaggtttctcttcctaggtgtgttaaccatggagattagccagcataatacacaacaatagatgtttataaaaaataccagagattttgtatcacttatcaattttaaggtagtaaacctaaatccaaattttgcaattttaaaagtatgatttttttctttttttttttttattacgtattttcttcaattaaatttccaatgctatcccaaaagtccccctcccccgtcactcccctacccacccattcccatttcttggccctggcattcccctgtactggggcatataacatttgcctgaccaatgggcctctctttccagtgatggccgactaggtcatcgtttgatacatatgcagctagagtcaagagctctggggtactggttagttcataatgttgttcctccgatagggttgcagttccctttagctccttggatactttctctagctcttacattgggggctgtgtgacccatccaatagttgactgtgagcatccacttctgtgtttgctaggccccggcctagtctcacaagggacagctatatcactgtccttgcaatatgatttttaatataaagtagaagactggatttcaaggacatgaagcctaacctgattattaataagagtttatgcatgctgagcaggaatgtatatgtagcagaggttggtcttgtcagacatcagtgagaggagatgcccatgatcctgtgaaggcttgattccccagtgtaagggaatgccaggacgggaaagcaggagtgggtgggtttttgaggggaaatgaggaaaggggatagcatttgaaatgtaaataaggaaaatatctaatgaagaaataaaaaggaaaacagagattaccccatatattacagaggcagctattattaagtcataagataataataagtagaatagtgaattttgatataaattttagcttttatcattaagaggtaaaggctatttctaactacttgttctattgtatttcaaaaacaagtttttcaagattcttatctttcctaatctaaggtatagagaaagaaaatattaattttaaaaacaagctgatgattttcactcttaagacaggatttctcaatggtctggagctgaaaattggtctagacttactgaccaataaatttagatgccttcctgtcttctttttcccaaaactggaattacaaatatgacactgtacttgcccttcatatatatattttgagctactttcttagtagatattttctttgtttacatttcaaatgttatcttctttcctggtttcccctcccaaaaaccccctttcccagccccccggccactgctcaccaacccacccactcctgcttccctgtcctggcatttccctaccctggagcatggaaccttcagaggaccaggggcctctcctcccactgatgtccaacaaggccatcctctgctacacatgcagctggaaacatgggtccctccatgtatactctatggttcatggtttagtccctgggagctctaggggtactggttagttcctattgttgtttctcctatggggctgtacctcatttagctcctttgtccttcctctagctcctccattgggaaccttgtgctcagtctaatggttggctgagatcttccacctctgaatatgttaggcactggcagagcctctcaggagacagctatatcaggctcctgtcagcaagctcttattggcatcaacaatagtgtctgggtttggttacagtatatgggattgatccccaggtggggtaagtctcttgatggtctttctttaagtctctgctccacactttgtatctcctccaatgggtattttgttcccccttcaaagaaggactgaaatatccatactttgatcttccttctttttgagcttcatttggtctgtgattgggaaaagatctttaccaaccctacatccaatagagggctaatatccaaaatatacaaacaactcaagaagttagactacagagaaccaaataaccctattaaaaaataggttacagagctaaatatagaattctcaaccaaagaatatcgaatggctgagaagcacctaaagaagtaggatacccaagatataagatacaacttgccaaacgcatgaaattcaagaagaacgaagaccaaagtgtggacactttaccctttcttagaaatgggaagaaaacaccgatggaaggagttacagagacaaaatttggagctgtgacgaacggatggaccatctagtgattgccatatgcagggatccatcccaaaatcagcttccaaatgctgacaccattgcatacactagcaagattttgttgaaaggacccagatatagctctctcttgtgagactatgccagggcctagcaaacacagaagtggatgatcacagtcagctattggatgggtcacacagcccccaatggaggagctagagaaattacccaaggagctaaagggaactgcaaccctataggtagaacaacaatataaactaaccagtaccccggagctcttgtctctagctgcatatgtatcaaaagatggcctagtcggccatcactgcaaagagaggcccattggacttgcaaactttatatgccccagtacaggggaacgccagggccaaaaagggggagtgggtggataggggattgggggggtgggtatgggggacctttgggatagcattgaaatgtaaacgaggaaaatacctaaattaaaaaaaaaaaagaagtgctcagcatctttaggcatcagagaaatgcaattcaaaacaacccagagattctacctcacaccagtcagaatggttaagatcaaaaactcaggtgacagcacatgctggtgaggatgtggagaaagaggaacattcctccatggttggtgggattgcaaactggtacaaccactatggtaatcactccagcagttcctcagaaaattggacttagtactaccggaggatcccgcaatacctctcctgggcatatatccagaagatgtcccaaccggtaagaaggacacatgctccactatgttcatagcagccttatttataatagtcagaaactagaaagaacccagatgtccctcaacagaggaatggaaacagaaaatatggtacatttacataatgaagtactactcagccattaaaaacaaagaattcatgaaattattaggcaaatggatgggactagaaattatcatcctgagtgaggtaacgcagtcacacgcactgataagtggatattagcacagaagcttggagtatccaagatacaattttttgagtttcaaagttagatcctattgtgtttaagacaagcatttcccacttgtgtcttctccctgccttggaagtgggtttcaggttttgaatgagtaatgtggtagttctgagcagtggtgtgtgcttcttcttttcagtggaccaatgagaactttcttctcccagaaacttgctattattctacaaggcaacttttgtcaagcatattacataatgccaagtaaattctaagcactttgaaatgcttactgtcttttccatctgcctcattcttgtaacttcacaaacacaatacttattttggtataatataataaattactcatttcttagacaatatacatatccccaacacaatgtgaccataattgacattagattttcattgatgatagtgtactctgattattcattctttctgtcctttggtctgccagtcacatttttttttcatggaaagaatagggtgtgaccatgaaaggattaaggcaagatctcatacaatactacaacctgcagatatctcatatgtacctacagctttcagacatggaaggtttttcttccttattaaaatttccagaaaaaagtaattattatagcctaattatggggaatatgtgagctaatgtagaaatatttaagtaaatgcttctcaaaatgcaaactatattccaggtaccctgctatgtaattaggacacaacttatttaattatccccgcagtatgattatactagattctcacctaactggtgagtccagattatcaaatattgaaaaaatatttaataatatatcaacacaaaatattaacaaaatgtaatttgtgaggttctcattaaactattactagcttttaatagaaattagtaggaatgcttacaccagaaattggcagacattactatagcactgaagattttgaaataagtgaaaaataacatcaacactaaaatataactgaagcaggaaaatttactttattaatgacaaagtcattctgtctatctttcacatctctgtacaacagcattactcagtgatactctacgctaataatatactgcataagtgctcaataattattagcaaccgttcatattgaagtgggcacttccctcactgcatatctgtgccttctttttcccagctctctcatccttgacaatataagtttttttacctatgtactgatgaaaagactgctaataacagaatgatcattactatttttgttcccactttatctttgatatattgcaaccatttaaagtggatatagaataaatcatcatttcctagtatacaaatattttgggggaccatgaggttgaatatttgttgctcacttagttagagattacaggtcagagaatgctggtttagagactattggcaacctcagtgtaatgaaaagaaatctgttcaatggaagagtgataggacagtgcagcaagctgtattatttttcccttgggtttatactaattagcagagatgttgtgataaaatgttctgagtcaaggccagctataccactagtttggggaagtaattatatttgatcactttttttaagcacacaaatgccagtaggccaatgcttaaagtgataattgatggagaaaagggtttgctttgtttgtttgtttgtttgtttgtttgtttttgtttttgtttgagacagggtttctctgtatagccctggctgtcctggaactcactttgtagaccaagctggcctcaaactcagaaatctgcctgcctctgcctccccagtgctggtattaaaggtgtgaaccaccacacccagcaagaaaagggtttttaaggtgttataaattagaaaaagaatctgtcagcaaagcttatagctgctctatgcttttggagtctgtactctcctgatgaagtcaaggatcctgtttactagatagtcctaggtgctaaggactttgagatgatctttacaaagttcttgatcacaaaatattctgagaacatactgccaaattaagcagttagtcctcatgactgctggaaggataaagcataaaggacatacaagtcttctctagagcactaggaagagaggcacaaacatcagtgactaacacaataggttgtgtgaaaattctagattgagagactatgatttcagactgaccactaggtattggaaaaacaattgttattctcacacctaggagtgactaaattcaataggttgtcctgcagtcctttgtctaggagttgtgccctagaaatatcctattctataaaagcatgtctattgataatttccttgtttgtatccttgtgttaggcaactgcatatttaagaatcttaagtatagtgtattttccctctaaatgataggacacacaatctttaactgacttcatgttgctctggctgttataatctgtttccttttttgtgatgttccacgaagtttgctcacatgagttgtattctaggtgaatctattaaggctgggcttaatgattaattcatgattagttcattgctacatattggaaagttgtggttttctgtgatgaaccctttgctgcaaagaaaaatatccttgatatgaggtaaaagctacactcatctgtggctataagaatatatttaagaatgcagtctgaatttatggtagtctattaaactgtcaatcaaagcttttcctctatgatctatgacctcactagaaccaagtatttggctaggtatctaatatcaaatataattttttcaattgattagatcatccaattatatatttgttaacacaaagatatgagtggcactctaggagtatctgacaatgagattatttggttcattggtatcacaactggataggccgttgcttacatccattggcactgtgtataactccttcaggcactagaaataataccagtttgaatcatggaaccctatgtcaaaagtgttcagtatctttagcagtagggactttcctttaaccaagatacaacaatagtccatgaagtttgggagccagttgaactcactttagcaacaacccaaaaaaagtttttcttgtgctagacagcagaggtttcattagatggattatggcccttttgatgaacattgtaatacgtagaggcataacttcatttagatatatatgaatatgtatgtatttacatatggataaaaatatacccatatgcatataacattaagtaaatataaataaacccgtaaagtttgatcaagcatccttagtattataaatagctcccctcccttgggctgatttccttcctccttcacaaataaagtagattttaactatcattctaaataaataattatttttgtttaaagtgtaacaatgtctttcttttacggaatccggtcaggttttaaaagtgattcatatttacaaatctagtaatatgattatcatatatgttctcagaattctttctgttaaaatattccaaaatataattggtcttttctaccagggattctgcattcactaactcaaagacagtagatcatagttattcaagaagcaggtgcatctgtatatagcatctgcagattttttgtcactgttccattagtaatataagaatcattctcattgcacttatattaagtaaaccaggggtgatttaaaggatcctagagtgtgtgcctaaattacatataagaactacgctattccatgagggacttcaaaagtctcagatttttatttacttagagcaagatttagcaataatttacttttgaaatatgtaataaataagagacacaacctctgctgagtatatgaagcttatattctattcagttcaaagtaaacaataaattaaaatagacaattaatagaaagcctgatgaggcaaaaaatggatatgtgaatatccaaatgtaggtagatacatagataagaaacttatatagtttggtatgtattatacagttggagttatagcacagtaactgggcaaggaagagattttaaatatgtcgtgcctctaaaatatcctttgttctgggagattgtttcataaaaaataaaatctcaaaattgacagatgaagtcagtaccaatttctctttgtgtatttaacagagttttcacaatttctcataacctttaaagagtttactttcttaaatacttaaatttatcaaaatttaaatttactcctaatgtatgcattaatacacttgggaaaaatcaaaaatgattaattttgcataatagttctctttgatgctacaaccatatggcttctatatagacaagattcgctacattttacttagatgatttaattgtcttgctttttaaaaggtgccagtaacaaaaatcttttccaagatctaaagaacagagtttgaattggttctacaaaaaagcaaaagtaataaattgaatgacttgactaaggatcaaatattcttttgcttctcctgttcttaaaacttatgaaatgtctattcatatttccttgtccaacaggatccaaaccttgctgctaagggaagaaaaagtgcttgttatcaagtatgacaatctcctttccttccagcttcaaatgtaaatgaaatattatcaattaatacagttgctaaaagtcttatcgttcatacattttaaattggggaagacataagaaatgttagatatttcatggttttataatttttgttactggatactcttacaagaagatttgatattgtgaagacaggcgataacttgcaagagagccttggaaagttcaatattggcttgttttgccttgtgatgcatatgacactatattttaattatcaaaaatatctggaatgtgaggtcatttataaaggcaattctgactatgaagttattctcccacctctgatgttacctgaaagacatcatcagttttgcctttgaaacctaaaatcagtactttgtgtgtttctgtacttataaaggacaaagattcatttttagttggtgtaagaaagcaggatgctgcctcagcggctctgtgcttctgcccgtcccagaagctgtccggttctctggcgcaccctctaacctgttcagactaatttcctaagttctgctgagtcccggaaccaagatggcgaccgctgctgctgaggctgaggccgcctcccaagccaggcagacacctgtcctctggtccggatggtggccggctgtctgcggcccgccaagggcaagaattgacaaatgggacctaatgaaactccaaagtttctgcaaggcaaaagacaccgtcaataagacaaagagaccaccaacagattgggaaaggatctttacctatcctaaatcagataggggactaatatccaacatatataaagaactcaagaaggtggacttcagaaaatcaaataacccattaaaaaatggggctcagaactgaacaaagaattctcacctgaggaataccgaatggcagagaagcacctgaaaaaaatgttcaacatccttaatcatcagggaaatgcaaatcaaaacaaacctgagattccacctcacaccagtcagaatggctaagatcaaaaattcaggtgacagcagatgctggcgaggatgtggagaaagaggaacactcctccattgttgttgggattgcaggcttgtacaaccactctggaaatccgtctggcggttcctcagaaaattggacatagtactatcggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatctatgaaattcctagccaaatggatggacctggagggcatcatcctgagtgaggtaacacattcacaaaggaactcacacaatatgtactcactgataagtggatattagcccaaaacctaggatacccaagatataagatacaatttcctaaacacatgaaactcaagaaaaatgaagactgaagtgtgggcactatacccctccttagaagtgggaacaaaacacccttggaaggagttacagagacaaagtttggagctgagatgaaaggatggaccacgtagagactgccttatccagggatccaccccataatcagcatccaaacactgacaccattgcatacactagcaagattttattgaaaggacccagatgtagctctctcttgtgagactatgccggggcctagcaaacacagaagtggatgcccacagtcagctaatggatggatcacaggactcccaatggaggagctagagaaagtacccaaggagctaaagggatctgcaaccctataggtggatcaacattatgaactaaccagtaccccggagctcttgactctagctgcatatgtatcaaaggatggcctagtcggccatcactggaaagagaggcccattggacacacaaactttatatgctccagaacaggggaacgccagggccaaaaagggggagtgggcgggtaggggagtgggggtgggtgggtatgggggacttttggtatagcattggaaatgtaaatgagctaaatacctaataaaaaatggaaagaaaaaaaaaagaaagaaggatgaacagacataaaatttaacctatgttcttctataaatactattaaatactttacaactactctaatctatatttttgtatattcaagataagcttgctttatcatattctagtgagtaaaacaaagagagaatttgcatgtcggagcatctgtacagagcaagcagttaaggaatttattattactattgtgctgatatttctgaaagttcatatatcatagaggagataagtaataaaaatgtatattcatctaagtcattcctatagctttgagaaccctcccccaaacatatgactcagtcacactgtaagcacagaagaacagttgtcagtattttcatcaggaaatcaatgagataacctccttaacctagctcttagtgtttccacttcctagaaacagtaaatgaaaataatagtcagcatcacttctgtaggtgtgtctttttttccgtcatcaaaagaataacagacaaggattctggatgcattttgttcgtttttgctattgtttgttttcctttttagctattagtgttttatatgggaaaataaaatgggtgtaaaacacaaaagagtgtatgaggcaaaaataactatgtgatttggcaggatgtgtggcagggagaaatacatagatacatgggaaaattgcagataactagagcaacacaaaacagaattttcataaaaatctttctcaatcaaattttctgtcattcgttttaaaacaccacaaggagacatagtagaaaagacatatgccgatgcaattctgacttttttctcttcaaaacacatatgtaaaatttccaatgtcgttttctgttttaaatgccatttccttttgatgtcaaagtattaaaatcatttttagattttatgattgtcaaaaagctaccaaactgcattgaatttttcagatattcataaattaagacatacagacattagttctattgctgcagtctttatagcaatctagctacttattagataaacattaaatattagaaagactaatttatggagagagagagagagaagacagaagtaaagaaagaaaatataagaagaatggagggcttgttaagaataagagttaatgctggaagaagggagaagtgggaaattgaaatgggaataaaaatgatcaaaactcttcataaaaacatacaaaagtacaacataagtacaacattcagttggttgaatccatgacttatttcttgatattgttttttaagagtcatcatgattaaatagctctcatttttgtacgttcaactgggacaatcaacagtatgttgatgtctgtcttatatagcagtgtcttataaggcactgctaggcactgaggtcaggaggggacaatttggtctaggaaatttctgtcctagatccatacttcaaaatgatatcaatttggaatcaaaataattattataacaaagtcatgaaatatagtggctgctataattactattgttatttgtctgcttcaagcatggcatttcaggccaataaccaataaaggaagagatcagagcttgaggagcctttcattagaaaactgtgttcactatgctgaggaaagaaacggcattatttatttatgggtaactactaccaatgagaatatcacacacttggctgaaggtttcttttctgggtaaaaagagataactggtggcaaagtgtcatctgtcacacattctaaagacttcaactcctacagaacccactgatgtatccctggaggaactagagtgccccacctttgcctgccacgtatgtgctgggtagtcttcattaataaggagaaggaaatatggaaaactgttctctcccccttctgtaactgattgctcaccctgaaataggaagaggaaaagaaaagtgaacacatatgtgccataagaacactcttctgacttcctagagatacctgggtaacagggtatcattcatgccacattggacaatatggtacaacagcatctttctgcttttgtagtttaatggtctgaaatacccccggctatatgtttaatgccagacttccttaaattttatttctaatgaaaataaacctgactatattatggcatgtggattctgactagacctctggacaatagaagtaaatattcactagttggctacttcaactgacactttgaaaatagcattctgagaggctccttcagaaaatgttaccatatttttagaaggtaatttcattttttgctttttgcaattatatttaatcatccccccttcttccttcctccttacaaacccatattgccatattccctttctttcgacatagacagagagacagagactgagacagagacagagacagagacagagagactaacacacatatatatgcatatatatgtacatgatatgcatatgtgtgtgtgtgtatgagcaataaggtttgtatgaacatgtagactgataattatttccttcacagaagtctttggtcacacaggttgctgtttactggtatgtataattagataatatttacaagtactttcctaaggaaataattttcagcaattcagcaggacattcatcttgaaatggtttataaagaaaaggtggaggcgggggctttcacagtccattaactttaataaattcaacaaatatcatctcacctcatgaagagtcataaaaaatatccaacattctctgagctaccctggaggcataggatctgattatttagttcaatgatttcaaaacatacttgattacagaccactttttcatgccaatcttatttactccctttatggacaagtcctttggaggtcagaactcaattatgatgataaaaagaagttaagataagttcccaagtagccacaccttcaaatggaaaagagagtcaatattaggttacactagcttgaattcatgagaaaagagatgtaaaaggaattttaagaagtatcaattgttaaaattaaaaatagatgtgacaggatttaagagtggaaaatatgagacggttcccacagtttgatgaattatgcaagagtacaatgtctagctttaggaaggtggaagttatgaagcatagcttagtcaggctgaattcagtgaaatgacatcaaacttaattgcttctgggacaggcacaaacttgcttacagatgatcaatatggttttgtaaatatgattaataaacaaaacttctatccagcaaaaacattggcatgagaaagtatcattgtagactgccactttattttcacagctagtgttataactttacaaacaagatcacaatttctgttcatccccagtcaatacccagcataactccaatccaggatctccagagactgtgctaagacataaagggtcttatgttaaagagtcttccaaataaaattcagtctttactatgttctctggaagacttggggacccatcctctgattgcctctgaattcatttcctacttagctgatgctgtgactgccttcatcatataagctgaaatgttctactataccagatgaggtctctgcacttctttcactttccctggagtgtttttccagtgatgatgaagatggttttatacttcaagtaactcaggtcttcctcatgagtgaaggcatccctaaccttctctgtaccccactccttttctgtagtcaccattcgacacatcattcagcaatggctaatattgcttatgtgtctttgttcatctccttattctctccatgttaatggagcaatttaaatggtatataaattgtgaaatttaggctgcattttgttagaagagagttttcttatatggaatattgctgtcatgagggattaaggttgggtctgttctcatatattcatttagcagccacaagtaatgtcattaatttgtgcctttttagcttataccagcatcttcatattgaccacaggcaaaggaggaagcaaaatagggcaggtgggaaatattaagggagtctgctgtacaaatatcaaatgttacattcttccacaactctttggtcaaaatgcagttctatggacatattcttatagaaaacccctggtaatctacttcaactatcctttgagaaaaaagtcctagggtgaatttcactgggacttccaagcatgttctaggctctctgagtcatctaaggcaggaaaaggagcaggacgcataggagcaaaatggggaggagaagacaagaaagaaaagacggaaaatgaggagcaggagacagaaagaaaagaagatatagttggaacagagccaactaaattctgttcaatgcactctagtacaaaggaaaagatacatttcatggtagcaagaattttgtttgcactgctattgcatctcctcaaacaatatctatgtataacattccaacacagaatgtattgtgttgtatctatatatgtgtgtatacatattgatgtgagtttggtctaatgttacataaattatgttgatttggtccccaaattacacaaaaatacacaggtaagatgatgagggattctgtctgcacttggtattgattggttaataaatttgccagtggacaatagccaggcagggagatagaggcagaacatcagggttccagggaaagggtctgaggaagaaacagaaggagagagccatcatgctgggaaaggtgtagatgccaggcctgagatatgctgtactgagactttagctgtgatgtaggtgctggggaactcagtgtgagagagctgtaggtttgagtctgggtcagctaagatggcatatctgttattgtaagtaataactcagggatattgaaagggagagtgttagccacaaggaggtttgaaagtagcccagccattgagcttctaagtcatattaaagatataaagcctcatgcatgtgtctttcatttggaaactccgacctttgggatgagtaacaagaaaagtgctactaccactaaccagactatttgaatggagttatttcatttcagcaacaacagatatgtgctatataagaatgtatggtttatatatgtgtatatataaattagatagatagatagatagatagatagatagatagatagatagatagatagaaggatagataactcgtatatttaaagtcataaaattggatatgctacattcaacatgatgtatatgtgtgtgtgtctttttgtatatttaagtttacatgtgtctaaagtaaatataatagtctcatatttaattgaggcttaatcaaatcttttagacagtggtctaaatgcttaaattgaaatatttacaatataattacatattattagaagctccaatatcaatgttatattgttgtgatcagtggatcactgagataaacaatattcccaacttctcagggcttaggagaacagaggaaagatctcagtcacatgcatcatccatttcatggtgtcatatagtgccatcagatatatcctgcaacacaactgcatcagtaagaaaggtagaaggtaagatcatgcacttgcttcacaattgctctttaataaaatgttaagttacccttcctgaaggtgtgtgatcaagaacagactggcaagacaatcaaaaagaaatgctttccacggtcatcaggacaaaacctcaccaacacccatgctaactacagttctatagtgtttgcttttatattatacataaacatccatgctacacataaacaaacacaattaggtccattcaaagtcttattaaaattttgatttttattttctattgtttgcactattacactcagaatcatacttgcaggcccctttaataagcattttaccttctcttctacatcctaataaaatagggcttatgtatagggcttacagactgaagaagaaatgctaagcttaaattctaattcagatatctgtttgtgtgatgcaccttaaatgtcacccaccaaaccctccttctcagtataataaaaccatgtgtgaatgacacctttagtacagattcacagagcacacactacatattgacctgaaggctgcctttttaaaaatagctcccccacttagcacaagaagcaaatataattatgacacagggtaatatgtaaaacttctcaaattaataaggctctaaatatttgatatgtatttttaaaaaataatgtggaagttatttttgtaaaagaaaaaacattaaattgtgtcattattttaaaattatagtagtatctaatggtttataatctagcttaaaagaaagataaaggaagcagctatatatttcctaatatttcatgaataaatcaaatcctgattaacttaaaactgatattcaatcccagatgaacaaatcactgctttccattaagttttcttgtttaattattttgctttattttttcattgtgttactgtaaagctgacataatatctctctcatgttgagcaaatgggcgacttgtcattgtgcttaacccagagccatcctttctgtctatcttcctgtttgtgtctgttctttttattatttgtttgtttgtttttttctgcatactttctaaagatttgaaataaagcaatacattgggccacaaaatatatccctataatatcaattttttgaagattttgtatttgaaagaaaacacttttccttccaaatttcaggaaaaataaaaacaaaagatatagtaagtgtaaagactaatcttttggttatattactgagtaaatatggagtaatgacaaaggaatgaaaggaaggaggacaggagtgaagacgcagagaggggaaaaaggctcgtatagaatcttccaattacaatgcctcactgtctacccattagctgagtgagttcatacattcatctaatacttcagaaatctatttgatacattatttattaatattcttaagcttactttccatacactacaaaacaatgatgagtggacatacacaatggtagccaaatagccattcatacttgatgatgtgttattgtgacttataaatggctctttaaatgctctatgatttcttaccttgctttccttagctgaaacctcctgtcctcagcattttttttccattttttattaggtatttagctcatatacatttccaatgctataccaaaaagtcccccaaacccacccacccccactcccctacccacccactccccctttttggccctggcgttcccctgtactggggcatataaagtttgcctgtccaatgggcctctctttccagtgatggccgactaggccatcttttgatacatatgcagctagagtcaagagctccggggtactggttagttcataatgttgttccacctataggattgcagacccctttagctccttgggttctttctctagctcctccattggaagccctgtgatccatccattagctgactgtgagcatccacttctgtgtttgctaggccccggcatagtctcacaagagagagctacatctgggtcctttcaataaaatcttgctagtgtatgcaatggtgtcagcgtttggatgctgattatggggtggatccctggatatggcagggtctacatggtccatcctttcatctcagctccaaactttgtctctgtaactccttccatgggtgttttgttcccaattctaaggaggggcatagtgtccacacttcagacttcattcttcttgagtttcatgtgtttagcaaattgtatcttatatcttgggtatcctaggtttagggctaatatccacttatcagtgagtacatattgtgtgagttcctttgtgaatgtgttacctcactcaggatgatgccctccaggtacatccatttggctagaaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaactgccagactaatttccagagtggttgtacaagcctgcaatcccaccaacaatggaggagtgttcctctttctccacatccacaccagcatctgctgtcacctgaatttttgatcttagccattctgactggtgtgaggtggaatctcaggtttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctaatttaggataggtaaagatcctttccaatctgttggtggcctttttgtcttattgatggtgtcttttgccttgcagaaactttggagtttcattaggtcccatttgtcgattctcgatcttacagtacaagccattgctgttctgttcaggaatttttcccctgtgcccatatcttcaaggcttttccccactttctcctctataagtttcagtgtctctggttttatgtgaagttccttgatccacttagattttaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctatgccagtaccatgcagtttttatcacaattgctctgtagtaaagctttaggtcaggcatggtgattccaccagaggttcttttatccttgagaagagtttttgccatcctaggttttttgctattccagatgaatttgcaaattgctccttctaattcattgaagaattgagttggaattttgatggggattgcattgaatctgtagattgcttttggcaagatagccatttttacaattttgatcctgccaatccatgagcatgggagatctttccatcttctgagatcttctttaatttctttcttcagagatttgaagtttttatcatacagatatttcacttccttagttagagtcacgccaagatattttatattatttgtgactattgagaaggttgttgtttccctaatttctttctcagcctgtttattctttgtatagagaaaggccattgacttgtttgagtttattttatatccagctacttcaccgaagctgtttatcaggtttaggagttctctggtagaatttttagggtcacatatatactatcatatcatctgcaaaaagtgatattttgacttcctcttttccaatttatatccccttgatctccttttgttgtcgaattgctctggctaatacttcaagtactatgttgaaaagatagggagaaagtgggcagccttgtctagtccctgattttaatagttatagatgtgtgctttccttcttagtgtactctgaaaccattattaaaagattcacaaaaaattgttatagctctgtccttgacagaaagcagatgttgccatagacacaggcttaagtttgtgaaactatataacagggttaaagatcttgagaagtatgattggtgcccatcagcataaaggggaatggatcttcaatgctcctgcccatactaagacccaccaagcacaaataacaggctaagcccattcatccctaattgacaaggacataaacaattttacattagttaaaaaagtttttttttattctaagtttattttctaattatatattctcatgattacagatgtatgtgtaattaaataccatgtttggacatataatggtaattctttataatgattatatttatatagtaaaattaaatgagaatacctttatatagggttgtattgtagcaagaaatggagtctataaacaactggttttatttctgttttaatgtagcatgctttgagcaccttttctgtctattgtgtttttaaatttttctttaattttttgagactataatataattgcataacttttgtcttttttttctctctccaaatcattccaaatatcctccttgttctgtttcaaaatcatgacctgtttttcttcagttgctgttttatagagattcacaagcacacacacacactcactcacacacattcataaaaacacacacttgtacacgcacacatttacacacacatacacacactaataaatgcataagtaagcattctcaggcttataatattacctatatgtacatttttcaggtctgaccatttaagatagtataactgattaatgtgctctcaaaagactatttcccctactctcagaaatcattggatgtctgtacttctttgtgtgtagttgcatcatcttgggctttcccattcactttgccatttctgctgttgtgttccttattcagccattcatgggcaatcatgttaatgagacctaatgggtatagcttctgacattcctaggagacatgttctcacacccaaatctatttttctgttaagatccaccactccaaattcattttgtcattagtatgggtcctcaagccctttattcatcatccagtaatccatagacgaataatgctaaagcataaacatcagaatctgtaaatagtcatgcgtggtaaatgtcattcccacttcctgttgaactaaaagttatttttaaatggggatattaggttaatgaaacacacctcttggtgaatctgcaaggtcatatgcacaagcaattagaacataagggcattgatttaatgaagtgtttgatggatttgatatctgaatacattattcagacttaaaggaactatgttagatgaagccaggttagagagaattttgttccttggaacatttccttagaagttgtatttttctgtggccgattactctgtctccaccatcctactttctgtccacgtgcctaagtcctccctttcatgatggagtgaaacctttcatactaagaaaaacaaaaatagtcttcctcaaaatgtttctggggggtcctatgatcacagaggaatgaatctaacacaatacttcagtttgaacacattgagagagagaaagggaacccttcatttgcttttctctctgtttgttttttttttttttatcatattatgtttgctcacatcagatgaataaaatgatacctattcttattagtaaggccatttcttctctcctcaatgtacatccacatcaacactaatgtcctttgaaaacagccttagaaacatccagaaataaaattttaatggttctaccagtactactaacccagatgacaggaaacatgagctattattctatttcaaattctagtatatgttataagcaactacagttcacatgtactcacaacacaaatatttcttctccattaagtctcatcaaacagctttaattgttggctcctgagacactgtgtcaagttagacaatatctatcaagtgtctgtgcagcctattttaaatccttcagtgataataaacacactatgttcaaatgcagtctgttctatccttggatagttctgagagctagaaatgtttctatgcagtactataattgcatttcctgtcgctgcttactttggtgcttgttctgtgccttaaagcacataaaagagttttaattacccaggaacaacgaggaaaccttgattcctgtccaggtccacaaatctgttctcttcaaatccaacacctcatatccttgcagtgtggtgggtgcgacatgtcttctggacacagcgctgccaagtttgctcttctcaccctgcttgctttaaccatatgcactggtatttctgctgcatgtctttttgcttttagtcacaaagtgttgagctctgttctcccatgacatcactgcatgactagtttgcccaagtaaaacaaggtttaattaaatcttaatgttgtgcccactctttccagagctaactgctattttcacttcccctgccattagcagaatacataatgagagagtgtggagcacagagtcagccccttgtacagagagtagcattttgtcactcactcacattctctcactgggcttacttttatgtctcactacaagcagcctggacgaagagattatgtgtgtgttttcttttaggatatgaagcagcacagtatgagaatattatttaggagtaagtaaggaaagcgttcagttaaaaacatgtctaagattgagcatgtaaatctgattttaatctcctgaacccactgaaaagaaaatatttaaatgcggaaggaaccatgtgtcttggtaaccaccaatgggaaagcagagatagatattaagatcaatggggctcactgcctagtcagccttaccaaatcagtgtgtgggcagctgagtgagagattctgtctcaagaatcaagataaagactgaatgaaggcgataccttacctctgcattcacatatacacaaacacacacagataagtaagtgtacaaccatccacacccacaatggcatagaaaaaataggggactaaaccacatgagaataagaaatggacaaaggtcgtattcagtccatcagctttgggagtttctacttccacctgctgtctggttgctttttttccatgcgtacaaactgttcaaatgaaaatctttactcttctatgcaaataacctataaaatattgtctatttaccctgacataagttcttcattgcttttgatttttaatgtctggcaaagcaaaccaactaccaacaacaaaattacataattataccaccaaggtaaccttggggtaactaattttccaatagggtcataaatcttcaagagtgatttaaaaattggtgatcccataagactagtataacatctgaccaccatttccctacaaaaatatactacaacctatgaaaccataggttgacatattcacgcagattggtaacaaattcagctgtcttccaaccaaagacaaatgtgaaagttactaatttacaaagtgtggatttataacactagctcaatgaacagccaaacctatatattactttacatgttaatattggctattatgttatttaactctccttatttccctgataagtaagaattgttgagagtgactacatagacctaactccatttcagataaacaaaacaaaacaggtacaaaatttgtccattcaaaggtaacagaccatgatagtataaaataaaatatttagttgcaaatgtctctattttcaattttcctaatcaaatggaatcattttatcatgtatatggagagcgttcagtttgtgtagtttttgtctaccaaatgagtgagttttcaagctcattagcatgtgtaaagatggtcacatcagtttacataatgattagttctgttgttttactcaaaataaagcacccacaattacaatttgaaaacagaataattcttaaaaaaatttaaaagtgttgaattctttatagatcaaacatgaaagtgattaacttattttcttcatctttagtgaagcggttccagatttgatgcatagtgtagagaagtattttttttcagttgatattgaatatattaaataattaggaaatgcacaaataaagagtataggagattcaccacggaaacctagctcagtgtatggataaatcttagcacatgttaattgagtgagtggctgatttaaggacttgttcaaccgaactctcagtattcaagtctaggacattttactattcttcaatttttaacatacatcataatttctatgattctaataactaatagaggtccctttccaggtctttcattttctgggctacaactacgtagctcaatgaatttgaagcaaatttcagacactgatatctctcatttggatcttcacatgtgttcatgaaaaatgaccactctatgcagtccagtcactttacatgaccccacaggcagaggttacaatacagtcatgagcagcctctgatggaaatgatgctgacacagcagctttctgaaaggctctgtagtgtagtcaataaaaggctcacatttcttctgatgccatttctaaagctgctccttggcaacaacagtgagcctctatttggagacacaggtacctctaccctctacactcagcatagaatttttgccacaatagcctctggcttcaaaatcttttattattattattattattattattattattattattattattatctttaatctctttttatagtccagtcattatccccctcctgttccgccctctgacatttcctcttggcattccccatcccttgtctccaagaagatgtccccaatccccagactcctcccacaccattccctgattcccaagtctctcaagggttaggtgcatcttccctcattaaggtcagatcagagaatcctctaatgtatgtgtcaagggtcttggaccagctaatatatgctgcctggttggtggctcggtgtctgagagatctcaaggttccagggttgttgaaactgctagtcttcctatgaggttgccctcctcctcaactccttccatcctttccctaattcaaccacagggattcccaacttcagacctaaatactaaaatactttttttattagatattttctttatttacatttcaaatgctaacccctttccacatttcctctctgaaaatcccctctcctctcctccctctccctgcttctgaacccacccactcctgcttcctggtcctgtcatttcccattttctatggggcatagaatcttcacaagaccaagggcctctcctcttattgatggcctactaagccatcttttgctacatatgcagctagagacacgagtcccaccatgtgtttattttaattggcagtttagtcccagggagctctgggggtactggttagttcatattgttgttcctcctatagggctgcagaccccttcatctccttgggtactttctctagctccatacttcttatatagtcatgcttgtaactgtattcaagtacaaaacttttgtacaatctatgctcagcatgcaatggcattccatgagttctcctgaggcagactgcacacttagagttgtttcatgtacttgtgatttttctctaatcaatgaatgtagaatcactaatagatcacacttgaggtgccacatacagcttaatgattactttgggcctgtgatgtccttaagttgtatcactatataaactgtgtcacagttctaaccaaattagttcacttacactgagtactggtaatgtcagtgaaaaacttatttctaacatttgaagtggcaataaatgacacattcagctgatttttaaaaagccatgtttgatcctaatgaacatcattactttagtgaccagcaattctcaaattaaaataaattagtcactatttctcaaatgtggcttttcaaatagcctaatacatgttcatttaaccgatcattacctgataccggatctcttctttctcggggtaaaattgaaactagtgggattcttataatctatcttttatattgaataagcttcaagttgaatatattttaaagccaaggtcagttctagaattctacactgttgttcactctgtctgggaaacagtgcatcttaatttttttttttttacaagcttgaatggtttcaaatttagatagagtcacaaattcttgccaatcagtgtatcataaaaagaaaatgtcaagctttgaatctaaagagttgtatttcattgtaggattcattcacttcagggttaaaaaaaatgtccaaacacacaatgcttactagaatattaaccaatcaatttccaaatatttttgttactgttttatagagcttttcttactcaatagttcctcctcatgtattattaaaattagatttctggtagggaccatgcctttgttaataatcttgctatcataggatctagtactcttcttgaacatattaggtgtttgtcttagtcagggtttcgattcctggacaaaacatcatgaccacgaagcaaattggggaggaaagggtttaatcagcttacacttccatactgctgttcatcaccaaggaagtcaggactggaactcaagcaggtcagaaaacaggaactgatgcagaggccgtggaacaatgttcattactggcttgcttcacctggcttgctcagcctgatctattatagaagccaagactaccagcccagagatggcaccacccacaaggggacccccaacttgatcactaattgagaaaatgccttacagctggatttcatggaggcatttccccaactgaagctcctttctctatgataactccagcctgtgttaagttgacacaaaactagccagtacaattgaccacttgtcaacttgaaacacatcactagtaaacctcaacccttagcttcttattcatccccaatatctaaacaactttaaatatcccacagtctttacatattaaaagttcaatccttttaaattatccactatcttttaaaatccaaagtctttttacaattaaaagtctcttaactgtaggatccactaaaatattttcttccttcaagagggaaaaatatcagagcacactcacaatcaaaagcaaaaattaaactccaactgtccaatgtctgggatccaactcatgatcttctgggctcctccaagggcttaggtcacttctccagccctgtcctgtgtagcacacagcttttcctctaggctccagatgcctgtactccactgctgctactgttcttgatggtactgttctcatggtactggcatctccaaaatgctgttgtcttccactgtaacttggcttcaacaatagcctctcataggctttcttcatggtgccaagccttacctcctttgcatgaccccttaaatcctgggcaatcaattgcaactgaggctgcaccttaaccaatggccttgcatgacttctcacagtgccgcgcctcagctcttctgtcggacccttcatgccttcaaaaccagtactacctgggtaactcttacacattactaagtccagccacagcacaaggtaaaaccttggctatctctggaacacagcatctgtgctctcaggaaacacttcccagaagatgtcacctcaatgatgctggtctcttcttaatcactgctaatttcttggctccagcaaaccagcatcaatagccccagtaaggaaagttttcactatagtagttctggaatcttgttgatcacagctgactcttcagcaccagctaaccagaaccacaaaatcttcacaatcaaaatagcaatggccctgaaaagagtctttaatcttccctctgaaatttcagaagtcaggcctccttctgcactgttctcaatattatcttcaaggctcttatacaacatcccacagagctcttaacactgaatggatcttctatcccaaagttccaaagtccttcctcagtcctccccaaaacatggtcaggttgtcacaggaataccccacttctggcaccaatttgtcttagtcagggtttctattcctagagaaaacatcatgaccacgaagcatgttgaggaggaaaggatttattcagcttatacttccatactgctgttcatcaccaaggaagtcaggactggaactcaagcaaatcataatgcagaagctgatgcagaggccatggagcaatgatcattactggcttgcttcccctggtttgctcagcctgatctattatagaacccaagactaccagcccagaaatggcaccactcacaagggggacccccaacttgatcactaattgagaaaatgccttacagctggatctcatggaggcatttccccaactgaagctcctttctctatgataactcgagcctgtgttaagttgacacaaaactagccagtgcagtgttcttgtacagcttttaaaaagtataagtgagagttgtaaagttcagataatatatggtcagctcacatatcccctttttttccacatgaaaagaaaagccatgagtgttgggatcatttaagtctaacattatccattttctgtctgtctgtctgtctgtctgtatttttgtatgtgtttttaatctgacatgtaagggtccactttatcatctaacaatgtaataaagaaagacatgctcactttttatccattcactgcactatatcaggataaatacttcttaaatatgactgacttaaagcccaccaataattctgcacctgtttaattttaaggaaagcatccaaaattcttagcatattaaattgtttgtattaattaacccctaaccaattatgtatactaatttgatatttcatatatacatatatacacacacacatatatatacacaagatatattaatattatatatactccctatatgtattgtgtgtgtatttaaatttgtgtgtgtgtgtgtgtgtgtgtgtatgtgtttaacttatctcaaaatcatcattctgcattccagttcactgaagagattgtataagattctctcagacagtctttcctgactttgatacctgcttttccttatttgactaattttaatttgtattttaaggcagcactcactgtgacatctttaatcataaactgtttcatactattctgattctgtgtatgagaacatagaatagaaaatgagtttctggaagaagaatgtgtgaagatttaaagcagcctgctgtacagagtagggtctccagaaataactaatgaatagctataacttcatgaagaacttataaactatcctgctaaaggaatttccattcttgacaattatctacagaaaaatgccattgctgaacacattttacattcttcatggtaaagaaataattgtttcactgttgatgtcaatatacaccttcaaccacctaaaaattatctggcactagaaatacatgagtactggaatctgatgatgagactagagtgtgagtcaacagaccacattccaagttggcaataacagaacccaagcatccaaagctcataattcaagttgagcttctcattaatctaaatgttaatgtaaacataaaatgtggcatattgatttggaactcttttatatgaatattgtataactgagctctctaacagaagaatccaaatggacatctcttcacaccaattgatttcaatcaagtgaaaatttgactaacttttattctttttctttcattgttttttttaattttgatttgctttgtgtatgtgtgtatgcacacccacacacacacacacacacacacacacacttgcacacacccacacacacacacacgcacacacacaacacacacacacacacacatacaccatttgcttcactacaaaatcatcgcaatacagttccctaaacaagacctgcacaatggcatggcaacatgaatgggggaaatttataagacccggccccatgtgaaacattaagacaattgatggctgctgagggaggagggaggagccttctgataagttgtactcatatcatatgtagacaaataagtataagtggattcctgtgtgattgtgtgtgtgtatgtgactgtgtatgtgactgtgtgtgtgtgtgtgtgtgtgtgagagagagagagagagagagagagagagagagagagagaggtaacaacaataagcaaggaagaagtcataaatttgagaattaacacaggagcataagaggtattgtagggggagtggaaggaatgaaaatgatgtcagtacagtactcatacacgagatgcttaaaaataaaataagctgaaagtgtctttgcaaaatgagaacagtaaccttggatagttttgagcacatcagtttcttaatctgttctttacaaatactgaatggagagtttagtagtttgctttttccttgtttttctgaggaaggaaaaaaattagagtatcaagactgattagttgagtactgtgtggttgataaaaattgactgaattttctcctattgggttatatttttatattaatattaagttgtttatatatgcttattaaacacatatacacaagcatgtgtataatggaaaatgaaatttgcaaaagacattatattaggtcaaccacaaataagtcatagagatgattatgatgattatggtgtagacaataatgttatctgtaaactctttccagatactaattcacccaaggaactttataaaattgtcgtagtttgattcctgcaacagcaggggaaggaattgtcacttttgggattataagttaagataaatagggaaaatattcctaaccccttctcaaattctgaagcaactgtgttgaggccaatgaaatcgaatatagggaccactagaaggtgagtcagtgagtgtggccaggggaagtcatccaacctcgaactgccaggatgcaagaaatatgaagtagaggcacatgcgctgggcagtcattcccatctgccagctatgctgcttttctcatgcttagaaactaaactaaacatctatggcttggtgtcttaatcatcaaaagagaaaacacggttcatgtttttggttttttcccagaatagttaggatgcttaatttttaagtactgtggacagtttagttcagagtctgaggcataaaacacattgacatttcccttctttctttcagcaatggcaggaaataaatatgatcagtcagtataaaaattctccttgggaataatgatttcagcaaacattcggttcttaaatgtaggaaacaattctgtttgggaaagacaaagacatgaaataccaattagatatgcatctttgatcagaactgattttccttgtttggagatagaaacaacaaaaaaaaaaaaatccaaaaccaaaccaaatctagccaaaacaaatgaacaaacacatgccacccctgtaagctattttgtgatgctctctcaatatttttctgatctcttcagagttcaaacctttgtcgctcataagcacagcaagacagctgcactaccaactaccagttgcaacaaaattattttgattttctgatttaaaaaaaaatgctaaatttcaacaagcagacttttgaggttgttgttgtttgtttgtttgtttgtttttccaaattggtttgtgaaccccaggtcaattgattagagccaccttggtactatttgtctgtaattaattgtatatagacagggaagctggaagatgtttgttcatagtttataaaaatgccctcatgcaaacatgagtgttttgccccaaattattactgtaacaaataatgatttttaaaggaaaatgagagaacttgagagaaggccacaattcagtctttttttttttgtcttgagattgtgttttatgtgcacaagaatgacctccaactttctatatgcccaaaggtgaccttgaactattgatcctcctgtttgcatctactgaatactaagacgacaagtataccctacttcaactaggttatgacattctaggaatcaaacccagtgcttcatgcatgataggaaagactcttaacaattgagctacacctctgggtatttaaaatattttttaatttaaaaaaaaaaacaacataatttgggttggggagcagggagggggaaaggtataggagattttcatgatagcatttgaaatgtaaattaagaaaatatctaataaaaaattaaatactctctgaaaaaaagaacaaccaaataaataaataaataaataaataaatgcatcagttctctcttttctttctttcttcctactcctccaaagtctaaagccccttccctcctaaaattgtgctctcttcttctctagcaattatacatacatacatatgtacatacatacatacacacacacatacacacacagacatacacacacacacatacacacacacatacacacacacatacacacacacatacacacacacacacatacacacacatacatacacacacacatacacacacacacacatacatacacacacacacacacatatacacatacacacacacacatacacacactcacacacacacacacacacacacacacacacacattcacacacacaactacatcctgctaagtctgtactgtgttgactgggtatataattttctaggactgactacttcactgattttggataaccaatgagaagacccatcactggagaagacaaaactttcactcccacagcaactgttacttgaatgtagcttatcatctagggttgatggcccataaagtttcttttaactactctgggatatttgttgtaattatttaagaattgtttgtgcaaccagatggttgtggctttgctgtcatggctggaaggcacacggttagagcagatttccagttcttctggcttttaaatacgccaggtctctcactggagatgttccttgaaactcagataaaggagttatgttggagatgtatccatgtgaatggactcccttgtctgtttttaattgcatttgactatgtgctgttttctatgtcatcattcagttggggaaaaaaaagagatgctcccttgataagtggtcagatctatacttacctatagtattataataattatttagagtattgttaggaattatactgctctaggaaagtagaggttgcaggctctcctctaaaatccatggacatagtaacacttttacacaatattcttcctgcttgaaggagagaactttaagattcagtgaagtttgggacttgcttcaaaattgcttactaactattgtatggaaaattgtatccagtcagaatgtttacttaaatatttttctttgcctatatttttatttctatattagactgatatattacaattacagtggagacttctggtactttttaacatactaacttgtatattttcataggaaaacatattgggaattgaacctgagtcttcatgtgtactaaccaagcactcaaccaccaaactacagtctcagtcctgattttctaatgttttaagtgtgtttagctattagagttacaacaatttattaactgcagttaaagtcaaaagaaaagaaaaaaaagcctctcatattttgcaaaactgttatttatacaatgtttccccaatagcattcatataatatacattcaagaataaaaaacactgaaatttgacagagaaatgaaaaactaatgaaatcaaggatgactaaacttgagcagagaagcatgcataaatatgtgtaacaggataattacatggacatgtatgaggagttgccttattttaccaatatttaaattaactagtcatgccgggcttggtggggcacacctttaatcccagcacttgggaggcagaggcaggtggatttctgagttcgaggccagcctggtctacaaagtgagttccaggacagccagggctatacagagaaatcctgtctcgaaaaaaaaaaatgactagtcacacagtagtgaacaatgtatgttctgagatttccagttttagaactctactatgaacgtgaaataagcaggcatatcagaccctagatgtgtcctcattcatatgttgtaatttaaaattgatctctgtattgttctctccaggtgtgaagaaacatcaccagtagagatccaggacacgtgttttacttctttgaattctctcaggaagagaagagccagaaagacccacattaaggtatgctcaattcacttgttatccatcttaggacttacataattgctgtatatgttagggagaggatgaggttgaatatttgtaaagaacacacaaatagagaaccagtaagagtttgtaacaaagacagactttctcacatttagtaccatctttaggtagacttgcttaccagggttatattactctttgtcatcaaagattaatggagggatctggcacaaagaacagagacatgattctaccacggttttcaccacttcctacaatattaagataatttgagttgagggggggggagttatagaaagagccagggcactgagatgcttcctcatttaggaaagatgttacatattcgcccatattttaatcggcttccttctagatgtgatgttttttcagtaccaccaaaagctctctctgttgctgtgcggctgctgctgatggcagcacagcaaaccacaaccatttgttgtcgtatccatattttaaatgtaaaaggccggtggaagaaattttttcgattgtcataatatactattcaattattagtcaaagcatttgtgaaggaaacggtttataaatatcataagtgaccttagccaatgccttaatataccagtttcaatggggatttgtatctaagaaaacgaatataattaagatagtgagaaagagtaataactttaaaacaaagcaaagtaactgtgtggatctaggactataaacaaaggaaaggatttagagcatgtgccaggacccactgcatactgaccaggcatttgtcagtaagtttgtggttttcaaacttcctaatgctataactctttagtagagttccttgtaatgtggtgatccccaatcataaaattaatttttgctacttcataattgaaatttttcttttgcattgagtcataatttaaatatcggatacatggggtatctgatatgtgaaccccaaggggtcaagaccaacagattgtgaaacactgctctcagaccaacaggacttatttatttcatacttttttctttagttgaggctcaaaaacattccattaaaagtaacttcactgtggtcatttgatagaattaaattttgggttatattcttacctgggctaaaatattagaagaaaaaatctaagagatttgaccatttggcattttattacagaagaataaatatttaatatactactccactgtagaatatcatgagtgataattaatcatcagaatcagataagtctactttcacgatatggaatctgtatttaatacaatttttgcttcatacagtttagtatgtgtagtatattacatgtaaacatgtagcaaatgcatgtttaacatgaaaaatataagttgtttgccaaaagtgggatttataaggtcatttggaaatttgattattagcaaagtatttttagttatctttcaagaatatcaaatggtttataagttaatcggaattttatttttcacactcaaacatacaaatctgaaaatgattctataaacttatgatatgattaaatctataaaagtcatcacctaccaaacttttatattcactgaaggagcagagactgctaaatgtctttgaagaatagtgaccatcgggaaggagaggatcttttatagatttaagtatatcataagtatatagaatcatttttagatttatatatttggttgtgaaaattaaagttctggttagcttatgaaccacttgatattcttgaaagatatctaaaaataatactcagctattaaaaacaatgaaatttgtaggcaaatggatggaattagaaaatatcatcctgggtgaggtttaaaaaaaaaaaacacacacacacagtgtgcattcactcataaatggatattagcccaaaaaaatcagaacacccaaggtacaattcacagaccagaggatgctcgagacaaaggaagacctaagtgtggatgattcagtcctttttagaagggggagcaaaatactcatgggaagaaattcagagacaaagtgtggcacaaagactaaaggaaaggccatccagagattgccccacctggggatccatctcatatagaaacaccaaacctagatactattgcagatgccaagaaatacttgctgacaggaggctgatatagctgtcttctaagaggatgttccagagactgacaaatacagaggtggatgctcacaactaaacattggactgagcacaggattcccagagtaggagttagataaaatactgaaggagctgaagaagttttcaacttatagggagaacaacaatatcaaccaacaagaccttccccgtactccccagagctcccagggacatggaggtacccatggctccagccgaatattcagcagaggttagccttgttgtacatcaatgggagaaaaggcccttggtcctgtgatggttaggggaatgtaattcccagtgtagggaaatgccatggcagggacatgggagtgggtgggtggataggggagcaccatcaaagaagcaggaagagggagggtgggatagggggttctagaggggaaactgtgaatggggataacatttaaaatgtaaataaataaagtattcaattttaaaaagtaaaagttttctttcaaaaaaacaaaatgaacaaaaacaaacaaacaacccccccaaaattgccaaaaatagaaaagcctgctttctcatcttcagtcaattcaagtacaaagcagaaatactttccatttaaaatgcatcaaaatatttatcaaaaaggcaccattttatagtaattcttcttagttactgttttacggctataaataaacatcataaccaacccagcttataaagcaaagcattcgattagggccttacttacagtttcagaggcttcgtcgatgactatcatggtggaaatcgtggtggcaggcagccaggcatgttgttgaagcagttactaagagtttacatcttacctacacgcagtgggtaagatggatgtttgaaaccacaaagtccattctgtgggccacaccttctcctacaaggtagtactttttaagccttcctaaatagtacaccaaacaaatatttaaatatttgaaccaatggggaccattttcacactaccacatttcactttctgggccccatagattttcagccctatcataatgcaaaatgcatacagtacaacctcaaagatccacatattcattcacaatcacaagactatgaaaaagtctaaagtccaaaatcttttatgagaaccaaggaaatcacttaaatgtaaccccatataaaagcaaaaagaaaattatatatttccaacataaaattgtgcagaatatacataaaaattccaaaagggaggaaatggcaagccgtgagaaaatactagaccaaattaacgctgaaatccagcagggcaaattcctaatcctgtacatccatgtctggggctatgtggctcttcagatctcccaccccttccagctttgttgaatgcagcacaatgctttctcttgacctggtgccagaccttgtctggaactcttcttggcaggaatccacagctctggccccttcaacttcttcaggtctccaacacaatataggctttaccttcacagcttcaggcaacagcctctcaggacctccctgcagaaagtcaccggccatatgtgtagcctcagcagtttttcttaacctttaaggaagattttccaacccctttacacctgtatcttttgaacaaagcctggagtacttggctaaagctgccaaattctgctgacttctagggctggaaactggtccttttcaagacatacattcatataagctttgaattgttaatagtttcttttgttgaataacctttaattttcacatgttggaagcttagctgaatgggttcttgccctgatgccacctcttctttcattccattccttctaaagcctttgcttaaacttctcatctcttgagcataggacatggctccaacattaaacatttcccagttctctttttcctcctcaaactgtacactttgtaatgctttagccctgcttgctcttttttattgtagagctgcaacaacgtgataactaatagccatgtgacacagtcaactctaggctgtctttaattaaaaagattttcaaattagtctcatgcagaattttcagacaagagaagaaagcagtcacattatttggcaaaatattacaagaatggtctctaggccaactggcaacatccttcccatctgaaacctcttcatcttggtctctatagtccacattgttctcagaattactgtcttccaggtatctactagaaatgccccaaaacaccaatgacaacactcaatctcctttctaatacaaagtctataaatgaggactcagtgaaaccaccaaacgaaaccactccatggctagaaaaataaaggttaactaaggttcaatcttcaatcttcgtctctcagtgaaagcagagagaagggcaaaagggaagtattgcaagcagatttcacatcatcagggtggggtccttcagctaataaatggtgttcagattgtgtgggaactagttgcccttgaccatggttgtagaccactggggaagataaagggtggtttttggttatcaaaacccctccttagatctgctttcctggtaaattgaaatgaacctgtgaagaaccttgatgttagtctcctctgaaaagatacaaacattattctacaggtaggactccaatcttaagatgcaagtgtttctttcttttttttttaaattgggtatttatttcatttacatttccaatgctatcccaaaagtcccccacaagctcccccacctactcccctacccacctacttccacttcttggccctggcgttttcctgtaccaagacatatagagtttgcacgaccaatgggcctctctttccactgatggccgactaggccatcctcggcttcatatgcagctagagacacgagctctggggggcggggggggggagggtactggttggttcatattgttgttccacctataggattgcagatcccttcagctccttgtgtactttctctagctcctccattgggggccctgtgatccatccaatagctgattgtgagcatccacttctgtgtttgccaggccccagcatagtctcgcaagagacagccatatcaagtgtttctttaaattaagtaaaagcagaactgtgctaattgttaaaatttcataactacagctaaatagtttctttaattaatagaataattattgatatgtatgtatggccattgaatttgaaatgaatctactttcttatttacctttatagtttgagagccttttgtgtacatgtggcatatgtgtttatatgtgtcaaggtgggtatctgtacatgtatgatcatgcaattggaagtcacaagtccacatagtttgtcttcctcaatcactctttattttattttaagacagtgtctcttcctgaaacttggtctaatgtttcagctagactgtctggaagtcttctctagtgatccatttgtttttttcttggaggatgctaggaaattaacttacagttacagatttttaccaacagtttccacttcctgctcctgtgtgatagccaatacaatatcattttaggttattataaaaatgaaataacaatttattgcatagaaaattaaatgaatactgaatttatttctaggagatgtattctaaataatatagtaagttcaaaaatattcaacttctggacactaataaatcacaacaacaaaatcacatgatgggagaacacgctaacttttattttccttaaaatatataatatttctgattaaatttagaattactttgtgaaataaaagcaaaacagtttctatagtacagtttgaatatttacagaaaatttcaaggatgttttgctaaaacatcattaaaaatcaaaggacattactataatatagccccttacttgaacaagtgacattactctttctcgtctgctatcaacaggcatcagcctgcagtttcgttacctatggacatctgtccagtaggagtcaggcctatcaacactgccacctattcttctttctgatagaaggactgaagattattgtgttctgaaaagttgttaattggacagggcaacagattgaaacctggtatgttccaaatagcagagtccggttcctggtttccatgcataaagcagtcgtgtacatgggtaatgggaaaatttattaactgttacttaaatggagttctgtttaatttttgtgaatatacatatttatatgtatgtatgtatatatgtgtgtacacacatgtatatatatgtatatatatactattattacaacgatgggatttttttcaatacaaaatttatagtttcttttccctagtctgggttgtctctgaactgtggctgtactgatacgggctgaactgttactacaaccgattcatagagttcttggttaataaaacaaacatgcccacactcccgtgactctgatcgtggttagcaaaccattccccataagtctaatatgggcctacactgggaaattttctgtccttttgtatcccctcttcttgctatttaaataatatgctaaattcaaacacccagtggtagtaagagaacactttcataaaataaaaagtagatcaatggacctacatgtgaaaatggatatgtgtgtagatagagaggcattggattgcattgaaagtagttacaatatgttacaagaattcattttaaaatatagaacattttatgatactatatatgtacataataaacattgaaataatatttctaattgttctattactttggatatatacagaagattagatttaaataaatattcatttcaaaatactgatacaaaaatgagtaatatcaacaatttcatacatatttgaaaattatgtataacatgaatatacaattttatatatccataattctattatatatttcttttaagctttctattaaaaaatagagattaaataaacttataggtatatagatgggaaataggatatagcaaggtaagaaaatgatttcttactgatatatttgcacatgtctatgtgtgtctcaaaaacccgtgcaaggcccaggcctgttctctctttatcaccaaatgagaatgtgcttcttggctgcttctaccatgctgtatttccatgttctccacaattatgataataaacaacctttgaaaatttaagcaattccccctaataaaatgttttcctttataagaatggctttggtcataatgacttgtctcttcaatagagcagtgactaagacaaggagaaaagacaacaatgatcttacacaggaccagaccctgcattctacaatagcaacttgccacacaagaagcgaaactcccttaattgaattgtaggccttccaaacagaaggaaaccatctttagtacagtaaatatgcctagtacagagtctatgcctaggaagatcatgagtcatggggagaaccaactgttgctttactcagatctttgtaatgcagattattcccaccacagacatgtgaaattatgaaattttcctggaaaagatttgttccatgactcccagagttggcccacaactgtcataataatttctgctcctttacatcaatcatagaaatgtgtgcttcaacatctacaaactacacaaagacacagagacaaataacacaaataaaccctttggataaattgcagacaatattaagcaaaaagaatctgtgtaacttccaaggcttgggcctgaaaataacctttcaggatgatagagaaggaagagataatctctgtattcttcagcatagtgacagttttggagtggtaaacattgggtcaaagtgagagatgtggatgagtaacagaaaccagttaaagtaattgtatatcaattgtgcaagactttatctatcatatacaaaggggaagatagttgttcactgaatatgctattgcattagtgggaaaactttggttacagttataattataatttaaagactgaaaacaagtaaattcctttagtgtgccattttatatagatactgacactgtcccatttttaagaatattaaatatgccaccactgtctatcaagcttttctaaggtatggaaggagtcctttgatacataagacaaagatgtgacctgtgtcttcctctctatttcctaacaatgtttcattttacagttttgtgtgtgtctatgcagggtcatgagacgttaataatcccttttggaagttttaaatgaaccttctgttcacaaaatccatttactctaatcacttgttattgcgattgtatggaaacaatggcagactgtagcaacagtgaagtccttcctatgcatatgactgaaatttgacttctttaactgaattccactattgaacaattgtttccttttcacccgaatttcaaggttaaagaccttgaaagatagtagttgatgcagtcattcaaattgagtcaaatcagatcaaaatatgtgcaaagcaattcaaattctctgaagttttggctgctttggcttatatggagggtgtttacagtaagggtttacatttcatattaatgggaagagtttattgctttttgcttatgtagttttatactgtttttctttattttgccttttacaactaatatagcttaggctagtcttattagacagctgagataatcttgagctgctaatcttccagcttctacacccaaagcaagaataaaaggtgtatatcattatgcccagcttgtattagagtaatataacaataataattcaaaatggtgatataagttgcagcaagggaggtatctcatatgactcagaatatcagcctttttgtgtgcttttattcactttacatcccaattgcagctgcagttcctcttgtcctcccagtctgatgcttgcaaatcactccccttactacccactcctttgttcctcagagaaggcaaacatcgccttacgtatcactccaccctggcatatctagtctcagtaggcctaagcacacatcctctctcactcagtatttttttagaactaaatagggaggttggaaagttaggatcccttgtccaattctcttcctttgcctatagcacaagaagcataactgagataaagaagagataaatgaattcaatggctttgaaaaggaatgccatacaaaagaatacagcattattttgtaggaaaaaacaatctcacttcacatgtgctgtgtttggaacggtagccgctgggaaagctgaggtgaggagaaaatcacctgctaaggctcagtcactccacatcgcgtttcagctgagagtgcttaaaaacaatacacttgaggaagcaagctatttgcagttatgtttatacatgatcctatttactctatctgtgaggggagattttccgtcagagttgtcattgttgtcattaagcacccactcattcattcaatgcatgtttattgaacattaggccacagcattagacacgggggttacggagtaaataaatgtccttttctgtgaaaggaagcaagaacagaccctgggaatgtaacatcttaatggtagatggtagaaacgggctgagcagatgtacattaacataaagatatatacgcttgcccacatatacacatatgctatcttgccacactgagggagagaaatatcaatcacactgtagatattaacagaatgtctgggtggcttccgtcttcatcgcagaaaattttatggatgagttgagttttgaaaactttggaaaaaaatgtcaggataaaatatggtggtgtagaatacggagacttttactgtttttgtgcagagagagctctctgaagacccaagagatgactccgttgcgtggagaactatcatttgaatcagcaatcagctcaggtgaagcattctttggatgatcaaatcagaactaagtctttgcattacagaatgtttctagaagaaatatcagtacaagaattgcacattaggacttcaagtctttggctctgagttcatacataataattatgacaaatggaaacaaacctaagctgttgaacacactggtgaaatttctgagctctgtgaattattttttattattactgtatgtgtaaggcatgtatgaatatgcatatgtgggatattaaatccattcaagagtattcgatgaccagtgctttgattgttcctctatggttctttaatttttaagacagggactcacactgaacttacaaccccatttcctctgcctagaattactagacagcacacctcagggatgcatctatatccatgccatcccactccctctcatcctcctgcccagtgctattaataaggcccatactatcttacattattgctattaccaatatgagcatagggtctcatggttgtgtgccaaacactttagtcattgagctatattcacaacacaaataaatacatcaatgaaccatgtggatgggaatactttacaaaatcccaccactagatggagaattataggccatcaaaggctactgagacagggaaaaacagattcctccaaagacaagtccctgatagccactcccaaatttcggacataacacacacacacacacacacacacacacacacacacacacacacacacaccagttcaagtagtcaattgcttttatatctatgtttgactctttatctgtctatatatgtgtgtgtgtgtatacatatatatgtgtgtgtgtatatatatatatatatatttacatatatatatatatatatgtgtgtgtgtgtgtgtgtgtgtgtgtctgtgtgtgtgtgtatgttcacatataataataattaaaaagaggtcataaatttttgagggaaaggggatgtaattaaaagaaaaaggtaggaagaaagaagtggaaatgatgtaaatccagaactcttgtatataaatttttttattacttttagttttttacaatccagccattaccctctccccagtctgccctcccacagttactcatccccccagtctgtcctcccacagttactcatctccccagtatgccctcccacagttactcattcccccagtctgccctcccacagttactcatcccattcctcatcactcctgtctccaggaggatgccactccccacaagatcttcccactccctggggcctcaagtctcttgagacaaaagagcatcttctcacactgagacaaacccaggcagtccaccactgcatatgtgttgggggccttggaccaactcctttattttggctggttgatgagtcagtatcagagacctcaagggtgaaggtgagttgagactgctggtcttcctatgggcttgacctccttcacagcctcttcctgcatttccctaattcaattataggggtccccagctccagtccaatggtttggtgtaagtatatgcatctgtctcagtcatctgcttgttgagcctctcagaggccagccatgcttggtgcctgtctgtaagcacaccatagcagcagtaataaggtcggactttggagcctccccttgagatgaatcccaagatgagccagtcactggaccaccttttcctcagtctcttctctatttttgtcactgtagttatttcagactggaacaattctgggccagaatttttgactgttggatgataaccccatgcctcaacttgatgtcctgtctttctactggaggtagactctacaagttccctgtattagtcagggttctctagagtcacagaacttatggatagtctctagatagtaaaggaatttattgatgacttacagtcggcagcccaaatcccaacaattgttcagtcacagctgtgaatggaagtccaaggatctagcagttacttagtctcacacagcaagcaagcgaaggagcaagagctagagctagactcccttcttccaatgtccttatattgtctccaggagaaggtgtagcccagattaaaggtgtgttccaccacacctttaatcccagatgaaagatgtagcgcagattaaaagtgtgttccttaaactcggagattcaatcttctggaatccatagccactatggctcaagatctccataccaagatccagataaggatctccaagcctccagataagggtcactggtgagccttccaattctggattgtagttcattccaaatatagtcatgttgacaaccaggaatagccactacattccctcttcccactctttggcatttcatccatggtccctccctttgagtcctgagagtctcacacttcccaggtctctggtacttttagagggttctcccacatcttaccctctgtggtcacatatttccatttattatatgtccctcataatgtctttactccacccctcatacctaatcaggttctccctttcccctccccctgtcctctcccatccaggcccctcccttctctgctcccatgattgctattttctgtctccctagcgggattggtgtatccacacttgagcccttctgaagcttgttaaccttcttgagttctgtggattgcatcataggtattctgacctttttggctaatatccacttattactgagtacatactatgcatgtcttcttgggtctgagttacctcattaaggatattttctagttccatccatttgtctacaaaactcagaatgtcctcttcttaatggctgagtagtatttcattgtgtaaatgaaccacattttctgtatccactcttctatcctgtgacatttgggttctgtccagcttcttgctattctaaataagtctgctatgaacatagtggagcatgtatcctttctatatattggagcatcttttggggtatatgcccagtagttgtatatctgggtcctcaggtgcaccatgtccaattttctgaggaacctccagattgattgtaccagtgtgcaatcccaccagtaatggaggaatgttcctctttttccacatccttgccaacatgcgttgtcacctgaggttttggacttatccattctgattggtgcaagatggagtctcagggttgttttgatttcatttccctgatgattaatgattttgaacatttcttttagtacttcttgaccattcaagattcctctgttgtgaattctctgtttagctctatatcccatttttttattgaattatttgatttttttgaggtttagattcctggaattcatgtatataattttcaaatccctaaaaactggattaaaaaatacttttctttgaattcttaatgaattgtttaataaaatacctgccacataatgacacattcccattatatgtattttagattgttatcagtaactttgttcttcaataaataaaattaaaatttacagtatgcaaatcataaacatattgatgaggatcaataatacatattttcattttgtttccatcaactgggataatctaagtgttgtatgatgctataatttgtgcaggtgatatggtggactcccaccatacaatgtggactcccacctaaataagaatcaaaggctatgagacaccattttcaactaatcacattgacccatggaggtgctaatctagtctatatttacccatatatcctatgaaactcaggcaggtctccttacacaatttttctcttctcaaaaccaccatgaaatcactctacctcgttaagctacttttaaattacccaatgtataaattgttttgttagtagtaaaacttgaacctgacagagtactcagtggatgagaaagggaatgaagaggataaatttgttgttgttgttttgacagcatttttttaattaggtattttcttcatttacatttcaaatgctgtcccaaaagtcctccataccctgcccccccccactccccttcccaccctctcccacttctttgccctggcgttcccctgtactgaggcatataaagtttgcaagaccatcctggggtactggttagttcatattgtttttccacctatagggttgcagacccctttacctccttgggtactttctctagctcctccattgtgggccctgtgttctacccaatagctgactagagcatccacttctgtgtttgccaggcaccggcatagcctcacaagagacagctatatcagggaggatgaccttttcttacagaccttccctctctgtactggaatgtttttggcttgggcttgagctggctttgtgtgtgctatgacaattgctgtcgttttgtatatggaacttccctaccacatgcagaaaacactgtttccctgtagtcatctgttgcctcaagctctttctgccttatcttccacaatgatcctagcattgggaggaggagatagtatgtagatttctcatttcatgctgagcattacacagtctcttattgtctgccatttaactagtcagtgatctctgagtagccatctataattgcaaaataagtttctctgatgaagactgagatttgtccccaatttttttatgaagataagtcattagaagtcagtttaacactatggctgcttaatggaactgtaggtcatggcctctagaaggaaaaaaaaaacaatgatgtttcttaaataaggttacctttctgtaatcaaacacacccctttgctgttcctgggtatggaggcatcattaatatttcaccattgtcaattcttcatccattcatgtattctgtattgtactaataactttgggataacatgtggcacatctactgatgaaatattagttagcagaaaactaataatattttgacatgtgctataatatagataaagtttgaaaacatggtgagtgagagaaacaaggcacaaaagattcatggtgatattccattcatatgaaattttgggcatgatatgatatgatgtgatatatttaagtttgaatttagcttaagagaacatatgcaagcatataatcgattagtggttgcttagggcagattggcaaaattaggactgatgggctcggagattttcaaaactggaacaagcagattcatgaatgacactctggtcttcattgagcacctggaagtatactatgaaaagcagcaagtttcatatgatgggctaattggagatggtactagcttaattaaataaacttattagatttttgcattcgccttatcagaaggcagatacatttggtaaaccactatgcatgtattaattatacaaatgaatttatctttcaaagcaatatttcaaaactagttttattttaactaccattgtatgttactgtgaggaaattattttaaaaagaaaatatactttactaagctatagtgtcagcaaatgcagagatagaatttgaacccggttgttcatgttactcccagactcattctgatcttatattttctgtgctccaggcacatggaagtggccactatgaccagaattccctttgttctcacaatatttaccaatattttatatggtatgcattcccacacattaatatgttggaattgtaacttctataagagtactattagaagcaaaattaagggggaaatggttaatgctgtatattacagtaattacaaattggaatatcaaaaacattaagggcatgaactggtttcttaaaccacgtaataagagagcattagaccagcaccttagaagcacagaaaagccttcaccatatatcagatctactgggaatcttagacttccacttttacagaaatttaagtaatatatttataaatgttgagtttgtagcattttcacagaataccccaaatgttcagagaaataatggtgatatcagaaatgtgattctgcattaatgagcacatcctgaaatcgtctttgcaagtgggttaaagatgaaaatggaagactcttgaaatgagaggtagcaaggtccaggtaccgtgaaactgactttcattttgcaagccaaggctgtgaccacagcagaaatggcagtaactcaacccctacagatgttggtagtggctcttctacctccatcagatggcattttctctatttggataatggtgtcctatgatgcagctgtgataaatgataatcctgattctctttagtacctgtcccgttatccctctagactcaaatcacagaagacacccaaggagaaagataaattatgaatcccaaggtttgatacacttcaaaaggcattacttgcatttcttaattcattccacaaaatttaggagacatgtgtaagaatggagattaaagataggatgttttaatcactacagagggatcataacagaggattagagtacatttttttagacgatctaagaaaattttctatatttaatgttaaaactcatagagcaagagagggacctaacaatctgacagttaactggctaagtcatacagcaaataatagtccacaggaagagaatggaaatgcccaacttcaattgtttaggataccagaaaggattcaacagcttaggaaataaaaaagttgcattgattttgtcatttaatatctcttctcaacactggaatagattcaaaatgcttacctaacattgagaaacaaattttaaggactttggcatccctgtaatgtccttttcattaaggcttcaactggtgcttgtaatgatagatattcatttggcatcctaaatggaataacagccatcaatttcaagagtagtaggtttgagagagatcacacaaccacaaagacaaggtgggcatgattactaccatgaatgacagagtcagagaagcatccagaataatatgattcatacactgccatgatgctagtttgttcatcatagagtcacccctaaaagtgaaaaactagggaaattgtttaaattcttacttggtttgtataagaaaaataattgctgggaagtagagacattgcagtagtaattgtctaaaacagttaagcagctttgaagctgggaagtggtcagaccatgtgagagttttgagatgaattctaacataagtttatttttgtgaatagaatgtccatggtaattctggtgttcttcaaaaggaaggatgtgtattgtaacacaaatttgagacttcataatcaacgctaagcaaattatgcagctagtatgcatgctcacctagaatgcacaatggcttaggttccaaccccagcaccacactgtctgtaatgacatgtgcttgtaatcctagtacctgggatatatgtattcaggaggatcagaagttcaaggtggtccttggttatatggtgactttgagactggcctggaatacagtagaccctgatgatacacaaatcaaaaaacataaaagattaaattgtagctactaacggctaccatgttaaagactaggttaaaaaatgaagaagaaaacatttgcattgtaaagaggaaaggaaactaacttgatccatacttgtgtcatattattttattatggaagacagaactcaagagacattaagtcaaatatttggtttgaagaaatcattgaaaggtcttgttcccctggcaatgtttagtgaaatataagatggataaatgagggtgagacattcttttaaaagtaaaggcaaacctttaaaaggatttggaaattctaatcctgtttatatggaaaatatatggaagcctaaaagttcaattacataccagcgataactggaacttattcttgtctctcaggtacagaatgaagaggttttaatgggtcaggggttatttcaaagaacatattgctattaatattgtggacactacttgttgtctgtaattataatttgttgttgtaagatttgtgacaccctctgttttctctgtggtatctgctgaatgaagaaaactacaataactatgttcattgaaattttgcaaacatcacccacagggccaaagccaacatggagactaaaattaggaaagtgctaactggtgccatagacaaaaccttaattctatattagtagaatagctagcctgcagttaccttacagacattggactctagtggtacagacatacaactctagtttatgtataccatggtataagcttcaccaagagagttgtgaggaaagtcagagccaagaatgagactaatagactacaaagttgctaaagtcacagtcacaaagattatgctgtatattttcttctgctgtatatgtttgactttatattttacaggtaggtcaatggttcattttgaaccattacaaaaatacatgacacagagtacaaacccgaaattcaaagttaggaatggatatctcaagtcttgttatgctttgtggaaaggcaactatttattcaataaagttgtcttctgtcattgtcaaaatcaattctcaaagacttcatccagggttctgtgacagagctcttacatagcgttcatgaagtcatgggtacaatccaatttaaaaaagaaaagtaaatcaattacctttaagtatttaggctacttttctttttgcttatcagacttctacttatcattaaagattaatctggaaaacctaattttcagaaaatcccatttttttccatttattgattatatcttacattcagggtcacttaaaaactgcttgtgcattaacaatgattatttccagctgtgtaattgtaaatgatttgtattctgactgatgtgcatatcagtattatctgaatttttctataccaaatgtcacattgttcataaattttataacttttttaaaattttgagtaaataacattccaattatctaatgaatatatcatgcaaatatatataatatttatctattttcaatatataaattgaatacatataaaatatatttctatataatatatgtaatattatattcctataaccaaatattgttaaagtaggatagctttaggcaaggcttgatctagaaactgagtagacactgaggacatgctctctgccactaattctcagtggtgtccagtttcattgttgcaccagccttaagcaggttctactgagtactgacaatgaaattacctagtaacttcaggattaccttctatcactttaacagtctcagtagattaaagatgggtctcatttcttatggtccttgaggaaatgtttctgattgcctattgaatcatgtttcttcttaaaactacccgtgtgtactgataagctataggttacttccaaatacccacactttgatcacagaagcatcctcgtgattatgccaggtgtactaagaaaatgtaaaaccatttcctcacacaaaatcctcacacaacatgtaatgacaccccccagatcccttttgttatggaaggagacataactacaagttctcatgttagaaggtagacatgtttgggaaggaattactcaaataaactttggtataatgctattaagtattaagttgttgcatttgtctttcctgctttattgggactgctttatggaagagtgcctgtatataaactcatctagaatccaactcttaaatgactgagaatgttatctaccataagagaaacatgtatatagagctgagatttttgcaaaaccacagggagaaaatggaaaacatgttgtatttcatttgtgtcatttcaaatagacagttgcttccttgatcttctttttttgattaataaagtaataatgtaggctggtttgtatctcctttatttgatagattctgtttgtaacacaagaatacgatttctatcagtctgcaaatcatttaactgtttccaaatgacaactataatttgtcctcagctgctccttcatgtgctaaaagaaacagaaaaccaaggcacttgtgtaaacagtttaaacaataagcagccattggcttaattatcttgttcagcaagcatctctatacgaatcaaatttttgttgtctaactctttacgatgactttatcatctgtagctattgtcttatcctaaaccatttatttcttttagcttactttttaattttttgctgattctttgtgactttcacattatgcacctcagtcccactcatctgcctgtcttctcatacctgccctctgcccttgcaaccttctccacaaaagaaactaaaaatcacacaagcacacaatcaatctaaaaacaaccaaaacaaaacaaagcatagaaaccatctcactgtagaagctgttttattccacagtgtgtccaaaagtatactccattctccatgcatctttacttaaaaatgctcattgcaatgagtcattggtctggttcgaggcctctggcttctgtcacaccatcaatattggaaccttactaagactccttccggttatcctgttgttgtcttgtgtcatggagatcctgcagctttgcatcagcagaactgaccctttcattcactctaacgattcctagatggtgtaaggttttaggtgtgataactcaatgtcctgattctgggcctgggttgtagctggcggctctcccatatgggaaccaccaggatgagctctccagcccctttccaatagtccacacagtgctgtcatcagcaggaagcaggggcttgcagagccagctccagtttgttttctcaagcgtggtgcaggggctgatctccaaagtgctgcatctggttaggggaacagacagttttactgctctcatgacccgggccagctctccagactaccttagttggcaaggagctagggtggtggaaggcatcactcccactacacctgatatcagatgagtattagaccagttctcccatgcttaatccctgggggaggtggctcatacacccgctctgtgtggggcagctttgctgtattgtccaggagaggtgcagtgctacctctcctgagggttgcagttggcactgggcatggtcagttctccagaatgccacagttagagagggccagggcaagttctgcgccacccttgagcagaatggttgggaacctatacagttgcaggcagctggagatactcacatggtctctaattgtaatgtgagtcacatacatcaacattacatggccactctgcatggccacatacccagatatggccttcggtagcaatacaggctgggatttcagcatgggctcagtgggagggactagctactaccaacccgctgttcctttcaaaccatgcgtgtccagttctgtctctcttcataatgctcaggcagttctgcatctcattctctcccatctgtccaccacatacttgcacattgtagttgctcacactgcagtcagacatgtggctagcaggctacagagggattcctcctctgcctgctctgcatggctttggcaagtgggtctctaggtgtctactgcctgcctatgtgacactgcagccagtggacctcttcctactccttcactgcttgacatgtcagtcgtgatgcctctgtgtatctacagcctgccagtactgtgcagcagcaggctggtttctagaaatctgtcatagtaggtgctgcgtggcatggcccatgtggtcccctggatgtcttcctcctgactggctgcatttagtggctctaggaaggcatctctgcatctacagtatgtccatacagagacacacaagtctttcacctttgacttaaatttaatgtacagataattcgtgtcagaaattatatttactactataaaggctagaaaagacaaatgcattttcagtgtttttggtgttttcaagagaaatcataaaaatttgagaaagagtattagtatagtagaatataaagatcatgcccaatgtaaaaatgatgtatttttaatttttaagagagaaaaaaattgtgaaattggaaggaaatgtggggactattcaacgagaaagtaattcttaaggagacgtaagtacctgtgagacagacaagggacaagagaatcctagaagcgaacgagccactaaagcaaggaagagaaatgctttggactaatcttggaagcttcttctggttacactagtgagcagggcaaattcaaattgctcataaaacctgagagagcaagagtccctcatagacatcgtataagcatatctatagttttcatctagaaaccccagtagtttgcaatgagggtggacaagattaggcaatatccatagatattttgattgccaatataggggtgaggaggttaggagatatggagggaagagcacacttctatgtctatacaatgggtaaggtttctgcttaatatccagcatgcacaggaaatcgaacccaaggaaaatggactcactgcaagacagataagggattctatagggcaaagactgtgtgtcatggtagagtattctcctagtatgcttgaaaaactgacatcctacacctatcatctttactcccttgccaaaaggaattcatacatagccttacaggtttatactatttttatttctttcttattttacagtgttaggaaactgagatcacttgatattatatatcttatccaaattcccaaagtagttaatagcactgcaaactctgagtcatataaaaggtaactagagtggatataatcaaccacctaattataatctctgattacaggaatggccatcgttgcaactggaaatgaatgtatgtgaagtgctctgcacagggcttgacacaaagcaagcacttcacagaagtgttcactgctttgtacagtagcagctgctttcttctatgtatcaggtataggtcataaacagattgagctgaaggagaagggaagaagaggctttaaaaccctgtgtgctccaggactgtgtagaatgaaagtggagtggaaacagttaggcactcttgggggataaatcgtgtccatagaggacattcagaagctagcaagggtatgaagtggtatgagtggtaggggaacagtgggagtgatccaagagtgacattcattttgagcactaatttttcacctcactatcatgaaagaatcaaatgccattccaggagttgctgtgtttatctacagcagtagacaagcttaaaccagaaagcagttagttcatggctacataatttctgagatgtcttttgacatttggagaaaggaaaaggatgacgttcttaaagatacagtatctaaatttttataggtatgatgacgacaggtttagcattcacttctcttctggtatatattgacaaatgtaactctatcttccaacctggctcaatgagataggtagagagtagggtgaagaatcattcaaagatcacaaggcacagtttttttttttctgctgttgctttttaatctgttttgtcttgcttgcaattttgatacattgttaaagaagagcctagccaggctggtcaggttgcatgcagaggaaagaagcctcgggaacggacaccttgtcatagaatattttaataatgagtgttctcattagatatcagcaactaagctaccaattgcatgaacactacttcaccatcagccttgcagttgtctgggacaggtgcttcagattactgctaaagttttagagctttgaagaggttgaataactccagtaacaaaactagcaaatagtaaaatttacgtctaagcaggatgttagactgaagatccaagcatttacccagatttattcgtgtatagctggaggtttctaatttcaaaaactctagttcttctgtgttttatgttttatttgattgcatataaataagatcagaaaaatagctattatttatttaagtacatgtccttcttagacctctgtgctaacctttattagtactaaaccattggctttctggacatatcatttttttttatttattatggtattcttgcaacatttttaatgcaacacctgctttttgttgctatatcaatagagaattaatagagggttaaggtttaggattctatggactccataatctgcagagacacataaataaatctacaaataaaaagaaaacaatggacaagtgctgtcaagaaaataattaaacccagtggtgtaagcagactttgggtgcccactgcaactgcttctaagtgatgtgttctcttagatgatcaaagaaactggtgccaaatagaacaaagggaaagatgtgcaaagctctatttgtgcacataagtggttaatgcagaggccaaagtgcagagacaggtgatggggaggaaaggttaaagaaaggctgagaggaggtcaaagccagtcaaagaatgattttacaagtcaatataagaaattaaaattttactccttgtacatggagatacgtttgaatgaattctattctatttcacaaggaactattgtcctcaaagacagatctgagtatagcgaagaagttaaagataccaggaaaatctaattttactctaactttatcagttcatatttcatgcgaaaatgagcaataagcccctaaagtctttcagcagcttcgtttttaatggaaaggtgtgctgtttgacactttcatcaatcagtgggtgccattaatctgcatgttgtgttacagggagctgccatccttctgacttttccttttctttatgtttttaacttttttcttcttgtgaaattaattcatgtcatttccctttgaaatcagtggcatttgactgcacaagcacttagaggcaccctcctgtgattgtaagtttagtttaattacactgcttgtcagcagcacctgaagaaaaagagccagatgctgggccagggtcaggggtatattggggaacccttaggatacccaactttcatgtggaaagtggattgctctaggtggatagggctgtgtggaagggcatctgaaatggttggatttggtgagtgatgctggcatttggttcttaacattgttctaatgttgagccttgatatgaaaagaacatttgagcaagtacttgtaagatgtcatcaatttcactttagaatctgggttttgagaaatgcacttagaaacttagagaagactaataggcttgtgaagggttgaatactgtcaatcatactatttggttgttctacatgaacacgtgtctccaggcagaagtctcctgttgaaagttaaaatctgaatgcaaagatcctaacagtcatcaacccatcggatattagactttaatacatttaaggtcatcaacattaataaatacactatgcatttcatgcagtctttttaactttgtttttctgccacatgtttgcatgttaacaaaaagcaaataaacatatgaaaaacattgaatgatctaattataaaaatgtgggaaagaatcatcaattgaaaggtttattttatttcatttttacttttattttgttgtattaaatttatctggttaacagaacagtatcaatatgtcaatgcaactccttctattttgctacagtagaccaatgggtgtaataaatatgcaaattaacattattttgtaaattctaatacttggtagtttctcactcttggtaactacaaagctgctatcttggtttggatccccatagttctcaattattttctcatggttctccagggtctcagtggtcctgctcctctgaaaattcttctgcacatgtcctttgcaatgttttagtaaacctcaaatttattacaccatttcttaattcaatatttctaaattaaatccctgttctttttatgcaaactcttccaaaagctaaaaaacaaaattgttcttgacctggatagtctctgtgggttcatcttcttttatcacaattttttctgtatctccagttctgcaccagagttcttcctaaagcacaaaaaatgaacagctgcccaattcaagcttcagtttgccaatataagcaatatgtatttgtctaataaacaaatagaactagattaaattgctagtgcttatattaaaaatttcatttataatacatttttgtgaaggcaaaaggaacctagatttaaggcctcaggtttacataaatgacaataagaaagaaatggcattaaaaagggaagggagacctgagcttggctccctgggacccatgtaaaaaataggatgtggttcctggatcccgccaagactagtctgtgcaagtgagagtgtggacttcagaagctaacagcttctgggacaggcagaagccacaaagcttctgaggcagacagcattttgggcttcagacatccgggctctttccctgccagaggagaggtgtctgccccgcctgggagggctttgccagagcatctgggggagccatcttggtttctggatcccaccaagactagcctgcacaggtgagagtgtggactacagaagctacacagattctgggacaagacctgcttctggccttcatcttttgctaggaggcagacccgaatgccagatatctctccaccttccctgcaagaggagagcttgcctgcatagagtgctctaaccactgaaactcaggaaagatctagtctcccaggtctgctgatagaggctaacagaatcacaagaggaacaagctgaaaccagagacaactataaaaactaactccagagattactggatggcaaaaggcaaatggaaaaatcttactaacagaaaccaagaccactcaccatcatcagaacccagcactcccacctcagccagtcctgggcatcccaacacacccaaaaagctagaccaggatttaaaagcatatcttatgatgatggtagaggacatcaagaaagacattaataactcacttaaagaaatacaggaaaacactgctaaagagtttcaagtcctttaaaaaaaaaaagaaagaaaaagaaacaggaaaacacaaccaaacagggagaagtccttaaagaaaaacaggaaaacacatccaaaaaagtgatggaaatgaacaaaaccatactagacctaaaaagggaagtagacacaataaagaaaacccaaagtgaggtaacgctggatatagaaaccctagggaagaaatctggaaaaatagatgtaagcatcagcaacagaatacaagagatggaagagagaatctcaggtgcagaagattccacagagaacattggcacaaaaatcaaagaaaatgcaaaaagatcctaactcaaaacattcaggaaatccaggacacaatgagaagaccaaacctacatataataggagtagatgagaatgaagattttcaacttaaagggccagcaaatatcttcaacaaaattatagaagaaaacttcccaaacctaaagaaagagatgcccaggaacatacaagaagcctacagaactccaaatagactggaacagaaaagaaattcctcccgacacataataatcagaacaacaaatgcactaaataaagagagaatattaaaaacagtaagggagaaaggtcaagtaacatataaaggcagacctatcagaattacaccagacttttcaccagagactatgaaagccagaagagcctaaacagatgttatgcagacactaagagaacacaaatgccagtccagggtactatacccagcctaactttcaattaccattgatggagaaaccaaagtattccactacaaaaccatattcacacattatctttccacaaatccagcccttcaaaggataacaacaacaacaacaacaaacaacaacaaaacaaacaaatacaacaacagaaaccacgtcctagaaaaagcaagaaagtaatccttcaacaaacctaaaacaagagagccataagaacagaacgccaacaataacaacaaaaataataggaagcaacaattacttttccttaatatctcttaatatcaatggactcaattccctaataaaaagacatagactaacagactggatacacaaacaggacccaacattttgctgcttacaggaaacccatctcagggaaaaagacagacactacctcgcagtgaaaggctagaaaacaattttccaagtaaatggtctgaagaaacaagctggagtagccattttaatatcgaataaaatcgacttgcaacccaaagttatcaagaaaagacaaagagggacacttcatactcatcaaaggcaaaatcgtctaagcagaactctcaattctgaatatctattgtccaaatgcaagggcagccacattcattatagagactttagtaaagctcaaagcacacattgctcctcacacaataatagtgggggacttcaacaccccactttcatcaatagacagatcgtggaaacagaaactaaacagggacacagtgaaattaagagaagttatgaaacaaatagatttaacagatatctacagaacattttatcctaaaacaaaaggatataccttcttctcagcacctcacggtaccttctccaaaattgaccatataattggacacaaaacaagcctcaaaagatacaaatatattgaaattgtcccatgcatcctatcagatcaccatggagtaaggctgatcttcaataacaacataaataatagaaagccaaaatccacgtggaaactgaacaacactcttttcaatgataccttggtcaaggaaggaataaagaaagaaattaaagactttttagagtttaatgaaaatgaagccacaacatacccatacttatgggacacaatgaaagcatttctaagaggaaaacttatagttctgagtgcctctaaaaagaaactagagagagcacacactaacatcttgacaacacacctaaaagctctagaagaaagggaagcaaattcacccaagaggagtagatggcaggaaataatcaaactcaggggtgaaatcaaccaagtggaaacaagaagaactattcaaagattcaaccaaatgaggagctggatctttgagaaaatcaacaatatagataaaccctttgccagactcactagagggcacagggacattatcctaattaacaaaatcacaaatgaaaagggagacataagaacagatcctgaagaaatccaaaacaccatcagatccttcaacaaaaggctatactcaacaaaactggaaaacctggaagaaatggaaaaatttctagacagataccaggtaacaaaggtaaacaggatcagggtaatgatctaaacagtcctatatcccctaaagaaatagaatcagtcattaatagtctcccaaccaaaaaaaagaaagaaaaaagaaaaaaaaacgcaggacgagatgggtttagtgcagagttctattagaccttcaaagaagatctaattccagttcttcacaaacttttccacaaaatagaagcagaaggtactctacccaattcattctatgaagccacaattactctgatacctaaatcacagaaagacccaacaaagatagagaatttcagaccaatttcccttatgaatatcgatgcaaaaatccttaataaagttctcactaaccgaatccaagaacacatcaaaacaatcatccatcctgaccaagtaggtttaattccagggatgcaggggatggtttaatatatgaaaatccatcaatgtaatccattatagaaacaaactcaaagacaaaaaccacatgatcatctcgttagatgctgaggaaacatttgaaaaaatccaacacccattcatgataaaagtcttggaaagataagaaaatcaatgcccatactgaaatatgataaaagcaatctacagcaaactagtagccaatatcaaggtaaatggtgagaagctggaaggaatcccactaaaatcagagactaaacaaggctgctcattttctccctacctattcaacattgtacttgaagtcctagccagagcaattagacaacaaaaggagatcaaggggatacaaattggaaaggaagaagtcaaaatatcactttttgcagatgatatgatagcatatataagtgaccctaaaaattccaccagagaacacctaaacatgataaacaggttcagtgaagtagctggatataaaattaactcaaacaagtcaatggcctttctctacacaaaggataaacaggctgagagagaaattagggaaacaacacccttctcaatagtctcaaataatatgaattaccttggtatgactctaactaaggaagtgaaagatctgtatgataagaacttcaagtctctgaaaaagaaattaaagatctcagaggatggatagaactcccatgctcatgaatgggcagaatcaatatagtaaaaatggctatcttgccaaaagcaatctacagattcaatgcaatccccatcaaaattccaactcaattcttcaatgaattagaaggagcaatttgcaaattcatctggaatagcaaaaaacctaggatagcaaaaactcttctcaaggataaaagaacctctggtggaatcaccatgcctgacctaaagctgtactacagagcaattgtgataaaaactgcatggtactggtatatcgacagacaagtagaccaatggaatagaattgaagacccaaaaatgaacccacacacctataatcactttatctttgacaagggagctaaaaccatccagtggaaaaaagacagcattttcaacaaatggtgctggcacaactaactggtggttatcatgtagaagaattagaattgatccattccaatctccttgtactaaggtcaaatctaagtggatcaaggaactccacataaaaccagagacagttaaacttatagtggataaagtggagaaaaacctcaaagaaatgggcacaggaggaaaatttctgaatagaacagcaatggcttgtgctgtaagatggagaatcaacaaatgggacctcataaaattgcaaagcttctgtaaggcaaaagatataatcaataggacaaaaaggctaccaacaaattgggaaaggatctttacctatcctaaatcaaataggggacaaatatctaataaatataaagaactcaagaaggtggactccagaatatcaaataactccattaaaaaatggggctcagtagatgggtcacacgacccctaatggaagagctagagaaagtacccaaggagctaaagggaactgcaaccctataggtggaacaacaatatgaactaaccagtaccccggagctcttgtctctagctgcatatgtatcaaaagatggcctagtcggccatcactgcaaagagaggcccattggacttacaaactttatatgccccagtacaggggaaccccagggccaaaaagggggagtgggtgggtaggggattgaggggtgggtatgggggacttttgggatagcattgaaaatgtaaacgaggaaaatacctaataaaaaataaattaaaaaaatggggctcaggactaaacaaagaattctcacctgaggaataccgaatggctgggaagcacctgaaaaaatgttcagcatccttaatcatcagggaaatgcaaatcaaaacaaccctgagattccacctcacaccagtcagaatggctaagatcaaaaattcaggtgacagcagattctggcaaggatgtagagatagaggaaaatcctccattgttggtaggattgccagcttatataactactctggaaatcagtctggtggttcctcagaaaattggacatagtactaccggaggatcccgcaataccactcctgggcatatattcagaagatgttccagccggtaagaaggacacatgctccactatgttcatagcagccttatttataatagccagaagctggaaagaacccagatgcccctcaacagaggaatggatacagaaaatgtgatacatttacacaatggagctattaaaaagaaataattaatgaaattcctaggcaaatggatggacctggaggacatcatcctgagtgaggtaacacaatcacaaaagaattcacacaatatgttctcactgataagtggatattagcccagaaacgtagaatacccaagatacaagatacaatttgcaaaacgcatgaaactcaagaagaatgaagaccaaagtgtggacactttgccccttcttagaattgggaacaaaacacccttgaaaggggttacagagacaaagtttggagctgagacgaaaggatggaccatctagagactaccatacccggggatccatcccataatcagcctccaaatgctgacaccattgcaaacactagcaagattttgctgaaaggaccctgatatagctctctctctctctctctctctctctctctctctctctctctctctttttcacatgtgcctaacatcatttatttaaaaaattaaatattttctacactaaattatcttagtgcttggcagataccaattgactatataaccgtgatttttgcctccattcacttattttctattaattccatacagatttaattttttaaacttgtttagctgaaaaatttgaaggcaacaatcgtgagactcgaaattctgttctttttttttttttttttttctctcatgtctcttgtgaggctatgctggggcctagcaaacacagaagtggatgctcacagtcagctattggatggatcacagggcccccaatgtttgacctagagaaagtacccaaggagctaaagggttctgcaaccctataggtggaacaactatatgaactaaccagtaccccctggagctcgtgtctctagctgcatatgaatcagaagatgccctggacggccatcagtggaaagagaggcccattggtcttgccaactttatatgtctcagtacatggatcgccagagtcaagaattgggagtgggtgggtaggagagtggatggggagggtatgggggacttttgggacagcattaaaaatgtaaatgaagaaaatacctaattaaaataaaataaaaaaattttaaaaaatagggaagaaaagggaagggaactttattctttatttgttgaaatttcattattttgatatttgctaaaaataatcacaaaagaatcaatgcataagttagtataagaaagaaatatacatgagaactttaaatgtatcaccttaaatcaacaaaaatgtatttttaatgagttgaaatttgtggcataatcttgtgattgccatatccagggatccatcccataatcagcttccaaatgctgacaccattgcatatactagcaagattttgctgaaagaacccagatatagctgtctcttgtgagactatgccggggcctagcaaacacagaagtggatgctcacagtcagctattggatgaattcacagggcccccaatggaggagctagagaaagtacccaagaagctaaagggatctgcaaccctataggtgaaacaacattatgaactaaccagtactccggagctcttgtctctagctgcatatgtatcaaaagaaggcctagttggccatcattgggaagagaggcccattggacttgcaaacttcatatgcctcagtacaggggaacaccagggccaaaaagtgggagtgggtgggtagaggagtgagggcgtgggtatgggggacttttgggatagcattgggaaatgtaaatgaggaaaatacctaattaaaattgttaaaaaaaagttgttattccaatgaaaacttgaatttctatttaaaaatctctaaaaaaaaatcactaaaaattcattctggaaaattgtgatttgaatattaaagtaaagtatcaagcacacaaatattggtgttcaccaagattttcctttgtgcaatgagactgaaaccttgaagcattcttcttggtgcttacctgttgccacagtatttacctaattttcaattaatcgtctaaaactagtatttcatgggctgagaaattgtataaaatcagtcaagagagtcttatataaactctattcttgttttggtaaatcatattttcttatattcaccaggcttatgtatcaggagtattattgttttcatgtgataagtattttcaatttctttgttattataattgaataaaccacattaaggacaattttccttttaacaatgctttgcccatttggggtgttagagacctcagtttgaaaaagtatctgtttgctgtttaatcatgagtttggtcctcaaggacactcataaaaaaatgtgatcgataaggcacaattgtgatttgggggctgtgaaggcagagaaaagagcatctctgggcctcctggctgcagactaaatttccatgttcattgagagactgtcttaagggtataatgtagagagcttaagaactgagcaaagaaatcatcctctaacctctgattacgtgtatccaaacacacaaacacacacacacacacacacacacacacacacacacacacacaaacacaagcacacaaatacacagcttttgaggatgcctgaaaccttcataagctctcatatttgcatacacatctgcaagcatgcacattcttacaaacatgtgcatataaatactcaaatacatgcaaatatgttgcacaatagaaacttaggcacttaaaaaaaaatctgctctcctaacattgagtcatgtgcttctaagtcggtacaagcctggaatcacaggtgtgctgctgaatcttcagtgtgaaagaactgaagtatgatgtctatgtgcttagtttccagagagaacaatggtgaagtggcgcagaagacaaaactatagtttcctaaatctgcactgcggggctaatgctggaaaacagcgcattccaaaggagttgtttagaatcaagtgctgatttagctggataaaatgcagctgtcttatcaaattacacaactggattcacaccatcgactaattcctggtggaattttaaagatacctttatgggtgattttcttcccagtgcagagattcttaaattagacggttttaaaaacaggaaaaaaaaaagcctcaagtatctactcacaaggattatttctgttagcaactgtagagaatggaatttgtgctttgttaggtctaaggtcaccatttcaaaagaattcctaaaatgtaactgaatctaaataaatttcaaactgacaaattgtcatacattttttttaaagttattttttatatgacttcaagtcactctaatcatttgtcatggtacccaacatattttaaatgatgagaactcctctcatgaacacaacttcttcactaatgtccttactttacatactttttttttgtaaagagtaactttctatggagaatattatgcaatatctaataatcattgaatatcagggtgaagaaattaaattcagttggcttcacagtaaattttcttttaaaaaaataatccatatttttaaatgaacgtatctctcttaaaggatgctaatggtcccttcttgccttcaggtctttccacctaccttgtttcaatattcttgtaacattatataataacttataacatttgtgtgtgttggatgtgtattcatatgagcatacatgtacatatctgcatacataaagagatgcaagaagtgtctttatcggtctctttctcacttgttttgttagacattgattctcactgaaccttagttcactaacttgaccatagtggccactcagagagctccagagatttcttatctctgtcttcccagttctgggattagagatgagtacacagtgcttttcatggagatgacattcaggtactagaaattctgcagcatgcactttgctgactaaggcaccaccctagttccatgaattatcattaaattagtagaactatctattgatttttttcattcaaacaagtgggcagttcatttatcaaatcaataaggatatattaagtagcaaagtatcagacactgtggtctgattttttccctttatcattcccttcttcattctttctcatttgcttttccattcccaaactaatactaaagagaagtataataaacaaacaaacaaacaacaagagtagcaggagcctatcaagcaaccccagtcaggtccataaagatgaggaaagacagctaaaggagatattttcacattgccaggtagatggggtgaatgggaattagtgatgtcttccataatgacaggcagtaataggagattattaaatcccctctttgttgggatgcatcaaatgactgtaacatgggaatgtacactggactgtacaggcaagataaaaaactgagacaaatattaaaatccaagagagaacaagcagtaaatctagatggggtaaatgctgcattttggagtttccatcatcaaaggaatgtattggaaataaacagctgtcttcatatatacttgcactttagtatcctcatctgtattactagaatctaagaatatacgcttgttgagatgccttctggtcctgaggcactgtctgtgttatattgcctaacagcacatatgaccataacaatatagcatttaatattaaagtaaattttaagttaatttaataggcttaatttatatcagcttgtgtgaattacagaggcaagcttgatatgattattctctgtttataatatatttgagactaaaagagagaactctcaggttttgttccataaaataatgacttagacctaaaaatatatactgtgcactgacaaaattgcctatagttgtggaaaatcactccttaaatctagtgagcaacatgatatacacagtctttttattttctttatttttaaacaaagttactgaattcatgctatttactggtttgtgtttctgattacaagatgctgtcccctgctgtttgctaaagattataccagctcagagtcaccaacccagagagaaataatatgacaagtttatttgatcttaacatcagaagatcaaaatgtggacttctgtgtatctatagaagaaaaaccaccttggggacatcaccttccctctgcccaagttgtctcactgcagtgaccttcatttctagacagggctttgaacagaacagctgatgcgctggaagcatgaggatggaaggccttatttactaagcaattatttcttctaaaagacagcttatgaaggatcttaaacccatgtatctattaagcataactgacatccctgatggatttatatataaacacttgtgtgtctcaactaagtttgcatgtgtgcttttaggagcgttcccttgctgagtctttatttcggttcactttaacgaagaccacccagcagtataaaacagtgccatctctacagaactacaaactctcctccggggaaccacactgataataagagccagtgtgttcatgactgttttctatatgacaggctgctctctgtgtgaccggaaacttgaattcatgggaaattagaagaagtgaaattgactggatctgggttcaatatttggctgtcatttaccaagtatatcatgacatttcactttgcctgccttcaaaatcgttcagctgtttgaatattaaataaagtgatgcataaaagaggctgcaaaacatcatacagaagcgtgattaataattgactatgaatgcaaatatgaatatcagatgaccagttcagtgtcgtgtagagcaaataggcaactttggtactgtagataggcaatgagacactaagcagaactaggacatcttccttgattctctacttagcatcattccttccttttatgtcactcaagagaatacttaactctgaagggtgataaaggtgtctagtaacagctggtatacctcggtttgaattaccatactgttgatcttccctatgctgtctatttccctaaaaagaattcctaatacctttcaatttacttttaaaaatggggggggggcaacttctctgaacccatccagagcatctagggaaagaattttccaatgtttccccagtgagtaaatgatgcttgaccaacacaaactgacgttataaccagtggcttactagtgtttgtgaatcaggccatgtaacatctttttaaatataaaagcattaactccttcacaaattcacattgtacatgtgtaacaactacatcaatgctctcacaaacctattgagaaaccataagcaaatgaagctgaatctgcgacgagggtattttcccttgcaggtgatgacatctgaaatccatattaccgcttctccttcgtcttcaaagaaatgtatagatatacatttttgaactccaaagaactaaatatataggggtttgcatataatataaaagggaaaagaacatttgtcatgaacttggataggcctttgatattcctgtagtaacacaaaagctcttatcttatttcccagccataattttttttaaacatttgcacactctgtttgagccaagagtggtatctgatatttggaatgttataaaacaaaaccacaaacacacacacacacacacacacacacacacacacacacacacacaaatcagatgaccaaatacaccataaaaaaaggccctaggagaaatgaaacaaaaatatttatttaccttcactttcaacaggcacagtcgctaatatttataatcatcactttaaatttcatttgacctcatatctcaaatatgcttgggagacttaaaaatgagtgactgtagctaatggaaagagttttgtgataattatataccagagaaaaatgtcaaaatatgtaactattttatcattgttctatggtccccgcttcttaggaaaggcagtagaggtgaaatttgccaagtgctcttctaacacggggtgatggaaaagcccacattcaggagcgagggatgctggaattgagttgtcaagctgtcccgaatgtcttgtacaaactgaacaggccaatttactgcaacactgcctagactgaaggctcctatctagcctttacacttgtttcctcctggagagattaccctgctcccccaagctttccctccctggcagctcctgacctaccctggattcctcctgaaaaaccaattctccaaaggagagcagtcttaatccctaccttgggaccagcgtgctggacttcccagagaggctcctaccatcaatctgaaaggaaaagcttagtgtttgttgataatttttaaatcaagtggtgaattgatttcaatatattctcttttgtaccttaaaactctcagctttcgggatgaaaaccagcaagctttaaaaaaaataaaaaataaaaataaaattgacaactcccacacagcctgaattgctttttctgattacaagcctcggacgctgaggggctgctttaaaacggcgtttttccgactctcccctccaggtggcagcagtgctacacctcagtggttccaatccctttttccctgacttcaagtgttaatgcaattgaccaatcactgctaagatgatgggaggtaattgggtaattgtattttactgatctctagcggagaaagggaaagggaaaggggcaagaaagagggccagaggaggggaagggactgcagtcctggaacgctttggggagtcaggaccctaagtaacaggacctggcattggtggaaagtctagactggcagacgctgccaaccgctcagtgagcgctttcatttatctgggaagagagaagagagaggagagggagagagttcaccgcgaagtggatggaaggggagccgggactatggcactgagaccggcgcagagcagctgcgcgcccgaggacgaatctcctccaggaggaccagcgggcgtcgggaacggctgcgcacagaggaatcaacttgtggctccagacggtccccaacgcagctggaaatgagatcaaagctgcagtttcattccagaaggatgagaggagccagtgattagagaattttttttaaccctcttcattcctgtttcgttaccccccccccttttttctttaaatatattttttgaatatttttttttcctttttaaaattacctaacaccacgtcagccccttcactttgttttccctgcttgaaataaaagcctagcctgaacttccacaaccttggggactcgagatctactgctggatgatggagaaggggacaccagtgctggcaggggccgctggcgagggaccgcatcgagcgtctctccggtgatccctgccctgatcgcccagttcagctatacctggaggacctgtacccagtgctgggagtgggggaggggacccagtgaaagccacccagagccttaaaaaaaaaaaaaaaaagtagctgaccgggggcggaacgggtttgttcttgacagctgacggagccttgaaattttcctcctctacctccgccccctcccccgcccctgccccccgcactccatttaacgtgagattatgaaatcgcagaggcggtggagggaaggcgacgggatctaacagggagtttggaggggcgaggggggaaggtggctgggtggctgaaatcaaaaatccaattgcgcactgggttgtgatgagaaatctaatcagatctttgacgaaggggccggccggaagggtagccggtgggggcagttgatccctaaattctccgaagggaaagctggggaaaggaatcgaggatgtaaagacaagacttttttgttcttctttctttctttcttttcttttctttctttttttccttttctttttctttttttttttctttccttttttttaacccccggaggaggtggcttttgggtgccttgctaaaatgaaggatacgggacgcagctctctcttggagcagaacgcagaggataaggtgatggtgccagagagaagaaagaatgaagctttttcttgtgagacctggatcgtaacataaatgtgtatatggccacacggagagcattggggggaaaaatgaaataagctgatgtcagacctgcggggtttggtgtattctgacataaataatcataaaatagctgtccccctcccccaaggatgtttggaaatgaagaactgaggatccacaaagaaaaagtgtgctcatttttctctgtaaaagagaaagtacgccaaggagatatttttggaatgaaaagtttggggctttttttagaaaagtaaagacctgatatatatatatatatatatatatatatatatatatttcttttggaatttcccacaagaggagaggaaattaataatacatctgcaaagaaatcccactgaagaaaagttgaccgtggaagaaggaagcattgattgggaaagaaatcagcagaggacccttggatcagtgcccgtgttgactaaaattgaaggataattgcagttggattttttttcttcaccaacctccttttttgtgtgttttctttctcgttttcttttggtgtcaagaccgtgcattctttcttgttcttaaccacctggatttccctcgggatgtagctgtgctgaaatacagtgagtgatcctaattttcttatttatcagggcagaaattgttcattaatttagtgttctggttctctttctttccccctcccccctcactgtggttttttcaaggacccggctattgggaacaagaaaatgagggacagggtggcccacgcagttgttccatcaagctgtgctcactgataagctggactgctataatgatgcaggttgtctgcattctacgcaaatgcctttgcaagtgttcagtatggagaagaaggaaagaaaaaaaaagctctccatgaaagctgctgcagtgtggggtgcggatgctagtgattgacactctagaatgcatttaagttaccaggaaaccccagagttagcagcacaaatgttggctattggaaatcgaaggggcccaatttaaatttcattatccaacccgacactgcagatcaacagaagtattaacacaaaactaagatactcaagcaggtgaaggatggcttctggctaattcataacagggaattgtgcggtggcagaggaagtggtagagcgcttcctgcactcccttgtctaaatgtggtctttgcatccctgggggcttcagtgatgaaactgtgactgaaacaaggaggacccattcaccccaccccttgtaacttcagactcccttggttttcagagaagtggcactcagattgtaaaggacctgaatatttagcataggctttgtgaggaaccctccaaacaccactaagatacagcttttgagagaaaaggcagacatttaccgtcctgcggtaacttagaaaggaataccaaagaacaatttgtgtgttgagtaccaaagcttatcatggaccaagtttgctttgaaagaaagaagtcaatgaagacaaacaaaccaacaaacaaaagtaaataataattaaataaaagagaatgttgcatgtgatttgagaggctgggacctacaggatcacctccccctcctccacctctgtcagagtcttagagcttgtctgcgatacagaaatgctttcacccccacctatgacacccacctctctctggaggcttcgattagaaccatgaactgtcaggtaactttagaactatatcacacaggctaagcaaagaagaaactgaggccaggagagaaaccataattccttggttaatgaccaaacaagtctgagacagatgactcacacaagcctcagagaagcagacaagttttgaatccaaactaggaagaaatctggcacatatatgaggctcacagctgccatttttatttgggagagaaaggcacagtgatctagagatgatgaagtaaacttctgtcagtgtagacaacaagatttctaagtgccaacatccctctcctctcctctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcccctctccctcttatcctctctccctcttatcctctctctgtctgtctcatggttcacaaaactctggctttaaaatatttaaatcccagaagatccacaagtctgaaatatcccaaaggagatagaaggcagctgcctcctgagtgccctgttagtgctgggcacgtttattgctctgagtggtagactctagagagtcattaaggatctgtggagttagatttatattagagaggtgataatagaaaccagaaacactctgctaacagcatctatgtctgttctttcgctcccatcatctgttcttatccttcttgttattccttaactaaggtagcctacagcaaagcacttccctaatttatttctctaggcacatgtttcctgttgggaaacacagattctgtaggaatttaccaacttatgaaaacacatgtgcaaattattttccttgagaactttatggaggcttctatatatttctccctccctatccctgtccctgtccctgtccctgtccctgtccctgtccctgtccctgnnnnnnnnnnnnnnnnnnnnnnnnnntctctttctcatcttgtgttttgtgtgtgtgtcttttagtcctttatgatttgcatggttattgttgttaattcaccattcttgatcatgtaacaagtcaagttatacaaagttgttgatcctctgcaacttagtgcaacaagcacagaagtaagaagagaagaaaatgtcttgagattttccttactttatagttcaagtacaggctttgtctggaaaacttgccctgcaagtatgctgtgtctgctaatcaggagttttggtactattcatctttgttttccataaaacttttctcaatactgaacactactcccattcgaccacaaactatatttttctgttcaaccttgtcatggcttttctgtccctctccctccttatacaaataggtagatgttgccaagaggagggaaggaagggaaggaaaagacagtctatttgaaatctgtgtcagaacaaagctccatctccctgacaggaccaggtattgaaggtgttccttgtgagtgaattactttgccagcatcacacttgggtgcccagactaagcttgggaatccccttctttggcttgggaatcacttggctgtacagtatccacaagtttttcatgggataggaaagaaatcctggctatggtggagttgaaatcctacctaatgactgcttcagctcaagttggccactcagtgtatttgtgctaggtaggtaaacataggcacagaagtctactagggaccacacacccagaaagctgcaggttagcactagttttaaaggtatttcaaatttcttcctcctgtaatctaatagctacaccctttgagcaatattttaaatttccccgtccctcatcttttttcttttgcttgtgggttgagaataacgtctaacttgttgataaattatacttgttttgtaaattataagtgatattctggaaaacctcagccacaatagtctctctcagggtggatgtctgtctgtcatggtcattcttgagttaattcatgtgtatctactttctgaggatgaatgaagtgtgaccaagtactttaagggtctgttggttaagttcaagcacagtgaccgtgtagtttaaggtttcccttaccagaatgggttgtttaaaatatattgcattatatatatatatatatatatatactgctgtttagaaaaagaaatctgagccaaaaaatacttaaaagataatttaggcataatgaaagaatgatttaactacacctatcatgttttctactttcaatcttaaagtttcataaggtaaccttggactttaagtgtcctctggttacatatgcaatcatcttgttctggaatgcataaataaagacaaatgcctttgcaaatatataaatttaaatgaaatagtacatcattctatcacagcacttaagagcccgaatttcactcccttgatgggagggcttcctattctgatgtgtaggctcaatctgagaatggtaaaagatgaaggaaaagccataagtaagtcttaataattttccacttgtctaagcagtgggtcttcaccatgatttgttgtttgtctacgatagtagtcctatactctgtccatgtgctcagtggacgtccttagaactctcttccctttaataattacaaaacaaagcccagtttttagtcatagtaactgatgacatcagcatcatattggcaagctgtgtataataatactgtcagcttggtgtatagcttactgggttttgattactgaactttctaaagcactttaaaatctggcagggtttggaaaggcctcctaaggttcatcgttctcactttccattaacacaaatgaaaaccgaacatgaaaaatgttcaccatttggtgcatcttatatttttgtgtgttttctaaaattaataaagaaatcaggcagaattcagatgcttttggtcaaactgaactcaaataacttcactgggacacatgaattatacttagcatttagcctatttcaaccaatatgcttatctgtaaattagagataaccacatgaagctgtctagcagaaaaattgaatcaggtttctttatgtcatgtactatcagcattcaataattccatgtttaaattaaccatctttggtctataatcaggtaatgtgtggaatagaaacaagagtaaaaatgggtttttgttgaaggaaaaatcttgactacaattcactttggtaacccagacaggattgaatttggtgttaataatgacatcttgacacacatagcagttacctgggattcatgatcctcagttgaggagttgcctcattagattgctatgttggtgggagtgtttcctgattgatatagaagagcacagcccactgcaggaagtaccatccttgaacacatagtcaagggttgtattaaaaaatgtaggctgaaccataggtaccagaccagtaagcagcattcctggtttctgtttcatttccttctgcttggttcccaccatgatttctgtcttgacttcctggattcaaggactataacctacaaactaaagttaacaggttcttccccaaagtgctactggtcacattatttatggaagcaaaagaattacccaccagtcatacagctttcaagcacacttggtcgtatctcagtgaaataatcagtcatcaaaagctgtgaatatactttgtggattgtgaaaaatatacactgtgtccatgtatactttggctgcgttggccagaggtttatatcatagataacaaaaattgatttgtaagtaatatcttagaagactctagggtgaagggaggcagattaagaatttatgatgtcttcatttggttcaaaattattttacttaataattattgaattgatagacaaaattcagtctgtggctgaaataatgaactaggtactttctctgagggaataggctgtgtttttctctgtcgtgttctcagaaactcatacccacatgcaaaaatttccagtcttttgatacctaactgtgcttcatttaatcatctcctataatgaattcaagtacatgtacacaacatgtacattcttgtgtacacacaaacccttgagaatgtgtgtgtgcgctcacacacacacacacacacacacacacacacacgtgnnnnnnnnnnnnnnnnnnnnnnnnncacacacacacacacacacgtgaaagattgttcctaataatctacaggaagttagtaaaaattcctcatgattgttctgactggatacacagagagagggaaagagaggctatcttttattgaaaatactggtctgaacattatgtgatccagtagatttttcttatttttgatgttgtcatgggtggactggtgatatttggaatgtctcatactagctcctttgtgcttacagtcacttctgttcagtaacatttaacacagtggtagttcaagcactaggaacctggtattgagtttatagttatctacctaagaattcatgattgctggtaattaagagcatataatgcctgatagtaggaaattagtgatgaagaggtgaatggaagcatcaagtcgttttcatttgcaggtacaatggtgaaagggaaaagaaaaaaaaaataaaggatgttcaaatacctcatcatgactttagaatagaaaaataccatgttataactctgttttagcacctgctagttatttttccctaagtagacagttataccatatacatctcagttttccacattgtaaaactggttacccttttctttatctttatagttgtgaaaactaagatatatatatatatatatatacatatatatatatatatatagtataatatagtatatatatacagtacagacccttggacattagtcaaacagagaggacagtagtacctcactgtctattctatgaaatccagttattttctgtggtaatgagaacattcagcatactattgagggttgtattgtcttttatctaatgagcataaaaatatagaaatgttttggcaagtttcctatcaaagttcataataatactttctttttatatttataaaatatcagtaagatcataacgaaggttgtacattatatatcatatatcatctatatgatatatagctatgcttctatttcaattttggtgcaggtttatggtagattcctgtagttatctaaaaagccacatttttggaagttttggatgttattaaataatgacaatcataattatcacttgggagccatgtaataaataccagacaatatgttgcaaataaaaattttcacttttactatcacttatggaacagaaacaatcaaaaatagggtaattttgaagatgtttccgcaattggaacgtgaggcacttatcgtcaccaaatatcagactcaatgtattaaacatattgtcttggtaacagcctggcagcatacgaccagatgagcctgagaatgttttaattgagtttggaatatcgttttcctcctcctacttcagtcacataacttgcatatttttatcaaatctcaatcatagccgactgtgtctttaagaaagtgatcacttctaagaaagattcaggaaaaattatgttaatccatctagaatatatatggaagaatgctttttaaaatatgtatgctattatctgtaaacacgggaataatatcaacgctcataagaatggtctttagataagaatatcttttacacaaggtaatcacatgaatgagacttaccaagacttaattacattacagttgagtttgataccatgcttacccctgagttcatgtaggtatttcagaggtttgaggatttatttttcaaagattagttttattattcattttactttctcctcctcttcctcctttctgattaggattcctccccatttctgagagctatttacctagttcatttggagacacccaactctattccttagccataattgtacatggagagacctaatcaatctccataatcaataactttcttactttcttggatctcatgttggcttcataaactttctacaattgaaattgattgttttccttccagtaacttctgaatctagagtttccaatacttatagctctttaaccttcttgtccaagcagtaatcaaattcaattgttagcttctgtcacacaatttcctagattccatcattgtgtttaacaatacacttttcttcagtgtagtttgtcactcattctcttacaagcattattctaagaataaagcttttgttctataatctgtgagtatctttgtaaactgaactccatgcttttctcctgattgtaaccaattgaccagcatggtcataccttctcttgtcttcctgcttttctaaaaatttcactcctctggagatctggctagcttcgacttgaattttgtagctgacacatgacactggccaagcatatgcttcatatgtcaagcctcaaaacctgcatcctcctagactcttacatatctttatctagacacataggtgtgttctttcttctgcttagaaacatcttggttatcacatgctcgctcttgtcattgttgcaatgtatctatctacctacttggctacacccactcaatttagataaagacctcatgatatcccttttctcatctctaacactcaccgagacaatagaaatttattttggcagaacctaaaaacgagttaaaaggaagggtctatgactgggatataaggtgaataaataaataaataaataaataaataataaacaagtaaataaataaaacaagtggacggagctaagacatggtcttaatttggcttctaataaaagctaaaattttaaaaatacttctgccattagaattactgtcacataattttctccagtgtctaggtttctaattagcattatttgtaaaatttattgaaattttctctgctttaataatagtatacatatatttctcaatcatcacttctcaaattgtactacctgtacatttttacaataagttgatacaaatagattaacaagcaatggtgccttaacttgttcaattttctaagtacatttatggttcctgtttggccttttgaaatagtgatggtagctgtccttgagaataccatttttaacataggcatatgtagtatagtgttatattttatctcactcgtattaaatgcttaatgcagattttgtcagacacattcctcacaggcatcactcacagatagtgtaattactctcccaaattaagttgttcactgcacagtattcaaagctgggtaaggtttgccttcccactctggaaggcctaccacaaagattatggatttcgagcatggagattacctgaatacaaactcttgcaaagagaatcagggtgtaagggctgaggttcttcttcctatcaaagtgtagctgcttttcacattatatcaagaacagcttttactgaacccagttgttttgatcttatgctttgaaatgatgtcttctcctttcttgcaaaaacaactccaaacaaacaaacaaacaaacaacaccagaaataacataaaacaaaaaaccaacagaataaactaatttaggtgaaggataatgctaagggaagatcaaactgagttatgtttgaattttattcttcaatctttagtaatgaatgtcttgactatttgaaatattaatgttttgttaaatattcactgaaatgttttctactcattttagatatcttctacttagaaattaggaatagtcgtaatttttttagtagataaaagtacgttgatagtgatttttacagtgtttagaacatctcacttttccttttcatcttatgaacaagttttttatctcaagatttccaatacagctgcatattctctactagctaacgagataatgcctgaggagctgagaatgggaaggtgccagggaggacttacttgggagagtcagtgctgaatctggtgattccttcttgccaaactaaagttgccaggagcacactgtttccttgagagtagctcatctgttcaatctcaccgatcttgaagaagtaataataagaaatgcaaagggaaagcaattattaaagtggatatggtattgcataagggttcacagatttagaatgggaagatcatctgtctttggacaactaatatactttcataattattagcctcatctattcctgtacatatagcctaagccattttgattgagatcttattatgaatgcatatgttcatttgcatgttttggttactaaatcaagaacccactgtaaaatattaagacatttattctcatgacaaaggatgtgtgttgtttaatgatagcttggtactgaggtgtagatttcagtaattaagacaaagattctaagaaagctttgggacctttggaagcgtaaagaattctttctcctgaatttttgcagccagatctcagatgtgcagacttttcacaatctttggttgatagtataaaaaaatgagggaaggagagagagagtggataaacctgacctgctgttataatgcaatagagagaatgttacttgtttattggctaatccctagagagactcacttaatctagaatcagcattctaatggattgtgagggaacttgggttgggtgcctctcaaagtcagaagccacccaaaaagagttaacatctatgaaatggtgctccggaaggcaagaatggagctatgaaggctttctctgtattgtttgaacgttgccatggcaatcgtttccagcagaagttacatgttttcaattccccaaagcatcaagcaggcattccctctcacccattctccatccgtgcctgtgagccttcattcaagccattgccttcttctctgtctgtcttctctcttgtcctcacttctctcaagttatcccccattaataacaaaagtgtccctaccctaaggggtcacttgtggcagaaagtaattcaggcatatagtactctactcgatccattttcctgtttccccccttctgtttacgtattaaagacctaattagactgaagctgtggatagaagccgggttcggctttcccttgttggtaggacacagaacatattataatggttggtgttgtggtgatatgttaattggatcgctccaggcaagtgcagagcagccgtctctgacaattagaaagaacaatggctttactatgaagcagctccctctctgaatcagtgcagggattagcatgcactgcaagtctctagaaggttcctgtatacccaagacagatctgcagttagaaatgcatcctgcccctttaagcaagaatgctgctgcctttcacttagcttattttcctggcatgggacaagaagtgagggtagatctggctaggtgagctgcagaggaaaccctaccctgttgaagacctaaaccctaggatatatcgtgaggatattagcacggtctctttgcctgcttaatgcacgtggctggtgaattgtgaaatgggtctcattagagcctttcatatcctggaatgtgccaaagtgcattgcaggcacagcgccatcactttgggtccagccctgctgttcttcacagcagccaagaagggacagaggctctgtctgtattaaaggcctcagtctcattcccctctgtctactgttcattgtaaggctcctgtggccctttcagcccagtcagggatgaggcacagcacattccctaggtgtttgtggagaagaaatgtgaaagattctaagtatcactgtggagtttaaggcagccattggaggctgctacctacataaccccccactcccaggatgcctttagggttgcacttgttttgctttgtttttgtttttgtttgcttgcttgtttaattgttttcctgaaaatatttccagatactcacctgaaagaaagtatgggtagactgtcctaactaagccacattgtattattagatacaaaaactctttgctttcccccactagcttgacatactaagggttttggaatgaacctatatatcccagaatatagccccatctgtattatgagctaccatacattgaatattatgtatctcagttgcttggtgttaattaaaatacaacatgattctaaaaagtccataatataaaggcataaataaatctcagaaccaagtttagacaagcctcatgttactggttcagcacactcttcgttcttaaccccaaatttctcaactatattatgggaataactatagtatgggtgatgaggatacaattgaaaatatgcattaaatgcatttatcagggtttttttttaagattttttatttattattatatgtaagtacactgtagctgtcttcagactccccagaagagggagtcagatcttgttacggatggttgtgagccaccatgtggttgctgggatttgaactctggaccttcggaagagcagtcgggtgctcttacccactgagccatctcaccagccccagggtttttttttttttttttttttttttttttttttatatacttctaaatgtttgttaaaggatttgtctcctactgccccctttcttcgtggatttttagacagggtttcattatatagtgctggttggcttagaacttaatatgtagatgtcccaggactctaaatggcaatgaggtaatcttcctatatctgcttccaagtggtgaaactacatacatgatcacaatccctcccaaattatgttttcttataaaagcactgtgaaataaagactagatgtttgtctaaagaagaaaaggagattaagaaaagtgactaagtggttattttttaatgacaaaggaaaagggcattagaaattgagtttccaaatttaggatgatgtaattcaagatttgtcctttgtaagtttgtagttttgacagcaaaatctataggatcgatggcattgttgctttcatcttgaacatctgatttgtgttcatacatattagacttttttacgtcactgatgagctgcaccttgttattagcaattagctactcaggaaatgaaagaggaaaaatagctatgaagaactgaagcagaaataaacgaaaagtcctacaagcctatggaagtcaggcacagtctgacccagctgttcacaactctacagggacctcagtcctttttgggtagacttcccacatgcaccattctcatttgggggcatttggcttccactttttcaaccactcattgaaagatccacatgtgtgtcccatcattcacagacatcttaaggtctctattcacaggctagcacagccctattggagaaataatttaatcacaaatgggggtttctatcccgtctttgatcatttagttctacttccctgccaataaccccacatatgacttaccatattctgcctggctgctcttaactccaattggccagccatcatggtcatgttttcatgactcatctactccatggcttactctcctatctcctacttctttttctcatggtcctcctcagagcctaagccaggaaactgaaaacttcacctacctctcttatgcccagccatagctcgtccacatctttattcaaccaatagttttaaattaatgtgcaaggtcacatagcatcacttgctgtataagagcattctcttgttcttgactcaaaaataggcagtatttagcattgtaacacatagcaacagaccaagactcaacaattcccctttagtttaaataaaaaggctctttctgttataatactatgccatattattcatgggctgctcttaaattgaattgagtaaactcccaggatgaatatggcaagttatatttctgggttattggcagggaagtagagataatagcataaagggtaggtatctgcccagctctaatgcataaggcttatcataagtataaaaggttttgggtctcttagctgggaaatgaataatcaaagctgggttagaaatcccgattgatattaaataattcctacatcaccactcatatgcccactcatagactagtgcttgcttgaaaggaatagaattaaaagtcaagaacatccgtcacttaaaactgaggaccaataacagatgcaagaaggtaatataggcaattttacgaatcacaatttgtatacttggagagaaaaactatcatccatatctatgtcatatccagtagttcagaaggggattatacactggcacttcatactctaagtaactcatactctaccatactagaggtattagttatgttgatacttatctgagatgctatattttacataggtattgaaatttactatctgtctcaagaactgaaaatcatctgtgcccatgagttttgaagaaccacttcatctacgtcaatgtttcctttgcactgttcctctcgtccttaggaacagatatgtactcggggagactgtggtggggggagggaaatgccggcttatttgaaagatgaggaaattaaaacaagaacaaaagatccctggagatgtcctttaaatctcaaacacccacacttctggttagctgcattaaccatgcttctctcagctttgatttaatgtaatttgctagcacatagagttgtggcactcacttgccctttccttgagatcttcattttccttacccaggcttgatattccaaataacatgccacagtttcctttgcctcttcactgaaaagagggaactgtacttacattcaaataactgtttagcagtttctctgaaaacaagaggttgcttatcaagtacaaagacagcagcattactttttgtaggcttgcatgtgtttaaagaaaaaaaaaaacaagattacttttttgtacttgaattccatgctgagaacactacggtgcaatgatatgcttcaagcaaagtttgtatgtgtcttcgaaaggttctcagacagacaaaaaaatatgaggtaggttttttcattattattgtagaacaataaagattgccatttgcattccatcttaaagttgccatgccaatgggttattatatgtgatttttgtcagtttgtctttagaacagcagcattaatgctaagaagaaaatcaatagtatatgctaattattaagtgattatgaagtgcattctaaatggtttgtcttctataaacattgagtttacaggtaaataagattatagttttcaaaggacaggaaagggaagtttagctaggctcagtcacttttcgtatcatagagttaatgaatgtaaaaaaattactgttccagtcaaccctgatgatttctctgctagccactttgtcctagtatgacattacattactaaatatatgccaatttgggagctgtagagatgacttgaagttaagagcactggctgctcttgtagaggatctgggtccaatccccaggaccgacatgacaactcacaaccatctgtaactccagtcctgtggaatcaaaaccctgttgtggcttagagtgcatcaggtacccatgtagtacacagataatcacatcaggaaacagacacatttaataataaaatagattttacaaatatcttgtcatttgatttctccaaacttaaatcaagatatcaaagactgatagccattttatttgccattttgcttttaattttttattagatattttcttcatttacatttcaaatactattctaaaaattccctataccctccctcccccccgccctgctccccaacccacccactactgcttcatggccctggcattcacctgtaatggggcatatgatcttcacaagaccaagggagatttcctcccattgatggccaactaggccatcctctgctacatatgcagctagagacacagttctgcgggtggaggatactggtgagttcatattgttgatcctcctgtagggtttcagacatctttagctccttggttacttttctagctccttcattaggggccctgtgttccatccaatagatgactgtgagcatccacttctgtatttgccaggcactggcatagcctctcaatagatagctatatcagggtcctgtcagctaaatcttgctggcatatgctgtctgggtttggtggttgtatatgggatggatctctaggtggggcagtctctggatggtccttccttctgtctcagctccgaactttgtctcggtaactccctccatgggtattttgttccccattctaagaaggaacaaagtatccacactttggtcttccttcttcttgagtttcatgtgttttgcaaattgtatcttgagtagtctaagttactgggttaatatcagtgagttgcttttaatttttattattttattttagggacattttgagctttgacagtttgttacagtgttttgcagtatctgttttcttgacagctctggatattcacaagtaatgattatgctacactgctttaaacatattgaccactgaagatgagaagataactacacctgaaccccaagagtattgcatgaaccccagttacttgtcttgccctagtaacagtgaataaaacttcatactgtcgtgattcctgacaactaagcttctaaaaatctgcacagatattaattagtactaatttatatctaatatctctttcatgaagttaaaagggctctccttttgaggttctatgagcagttgattgttttgatggagtgtgggcagttagttttaaggatgtgtaggtctaccagcctccagtgtatgtctccatacccaggagtatatgaacagtaagaccaaagtacagaaattattaaattatattattaaattaattattaattgaaataaaaataaaagacatgaagttgaaagggtaaggagtgagaggatctgtgagtaatatacattatatttttatctagatatgattattttattttatgtccatgagtgtttgcctccatatgagcagattgtatgaatgtgtatgagtgtgtacatgtgcatgtgtgtgtgtaccatgtgtgtatgtgctgcctgcagagattagaagagggtgtcagttccatcagacctggagtaacagagagtggtgagccactataaatataggtgctgaaaattgaacccaggccctatgtaagagcaggtgtttataaacacagagaaaacactatcgtttaatgaaattattaaacaattgataaaatattttaagcattctaaaggagatatgtggtgataatgctagtcacaaacctagtagcacaaacatatctttatgttagtagcacaagtactttttgtctcagttatcagagcacacttatttgtgtaaagaaggaggatatattgttctaaaggccttaaggaattgtattcctttcctatttggatggtacatgagagaggcaggaaagcaccaggttactgtttttacaaagacagtactaaatgaagttaccattctcggctacctagaagctgaaccagatggaagcaatgctttcaatcagcccagactcctctagggtatcactctctattttgcctaagatgcagacactgcaacagcaggggagacaggctcagcatggcaggactgcaggatctaaggacacaaacacttgctcacttacacacacacacacacaacctggttccccatgcctttatctcagtgtcctaaattcctcatgtcttctgaagacatatgccacttcatcttcctctgctgttcaaaattcaagagaaaagactgcacattgaggccataagctatggatttaggtcatggtgtgacagtacgcaattattctcattccctactatatatctgacccaaaaagcccctctgaagaggatataaagtgactgtaatatcagtttggcttttgatccccaattctaaaggttttaaaaacagatggtagaggcttactgcggctgctcactattctatgctatctgaaacattgcttcttgtcccttcaggcaggcaagccagaatggaatcttgcttcctgttggctgtagaatatgcccctttcctatcctgatttgagcatttaacacttatcaggtccagatcactataatcaccccttgatttgcccttctcctcccagttatttatcctccaaaagcactgcttttgtgctgagctcctactagctaaccctcacttgtgaaatagattccagaccctgaaacctggcgttcttccaaaaacctttgtatctcggctcttcttccttcaaacaatctagtaagtattcttggctgtgctataatgcctttgtcctggtttgtgtgttctctttttctgcaggctcattatttgtgtctcttcatgaaatatatgggctttctgagcctagtccttgggcctaatttcttggtactcactatcatccagtcatatacagctatgaatataattacatatttaatatgtatccgtattatgtatatgtcttatctgactcacaatacaaaaataaattctgttctgcttgtaactactgatcttaaaagtgttataatgggccagagagttggctcagtggttaagagacctgactgcccttataataaactccagttccattcccatcacccatatggtgactcctaaccctctaaatctccagttcctggggacctaatgtcctattcagaactctgtaagcaccagatatacaaaatatgtatatgtatatgtatatgtatatatatatatatatatatatatatatatatatatatacaaacatatatatatatatacaaacactggcaaaatattcatatatatagtatagtatcaataaatctgaaaaaattaaaattaaatgcaagcagtgtttgggcttttattaggttttctttaactattttaaagagaatctaattggacccatgcaactttattttctgtggcataaccacacagttatgtatcacttctgataaaaaaacaactctgtggagaagcttactttgaccctgtttataaaagagccatgcaaacatgagaaattccaacagcagcttcatcaacagtgcagtattctgcgtccattggccaagccgtattctaataattactagttaaaagatggtgtgttggtggatctagtgtgttgtgttcattagaagtcgatggcttttgttattctaaaattatgtctgtgcttaccaaaataactgatcactcatgcagacagatttttcttttaactgttctttttgttagtgttctaagatgaagatggagctgtaagtcttaatgttttcaaaattctgcctgtgtatattattctgatatagcacagtggttcttgataaaactcactctcccaaagaggacagataaaattcatactaacaagtagaagaaaaacctcagaatcacacctgtttcccacgatattaaacagattaaaaaactggccttttccccaactttactgagtaatttttgacagtaaataatattacgtatactttaaattttccaccacatgttattacctgacccaataaataccagaaactgatgatgaacatgagccacgtctaacactctttgttgaaaatgttgagcaggtaggtgtgagtaaaacaggaagtgtgagcttatttcttccaagcttccttagtagcctggctacagcagccatttcctgatgctgaattttgttgtcacatggagcttagaatattgctgctggctgcccacaagactctaagcaagttgccattctttcttagagcctttgtttctgtaaaatgaagaatttgattcagagtattgctctccaatattccctttagctctctcagagtcagaggcatttcatagacctattttcagataatgggtctatcttggccatggagaatggaaattcattctcttgctcgccttctcgtaaattccagatggcttatttcttttctttacatctctggcctttcctctgtctctctatcatgcttataaaatatattcattctctcttctgtctatgtctggctaagtctttggccatttcacagttgcctttgtgtgtgtgcatgtgaggctattccgcagggtaagcacttaattttagactcgcttccactaattaactacgaaattaagtaggtgaattcattgattcggcacttggtttgatgtttatattaactcattaaaggggaagccctggatgtggccagaggcttgacgggaatcccccctcacttgttatgcccctgaacactcctctgacttcccacactgcatatctatcttgctatttctcagaagtattcatgtgtctggggagcagccaaatgagcaagctgcatcctccaggaactgtatcctttgtgaccacagaaacaatcattccttgctctgctccttcccaggcattctgaacacaactccagttttatttttgatacacctgaagaattctcagcggatgtaaagagattaaagtgataggctttcaatattagattctcccacagcctctgccctcatgcccacctcaggaggaaataggtctatatacctagatgaaattttctccttgtttttattagaaagaatgtagatgaagagcagtcaggggctgagcatgccacaccgaagcctttgccttgtttttctagaaaatttaatttggggtttatggtaatgactccttctcatggttttgtcctttgctttgggaaatagaaaccaccacaaatgtgtcaacagtggctatgcaatgtacaatcatgttttcatttttaagggcatgggtatttttttatttatataaagatctatggcttctctcaattccctacaaatactatgcaactcacaaaacatgttttgtggtaaaatagaatgtttggtaatggagcaatgatcatttttaaagagacctttcagtagaacctactcaagcattctgtgacttgtctaaaatagcttagcaaaaaatgcaagtgtaggagtatatgcatgtgttaatattttctctacctcttacatgttattcttaagttaaaatgtgttaaatgcaattaccttaagacaccttcaatcctgttactgaattattgtgctgagatactttgatttcatttttctctcattgcaccaataatctgtcattcacttcaccccacccaagctctccatgaataaacctatccaggtgtttttaacacattttcatagctacttaagtttattatctatctttgcccaggattctgtgctctgtgtacatatgaagccaaatatattcttccctgtgaacttctttggtgggtcatagttgttcaatacactttttatgaatctgaaaaatataaatatttatccaagatgacgcattcttcaaagtgacttgtgtttcaaactttaaacaaacaaagagggagaattttgatttactgttaaaaaatatgttcttttcggttgtaattcactagcagctatacagccataggatcctttttctttcttcctctctctctctctctctctctctctctctctctctctctccctctctctctcttctctcttctgtctctcttctctcttctctctctctctctctctctctctctctctctctctctctctctctctcttctgtctctcttctctcttctctctctnnnnnnnnnnnnnnnnnnnncttctctctctctctctctctctctctctctctctctctctttctcttcctccctccctccttccctctctctcactcactccctccctccatcccatcccttccttccttctttcatttctatttcatttttttcttttttctttccttggagatcttattcctgaaaaatatagtaaaatttatacaaattttgcttttaccatttcatatatttaatttgtcagatatttcatatattgccaagacccctgtctgtggatcttgcttccaggcttagtaattttagaatagcttttcatggagtctccacagatttagaagtcagttatacctttcctaagtatttgaatcatatgtttgatacaattgttaaatgaaaagttggattgcattatgctctcatcataaaacctatattcttcttttagtacataaggttgaaacttctgtatctcatatttgtggaaaagtttgatttctttaggccatagcagaaaaatatttatcattatcataaaatgaccaccaaataattcttctctaataaaagtttcaacatattttctcattgtctactgcattccccatgtaccttctacttaaggccagtctttcagttgttaaaatcgaatagtatctttgcttagttcctatgcaatgtaaagacttttcattgtattaggcagctctgaattgatgtgtcatcctgatgcctcccgtgatattttacagtactgaactttagatagaacattctacaacagggcagaaagctagcccagttataatcgcataatgatgctatgagtgggagaggatataagttgtgggtttacagatctttgttcttattttgttatgccatagaatgtgatcggatacaatgttactataagtcccatagttctagcttatggtgattaagtggatccattcattctcactgagttcatgccatccatgaaagataaccacactgatgcccatgtgctattaacattgccaatgagggtctacatctggggctaacagaataaaggactagggtgtcatcctacattggaagatttagccatgagcaggaaagcatcaaggcacttcatgtggcaggaatagtccagatcttacagtcatgaaagctatttcctgagagctggatagccagggtctcaggatactcgtgtattttagttccctgcaactagttaaatggttgttgtatggcctgtttactactataaaattctgatagctttaaaattgttcctccttagtaagatgaaaaatggaatgttcattcttcccctttgtgtctattgattgagggacattaacccagctgtagttttcccttatgttttatgaaatcatttgtgccgtgattcccttctttgggtttctctttaccacttacatttgtttattcattcattggattgtttggtttcctctgaggacaatttctgaagattgcttctttcctttcaccatacggaatttgggttgtcaggcttgacattaccttgatgagcctatacctatacctgatgagccaccttgttggccccacaccatgttctgacggattccagtaaaggcaagaaaacacacacacacacacacacacacacacacacacacacacacacacacacactgttaataaagatgaatgtgcatattataggcaaagcccttgattggagcttcactactggcagaagtggtgaggaggagcattggataaaaacttgttgagcctaatgttatacatcagacctgtaatcctactttcaggaggctgaggctgaaggactgctacaaacttgagggcaacctgggctggagtttggactgtgtctcaaccaaatgaaagaaaaccctatcacttgggaggtagaaacagtaagctcaggagttaaggtcattgtgggctacatagtttgagactaatcaggtatacatagccaagaaaaaaattaaagccagatagaactccagaggaaaaggcaggtatatctgagttcaaggctggcttgatctacagactgagttccagaacagccaagtgtacacagaaaaaccctgtctcaaaatagataaataaataaataaataaataaataaataggaatgaaagaaagagagaaagagaaaaaacccacaaaaacgtctttttaaaaagaaatttaatgtatttaaagttacaaaaaagaaattaaatgagaacacttttgagacaccagttccatgagtgtgatttgattagaatcatttttgttttaaattagatattttatgtatttataatttaatgttacccctttcttgatttcccctccagaaactccctatcccatcccctgcatctatgagggtgtttccccacccactcatccactcccacatcaacaccctggggaatggagccttcacaaggcaagcacctctcctcccactgatgccagacaatgccatcctgtaggacacatgaagctagagccatgggtccctccatgtgtactccttggttggtggtttagtccctggaaactctgggaactctggttggttgatattgttgttatgcctatgggattgaaaaccccttctgctccttcggtcctttctctaattcctccattggggtccctttggacagcccaatggttccctgtgagcatctgcatctgtatttgtcaggctctggcatagcctctcaggagaaagctatatcaggctcctgccagcatgcacttcttggcatccacaatagtgtctaggtttggtgagtgtatatgggatggaactccagggtggagcagtctctgtatgtcctttccttcagtctcctgttcatactttgtcctcccccccccatacttttttctcttccttcgttccttccttcgttccttccttcctccctccctctccctctccctctccnnnnnnnnnnnnnnnnnnnntctctctccatctctctccatctctctctctctctcactattttctttagacagaggtattctgggttaaaaaattggagatgagtgagtggccccatctcccaacctgggatcttgcctaacctctgtctatggtctctacaggttctttctcacttttgttgggtatttcagctaatctcagccctgttgggttctgggagcttcttgctttcctggcatctgggacttgctggtggctactgccaattccccaccccacattgctaaatacctctgttgaaattcctgcccctttgaatattatgtctcctctcatatctgatcctgccagccttctcctcctcctcctcctcctcctttcttcctcccaagcccctcccacactctacctctcatgagtattttgttccccattctaagaaggactcaagcatccacattttgatcttcattcttcttgagcttcatatggtctctgaattgtattgtgggtgttccaagcttttgggctaattaatatccacttatcaatgagtgcatagcatgtgtgttcttttgtcactgggttacctcactcagaatgatattttctagttccatccaattttctgagaatttcatgaagtaattgtttttaatagatgtgtagtactccattgtgtgattatactacatttttttgtatccactcctctgttgaaggagtggtatacctgggtcttcaggtcgtactatgtccagttttctgaggaaccaccagactgattttcagaatggttgtaccagcttgcaatcccaccagcaatggaggagtgttcctctttctccaatcctcgccagcacctgatgtcacctgggttttttatctttaccattctgactggtgtaaggtggagtctcagggttgttttcatttgcaattccctgatgactaaggatgttgaacatttctttagttgcttcatgtccattcaatattcctagttgagaattcttggtttagctctgtacccccccccttttttccccgagacagggttctctgtatagccctggctgtcctggaactcactttgtagaccaggctggcctcgaactcagagatttgcctgcctctgcctcccaagtgctgggattaaaggcatgcgccaccactgcctggcttccgtaccccattttaaatagggttacttggttctatgtagtttaacttttttagttctttgtatatattggatattagccctctatcagatgtaagattcgtatcgaacttttcccaatctgttggttgctgttctttggaatgcttaaaggaatgtgtgactaggatttggtttgtttagccaagtgcataccaggaaaacacaagaacctgagtttgatccaagaacctacaaagtgtttggccggtagtgcttaactatatccctagtactgagatgatggtgactgaatgatcctaagagctctctgccttgcaagttcggctgacttggtgagctccagcctcaatgagaattctaactatctctaaaaaaaagagtgagaagaatgattgaggaagaccccagaaactgacttatagtgtgcaatcatgtgtgtgcatatgtgtgttcacacacactcatacaaacacacaaacacacgcacacaagcacacacactggagaaagaaagtaaggcaggggaaacaacaaacttttaatacatgaagaatttcaagtttctgatctactagaagagaatgcagtgctggttctggaatggctggctagttgcttttcttgtgtaggatctatggcatgacctctgagggggaaataatcattccacagtggttgcatatcatatatcttacatatcagacatttacgttgtaatacaaaaaagtagcaaaattagagttacgaagtagtaatggaaggaattatatatttgctggtcatgacaacatgagaaactgtttaaagggtcacagcatgaggaaagttgaaaagcactattacactatgctagttgaaaaagatttatgttgacttattgctattgcttttcaacttttggaacatcactaatctttttaatttcaacttttgtagaagaacattccttttaaatatcataatctaagattgtatataaaacacagagcttttaaagtaccaatattagtttcttccattagagaataaaagctgcaccaaaatttataagttaagatacagagatggattatacttctaagtatgttttcaaaatctccacaagggagcctgaataatgtacaggctatgttgaacatcatggagtttaatagattctctattaaatagagtccaaaactgccatgaattaatgtcatatttttagctgttccttgaaaattatttgtggctaatttctttcccagtgtcagtttgatgtacaaattctaaaaatatctctaagtgtcatgtctttttttttaatataaagaataaatgttcatatgtttatagtttcaataattacaacttttttcatttaaatgtttagcacattgagagaaaattattttcaagaacattggagttctttatagtcttatgtacttttttattcttctcattgttacaggaatccatttaagaaaaaaataattatttgtcttatagattaagggagatgccatttagtatatagtaaataagatacagcaacaggaatacgaaatggttggtcacatccatcttcctgacttgtgtctacagtcagaaagcagaaaagaaccaggaagcaagtctggatcctcctctaatgacttattttctctatccaaactctaccttttaagggttctacatcctttcaaaatgacacctaaatagaacaagctcccaaatacatgaatctatggggtaatatttcatatttaaacactagtattatatacgtatgaaggcacatgcagtaaattcccaatattagaaagaattttatctgtagccaattctttagtttatagatatgatggcttttgaataatgttttggaataaaagctccatggtgcaagttgggatgactttgtatctcaggctgaattgtcttggttggtaatggtcaatatcattagttgtttattgtagcatgaaacaaaacaaaagcatacaatagggaatttcttatggcagtaaccaaataaagggaaaaattgagttttaaagattttgccacctcaaaagataatgcttaaagtctccatagtactggaaacaagagactgttgctttttcttatgctgtgagggaatgtgctgtgacaaaggtataagggactcattgacttaggagctctctggcattctcataaagattggatttcctcctcttcatcctttgctacccatgctgtctatatacaatttcatcttcagaataaaggaaaacacggaaaacataaaggttggaaacaagaaacttgtgaagcagaaagccagtaactgccaaatgttaaattcattcctatggagatgagtgagcctatcatggtgtgtagtatgagacctaatataatgttcataatggctcattctctctctacatttatttcctgtttacatgtgtacatttatttacagcaaaatcagtcctgaaggtcaagcctgaggcatgaccaaagtactatcagttttgcacatacaaatgcctctatatgtttctgctagctgactcacttaaacagatgtttcatatgtttgttgaaaatataacagcacttacagtcactgaaggagctcttacacatgtaaaaacaaactactgctaactcaaaccaaaacccagttaatttaggaggatcaattgaacttttattagaagctaagactacctatgacactaaaagtattaactttatcatatttcctaaatgcagattattctttccagaaacaaaatgaaaaaattctactcttcaaaattcttagtccccaaacccttaccatcttcagggaaagcacctgattaagataactgatatatgatagatgcctttcatgccactgaagaccaaaacagaatgacacttgatttaaaacaagacattgacagaaagaatagtagaactgttactaagtgtatgaatatatgtatgtgtgctctgatatacaaaagtcgatgattaatatagttaggaccaacttgaactaaatattgtcatcatcactgaccaactaaactccaatcttcacaacagaaataattgtctaatttcctcacttaatattatggtaagtaatctggtgttagtgattgttgtattaaggttttcataataagctggacatagtggcacacgctcttcatcccagctctcgggaggcagaggcaggcagatttctgagttcgaggccagcctggtctatagagtgagttccaggagagccagggctatacaaagaaaccctgtctcaaccctccctccaacccaaaaaaagattttcataataaatccacaaataataagtataaatattcttttgtctttctttttcattcatattacttagaataatacagaattcagtatagttatgaattctcatcatgccttgagatgtattggaacacaacatgactgtagctgtctatttccttctcctcttcctcctcttctctctattcttattctaatgagacacattgataaagtccatatttctactacaatatattaaccattgtatgaatgcagaaatgggccctctgtatatgttttaaatctgtcaaattctttcttctcatcctacaaacaaactgattatgtttggatatgccattgctcctgcagcaattcaaatcaacatgaattgagcagactcctagtaggaggattttaatgatttatttatgtatgcatataatccctccatcagatgcagactgcatactcctatgcctgagctgaattttattcatgtgtggacttgttgccaggctcttaattctgctgcccagattttaattcctgacaacacagttgtgccaagtggcaatgttagtgctgtaaggagttgaattttgcagaaatatttaatacctgctgtgtctatcctctggaaaagaagatagtccagtcttttaaatcagttggacttcagtggaaatgaaattttaaatttactttatatatttttatatttcaaagttgttaatcatacccagtaatgcctcttaaattaagtattaattaatacacaaaatggcccttattatgtcatttaatacatatagaccattgtttattacttactcatatcttattctctctcaacctaccctatcacttctctgtgttacctgctggtctccttcccccttagtgtacattttaatcacagacactgagtttgcagaagagataacaggattgttaggttatgcaggatttaggaagcagtgcagaattaaatccccctttaaaaatgtttaaagcccagataggcacttgaaaaattaagtttcccaacattatgtgtattctcaaagcacatttaaattacttctacggctgcaataataaaatgaaataggaaagtaccaacatgaaatacataaggcagagttaaagggcaaagtaatgagatcaatcaagccaagaagataatgagagacagaactaccaagcctacgctggagaacaggacactgatgggagcagatatttatagcacaatgaagaaatgttggtggaattttgcatgaggtgctatggggaggtagaaagagggaactttaattatgctctgtataaagggggttcaaaggacaagaagaatttattttaatctgtgttgccttcagagcaacagagttcgaagtaggacaaatcccacttgaacctttccttttaattgtgaagtatgaaatgatggcctttgctgtcaagtttggcgttgtgaaacaacacaaaacaatgtgtttctctttttctctgaagtagcttgttattcatatcatagatgtagaaacaggtaatctgtgtctgctgagattttataagtttccaaagggagaggcaggaaggagaaacctgaaaggagttctcatgagaggagacatgagaaatgcccgctctttcctagggctgggtagatagtgagaggaggctatctcaaatatcaagcataatttatcccaatgaagaaattactcttcttggcagcttttcccagggtaggtactagtggatacaaagaatgatcttagagggattcttctccaaatcaggttgcagacttgactccttaaaggagcttagatgcttatatcagggctcatgagcactccgccccgccccaacacacacacacacacacacacacgcacgcacacactttacagctttagagatatctcttctttctatattgaaactataagaattcaacctgacaatatgtggattcctcgctggccctcattgttcctcattgcattgcatatgaagcaagtaaaatgaatgagctgagagcatatatgttaaagaatttaaagatttcaacaagtattttttttaagtcaccttgaaactttttttaatcacaagttgaattaaaatagccttcaatttgggtatatgaaatatctgcatccagcctgatgatttttaaaaatgtgttttcagcaaataactactgttgtggtttctgtgaacttgagattgaattcacccctccccctaggaaaggagagggaagcctggtgttgctagggacacagtaatcattgtttctaagtgctggcttcttcagttgatagttaatatttaatgacagtttgctatatagcaatggcagttttaagtatctcatacagagttgttggaagaacagtaagctataaagatatgtacttacaaaagacaatagttacagcgaaacctagaagttcatttgtccccaggaataaaacagaagtagtggtgtggcaagggaagttggtgaaaaatgtattaactccatcatacatgtaacacttgtcaaccaatggtccagtttttttccctttcctctccttcccttcctccctcttgcttatcttccctctcttccttcctttcttccctccatccatccatttttcctcccttccttccttcttttcttccttcttttcttccttccttcctttgctccttccttcattccttcctttgctccttccttccttccttccttccttccttccttccttccttccttccttctttcctttcttccttgcttccttctgtccttccttcctcttcctctcattctttccttccttttttgaagtagtcttcttatatgaccttacttaattaataaaatttggccctaaatttgtaatcttttagctttggctcccaagaactaagaaaacaaccatgtacacccctgtaggatatcagggtccttcttttgtttagtcaattctgtctagtttgatcctctccggattactgttgcctttaaaaagtacatgtctcatgtgagactctaggacaaagagctccatttaaggaacagaacctggaggaagcatgccacattgacactcatattctccattccagatttttgtctttatgtatgcatggtccttgaaatttcatttctacataatctccttgcaattacacatatatgtaatgctctactgaggaatacctgatgtatcctcatctataggcaaaaataatcaagcataatgaattaatttctcttctaatagtgaaggctagcaatttcctccataagaaaggaaaatgtctcagtagcagctacagatattcttacctcttgctaataacattcttcccacaacatttctttttaaattttactgcgcacttaaaaagcatcattttattttattttgttgatcattgtatacacattgtgtattttctcattcttctaattctcttttcagatgcaggaagtcagttttaaaataataatagtagtatttgaaaataagaaagcagacaaatggcaaaggttggtattagttggcattttctttttgtatattattttccctggtaatttttttttgtaaaaatagtgttctctgatgtccccaacttctgtcaggaaagctccttgggtagatttcttttattttttacagtcctttcatctttgtgcagagtagaagactttttcaggttgaatatctaagaatactggctgggagaaaactactttgttcagttgtggctccaatattttactcataagatctgagactttgaataagtctggaattttattggccatcttttttgtaagatatataaaagtctgaatcaattttgagctgaaggatactttgtgtagtccatggtaaggatctgatgtagcttagtcttctcatcacctccatcatcttcatatggagttggttaatagtgatactattattactagcaatgatgtattagtcttacaagtgttgatttattgaaaagaagacacttggtccctacagtaacagagttctttttgttctttacttaatttggacatgaaataaagatcataaagtaataaagacttagtttgaggatttcactttttctccctcctattcagaatgtatttaggttaaactaaaatgtagtttttgacctcatagattaaatgtaagttaaaatgaattagactataacaaaggtattgagagtttgtttacttttgatagctgatcacaaaatgtgatttaatattttctctataggaagatttttcctaagttctatagtaaaatgataagaatacatgaaaggtatctatggatcttaaattctaatagtacaaattagactaatatgtaaaagaagttatattattcagcataatatgcatatgcattctactataattacagagttaaaataattgctattgttcaaatattatactgagaaaaatgatattcaataggatttggaggaactagaaagtctagaaaaaagttttctaaggtaaaattgctttttattgcacaaactctcacgtctcatgcaaggtcataagaaatttgagaatgtgttccagttagctttaaaagcagaaacttgtgcaatcagtatacaattttacatgtgcagatgtttatggaagtcaaagatgaattgagatactgtgatacatttacagatgaaacattttattcagtattacttcaagagacatgaacactactgtgttctttgaagatacagaatgtttacactatcattctacaaggtttgaaggtgtaattatattaaagatacgctgctcttccagagccaagtgtaaccagtgataggtatctctgttgtttcttgaaaagtaaaggtattgattttcatgtaagaaagttaatggggaaagtgtctctggtgtatcttcacagcagtgacatgagggtgtaccattttttcttggttactctgcatctgacatttttttgtctttaggatttacttacatgattttcagaggctatataataaacaaaaagaaaacaaaacaaaaataagaaacaaagaaacagcaaaaacctctgttcttttgcaataagtggacctgtgaagaaatagaacttccctccttaatccccttttatgtttaactggctagaaaattatactcaaacaaatctttagggaaagaaatacaacagtcacgattatcattggtgagtgaggtgttgcaattccctgcttcatcaaagccttttccaaatacttgacaacatgaaagaggatagacttgtacataaaactggagtttgtcgagtatttggagaatatagagatgggaatataattatttttattcattaatactgtatcacacttgacacatagtaaatgatgtttgcctttgtgactttatattcaatataaaataaatttcttgaattcttatatttatggaagagagaataggaagagaaagggtaggatgaaaagatacacacacagattcagagaggggatagagagagagagagagagagagagagagagagagagagagagagagagagaggaaagagagaggagagagagggagagagagagagattttagacagtagatatttctggtttttgttttttttttttttttttttttttttggtcaagtctagatagcacagaatgaacatgtcaatagaccaagcattagaattatattgtgagaaactgattaaaattgggtggcactgtttctttcttggcatgataccaacttatttcagtaatgtattaaatagccctttgaaacacaggagccaaaaaacaatgtcctttggaactaacacttttcaagagtttccaaattaatggaaagtgcctgcattaatgaaataaaacatcaagactttggcaggagctgattggcagaaatacccagtcgcttgatgcatctgtctcctgaagacacaaatgggtttctccttgtaaaagagaatgaaaaagtggggctgatgctaaagcacaagtctagagaaaaatgacttcctatattttgccagagaaagcacattttttattctgatatctttgtgccaactaaattgatatcatggttctaaaaaagaatagtatattcacagtcacaggcactatacccttaatattcagttaaacaataaatgaaaagatgttgaaggaatgtggtatcctcctacttttttgtttctttattttttatgaggacaatctctaaattcactggtttcatttatttatttttttgaaactagattctttactcatacaaaatactgtggttctagttttcctttcttctatttctcccagttagttcctccccatctcccaccactggattgactccatttctgtctctcacttaaaattaatagatttctgacaaccaagtgtgataaaataaaatataagatgaagcaaaaactatcatattgaagttgcacagagcaattcaaattcagaaagagtcccaggcgcaggcaaaagagtcagggactgatattttctcatagtcagtggtcccatcaatttctgagttaatagatgctatgcagagggacaggtataatcccatgctggccatgttcttgttgtttcagtctccaagagctcatatgagccttttttaatggactcagaaggccttatcctcctgatgtgctctatcccctcagacacgtataatctttccaattcctcttctgcaggatttcccgagacctgaggggtagaatatgatagaaatttccaatgtagactatctcttcatataatgtttgactgtgagcctctgtttctgttttcatctgctgccagagatatcaagatatatgtaccagtgtttacagcaatgcctgggcagtatttaattttattaaccctttaagctaatctggctacttctcagtcatgatcccatgattcttgcatattattattgatctgcttctttgggattgacttgttttttgtttttgtttttgttttctcactgtgtcttcttggaacctctcctcatactggctgattagaatctcctttcttctctttctctcaccttactagcagaagtttccactctattttctctactacctagccatttggcagagaataaatggtaagaattgtttgcaggaacttgagacaggacactctagacataagcattaaaatgctgtgttctgattgaaacaagatatgagggagagaagtcagcatttgggtaacacaaagatgaggtttccaatgtgcacaagaacaaatatggaccagtccgaattcttctacatgcagacgtgcagtttgactagcaccatttttgaatatactgtctttatttcaaagtgtatttattcctctgttatttaatacattcaggtgttagtatgtttttggaattatgtctgggtctttaaattgattccattgaaaaatatatatgtttttgtgctgattccatgcaaattttattgctataactctgtagaatatgagattttgtttgtttgcttgctttattttcagtcttcttttttttttttcttttctgagacagggtttctacatgtatccttgatagtcctagaacttagtgtgtaaccaggctgtccttgaattcatagatatcctcccttctattacctccacagtggagtgcttggattgattaaacatgtactaacaccacctggcttatacttgaaatcagatatgatggtacttccaaatggtcgtatatatttcagaattgttaaaactagcctgggtgttttgttttttgcacatcaaattgagaattgttattttaatgtctacaaagagttgtgttgaaattttgatggggattgcattgaatctgtagattgctttcagtaggggaattaaatttggaggtggaggtttttgtgatctttaggagtggtgtgcatcagagtagaaaaagaaatcatagcaatttcctgctacagatctgggaattgcatgcctggaacagtataaagggtgtgggtctgccttcagcctacttgttgccttgggaagaggggagtttgtattaacagcggctgcctcgtgaagctggagtctgatacaaagcaacaagtgttgggcaggaagttaaaaggtgacagtttgtggaatccacatgagatgtgggcataggagagtggaggctgcagctggtgttctattgcagtgtgggaacaaggctgaggaactggtttagggaagtgatacagagaatagaccgtttgctggcagcctatttggttttctggctggtatcagttccatatctttcttcgagatgagtctggattcatgagttggggttgagtagttagtagatgggttcatatacaaggtttcacgtttgtgcattcatttatagattaatctgttcacttattcatattttcattcaattacttaagagttttttttttttttcttttttgagcattataagcattcaggtttgtgaagatgaaaggagggagtttgaggcatgcatcaggtaatgtaaggagcacaaactagcaagtctacatttttgatgactccgtaggactacacttacagccttcaggtcttgtaacggaatactgaggttctaagtttacatcaagtcaattcaatacggttataactattggtttcaaccttgttctataaactcagattttgatattccaggacagagatctttccactatgaagtgaattggtctctatcctaatcacagattcatcctgtctataagtacttagacaattctgctgtcaaaatcctaactctcttgaatttttcagtgtatttaaatcaatccaacacaattaagagaatcagacatctcaaaactgaagtcaattcgtagtgctaataaaaacctctgtgtttaagatattagaattttacccaaggaatgaataaatttactaagaggaaggacttcttctgcttcactagaagtaaaataaatgtacttgatatattaaatgtgttttctacagttatttttagctcctcttaaatgatttatgtttctcttatatagaatgaggatgatagaccaacaggctagttagaaataccagagataatttacaaaaccttttaaaattagctattactataccttcaaatatttaccagctcagtgactgacatacctaagctaggttcttctctttgcattgcatgatgagagagagagactggatcagaaaggccaagggtcttacagaaagttccattcctcaaaagcagattactgagctattttcctctttgtcttaacacaattttgactagctatactagctgttaattgaataggattatgtctcccatacattaaaaaaattcaggaattgtataatgttattaggtgtatttcatgtgccttgagtaggaaaatggtacatcagagtgctcagcagttttttgggtttttttttttgttgttgttgttgttgttgttttggctaagttgccagagaaatcactattgctaccaaatactcaaaattacatgggtaattgataatagactggtgccttaaaagccttcaaactgtttttcaaaataaacaattttctgtgtaagattagtatttcgcaacagttatagaatgccagctaacacaaatgctactgaataataaatgaaacgttcttctcttgtgtacacatgcacacactattcaacttgcttaatgcatgtgaaaaagaaatagctgtctgatcacgtctgagaatagtatgtcatgatcataatacaattttgaatttatatatacaaatttatactttcatgtcttttttgcatggagactataaaatatgggccaagatcagagacacatgaaactaattaacaattgttcaaggcttccaattcagtccttctattttgtgccttccactctcttggcctgtcaccaggtactttcagatgtcagtgctttaaacaccaaggaaacaaacagaaggagctcattttttttgtggttgtggtgaatactgtttcataactcttctattgtatagtcatagtctagaaaaagttttttatagaccttgtactcccttgtccagctgtagtctgaaaagtataagttcactaagttccatgaaagtcagtttttaaacactctttaaaaatgactaataataatgtatttcaccaaccctatcaacatgtcattaggattggtgatacaaactagagaaatggaaaattttctcaggtgctaactggcattttgctggtggtgtccctcaagatggagaacccaaccaagacccaaatgtcatatgcaaaattacagtaagtatcagaaatgtatatgtcttgatttgggggctgtgagcaaacagttgtttatacagcctagagataaagtccagagagtgggaattcatcctactcagtcatctgctttcaggcttactatataaggcatgtttttgttgttgttgttgttgctgttgtttctattggttacttgattggttggttgttttttagtaactaaaggtatacagtggaagcaaacattttgtattctaatgagtactttaaagtgataatacaacatacaggaatagagataaagatcattggcccacttggctaacatctgccaagccttggatttaatcactggtacagtataatggcaaacatggtgacaaatgcctaaagcctcagctcataggaagtagaggcaagaagaataaattattaaggttttttttttctcagatgcatagtgaccttgacagcagcctggagacagtggcactctttttctgaaaaaaatggaaatagtaataataataataataataataataataataataataataataacaataacaataaatatagccgggtgtggtggcacacacctttaatcccagcactcaaaaggcagaggcaggtggatttctggtctacaaagtgagtttcaggacagctagggctgcacagagaaaccctgtctcaaaaacccaaaataataataataataataataataataataataataataataataataaatatgacactataatatatagcatattatatacatcacaggtataaacttttgaattctcaaaacagtcaaatgacctgtcctactcatcttgtcacttaagaaagcaagatgaaagagctggtgacaaggtagagaagcagcctggggatgctgcattcactcactaacaatgccctagaccaaacaacaaacaaaaagacctagacatagaaggttaaatgactcatagaaggtcctgaacatggtttacgtcagagctcgggttctgatccaaaacagtgagtgggctgcagagcagcttgagagaataaattaataatgctcaaaccaaatctatgaagtttcttcacttatctttaaaacaaacaaacaaaaacgaacacatattcttccccatcctgtcagctaatgagatagtgtgcaacaatggatgctatttacactgacattagtatttgaccaacccaaatgatattttaggtacttactggtattttcatatcttaactagtagataatggaaataaagtggcattaatagcaagtccttcccctcttctagaaaataccataataagactcctcacaagatctttccatttcagcatcaactcaaaagccttccttgcctttgctagtatttatcataacaacagggaaaccaattaaagaagatctatttactttgtgtcctgactggaattctcttttagttagacctcagattttaaacaatgcttccgatctttaacttctttggatagaaatagcctggaatatttgaaagtagtaacaggaaagtatagatcaagaacctgtttagattacagctttgaaaacaaagatttctgaagccttaattaatctaataaggaattgctcctatctacataatttatagaagatttatataaaatcccttttgatttcaatgcttttctcatcaatattgtatgtattgaagcacttcactctggcgtcacatgcatctttgcacacattccattggtatgaacaggaaggagagtctaaagtctatttctcaaaaaaataattattaatgttttgtatatatgtttgtatatctacacaaaaatgcttttgcagagctagttatttataagcatgaatagtgacttgtattttagtacgtatattacagaaaccttccacctgctttgctttcacttttcatattctctccattgcaactctataggaattgtctactttgagtattaaaggtcagaggaacaagtaatattgatcttaggactacattcaaaagctgggcctttatatctttggcatcctgtccaattcagaccatctctgctctacaaagacatgtcaaataaaagcaaaatttagtaaatattctcagaaaggcatttttattttttttcttcccctgtaaacctaaatcaatacttgacctttccacattcttatcaagataatatggagtctgtcagttttgacttagagctgtggaatgtgtgtcaagatccacttgtcctatgagctctttcttcttttatggacacacatgtgtgttaggcatatatgtacatatgtatgcatatccatccatatatagatatagatagatatagatataaacacatatatatggatatatatgtttatatagatatacctatgtctattagatgtgatatgtatgtaagtaagaatgtcagatgtacatataggtgtgtgttaggtgagtaatgtgtttataaatatgtatctttctatatatacatatattatagaagatatatatgtatgaatgtatatatttaagtgtatgcatatgtatatacttctgttttagcaattgagtccataatcaataatatcttcccatcagtaaatgtgaatatgatttcatagattttacagtgcattaatttgtaccatcttcataaaaatacatatttatggatagataagtacataaaatataataataatattgctttagaaattaatagagtcaaatttttacagctagatgagagatctagtaaccaattacctgctaaccgggcactctaaggaaggtcttcctcacagtatacctaagaagcaggtcagttgttcctgaatctttgctgtgtcagaattactgcagcaaaaatagcaggaaatgacatggctgttggtgtacactaaggaacaccatcagcgcaaaggttgaagtcaattctttcaaattaatgcaccttattagagccaaggagttccttcagtttaacaggaataaaaggagacacattaatgcaaaacgagaaagtaaaaggcctggcttcgtgcttgtttcttatctcaggtatgcaggcctcttgacctctgaattaaatgtctcacacattcagctcttttttttttttttttccttttggttatttttattttcattggaacaaacttcttggatataaggttgggagaggagcatcaggaagtatgtatatttggaaatatctctgcaagttttcatctagttgcagatggtgtatagaagagtgggtgcaagggaaaccctgtgtcctctgggtcaccttcagttattgacttgacttgaatggagtctaggctgaattggcctcatctaacagaagttaaatgacaacatacaatgtcttagttgtcttcgtatttaatcacctcaaactcctcctctttataaaagacagaataacacattcctcatagtattataatgagaaaagcagagtccatttgtcaaaaactgaaatgatgtcaccaataagaaagtgtgcactggcatcaaggcctcctatttgcaagaatgattgacatctggttgtgagtgacctcctttctgagggcttacatggtgttgatcttacggaagaaaaaaaaaaaagaaagggttttatgactttaaacctacctaaacatgaaaagataaatctaccttgcttttagaattttaattaaaacttcaacttgggaaataacggaaggcatatggagccagttcagttctgaggtgaggcaaagcctttcatcacaagttggcatgaagatcacagtgagtctggctttcagtccaaataaatggagagctagtgtacagaagtcagcaagttcagacaactttaaactattttttttctgtgataaatgggatagagatgaataacttgtcaggaataaaggaaaagaatactacctgggattctttgtttaatcaaatcctttagatatgaaataaagcaaatatcatattttcataaatggacctttgtgcaaaaaaggatatttacaaaattcctttcatagtaagcactattgatatgatgtatttatgtatgtcacaatatctttaatattcttatgagtataacagcattaaatgttatggttctatatatgtgtattttgatgtgacatatatatctatacaattcatatgtacagatatatttgcatatgacaaatcatatataatatacaaattgcattatatatgtgtcaatgtagaaataattatattttctttcatacatacacaacaacacttttgggacttgctatgtaactaagctggctttgaaattatggtcttgattcattggcttcccaaatactgatgttgctgtcatgaacccctacacttggcttatccaaaattatttcctgccattttatttgatttcaaaacacgacataggtagcagttcccttttttacttttgactgaagtgtgaattttatagaaatgcatgtggggatgaaactaatctcactgccactttaactaggactgaattttttgggcttggtaactctaggttaatggggtcttaagatacagttattgtccttggttgcatttctgtcatattaagcatagtatttttactgagagaaagtttaccatatactctgggaacaatgtcacctctaagagacacatccatctcataaccaaggagtaatcactattattgggtggagggagatcaggaatgctgctaaacacctcatggtgcaggatacaacaacagaagcacacatctcatcataagcctggaagtcatttatgtagagttgaaaaaggctcatctacagaatatgacatgtggaatctgctgaaatccaggaatgtgggtgaaatgttagaataaatcaaagaaagacacactgggaactggaaaatggccatgtaagacatgtgacaaagcatactgtagcttgcccctgtgagcagaagacagactatgaagatactctgagcctgagtaaacacggaaagcaataaatttagaaaactcactaagtgacaaggctctcactttagctaccatgaaagtgatctttgagtcaaagttgattagtatgacctatacgaaatccattccccaagtgagttttactttgcaggcacaaaacctacagagaagggacatgaaaccattttctttgtcaattaatgcattaaagataaccccagagaaacaaaatgatgaagtaatgaacagcaaacattttctcttagattaattggcaaggggaagctcaaatttgaattctccacttctacttcagtatctcccaccatcttactatagtttttgtttctgttatgtctagtttctgtgttatgtgtctgtgaggtctgaatgctcctgattctgtctctcagaaagagctttgctctgtatttatttgaaaaacaggaaggcatgatatgaaaaaagaagagaagtttcttgagaattattttacagagttttacaaagaaagaaactatactaaaaaaaacaaacaaacaaacaaacaaaaaaaaactgactcagaacagcaaacaacactgaaacagatgttgttcacctatatccattgtcttagtcagtgtcagtgtttgacaacatgacaacaaaaactttttttcccttatgttttgttttgtttttcaagacatgttttctctgtataaccttgtctcttctggaactcactctatagaacaggctagcctcaaactcaaagagatctgcctgtttctctgcttctcagttgctgggagtaaagatgtgtgctaccatcacacagttcacaaaaacttttgaaaggaaaacatttcactggagttcacttacagtttcagaagtttagatcactttttggcatgacaaggaagcatggtgtcaaacaagaaaaacagtgatggagtggtaagtgagaattcaatatccagatctgtggacaacagaaagataaagatactgggcctggcttaagcatttgaaaccccaaagcccacctcaattgttatatttcctccaataagggcatacatgccacagctcctatctcctgtcaagttgaactaattcctaatacataaatgttcaaacatataagcctatgggggccatttctattcagagcagcacacgcatgtcactttcaacattgatgatagatactgtttgatagataaatttgttttaaaggtgctttcaagctgttggctatttacagcaagtggttatcattgcacattcatgtgcgcataaatgattctgtgttagaggaatgaaaaaatacataatttatgattgtgaaggtatgcattagtttttgttgtaaaggctggctacataggaaatctgaggcaaattcgattgctcccattgttatcttaaagtaaatttgaatttaaatagcattgtaagttgattagtgtcttctaatgtagcatgatcaaatcaagatactattattttcattgttttggatattaagacttctatgttctaaaaatcttccatagcttctcctctagctatttttaaaatgaataaaatagaacgttgggaccatctcattctttgagttggcctggagttgagctcacataggcttcctataattcttggaaatcctcctgcttcagccttaaattacaaatataaatgtgtgctaccatgacccgtgaacagataggacaacctgtacttttgtagactcggtgagccaaactgtcttcactgttgtcagagaagctattgagaaggaaacctgatttctgggagtaggaaacacagtagtttcccaagaatttaattaacaaaatgaaatgagtgtcttatacatcttagatacatcaggcaggtcttttgatatgtccatgagacagcagggatgtaatttttaaagatccatgtgtaagttcattaaaaatgagaaaaatgaaagcctcgagtagataaggttgaaataaaactatttagaatggagaaagctttccgtctcttgaatgactaaaagataaacgaacactccaccttgagaaatagtattactcatctcttgtggagcactgggctttgagtctctctgctgttgggtttaagtaggttcggatttgtttaaaaaaatcattaaagatattattatctttttatgaacataattattacagggtcttttactaaatatcttacccaggtataccttcatttgtaatggtaatattttaatttaaaatctattaatagttgagcatatcatattgaaacttcttgcttccatattttaaaaaagattaaaattaaagcatgttactttttctgattgccccttatgtaagcagtgatttgaaactttaaactagaattggttttaaaaaaaatcagcaagcatatttcactatgattgagtgaaaaaattcctctttgtggaagaaatagtaggggcaaggggaaaatcttgctccatttcctagtcctgctaagaggagatgaggcagctttcaccaaatgtagaaaaatgaatctgtcacacagatggtgtcattgagacatgtaaatgaaacactcacgatactatgtctagcatcccttatttaataagatgatgaagaagtaaaataaaaacttgcataattgattgaaaacaaaatatttttatgtaaatatatttatgttgaaactatatagattaatataattattctctttttccctgaccactgataagagtgaatggttaaaaatctgtgatgtaaatattagtatgtaaacatgtactaataattttcaaagactaaaattggacttttaatagtgacaataattagcaaataaaagcagtcagattgtaggttagtaagaacagcaaaataggctgcatgtactcaacactggccctcaagcacaatgggaactgtagtattttatttaatattaaaacaaccccatgaaagagacttttgttctacagctgaggaaaaataatcttaacaatagtctgatttaattctttctgtcaaagatggtgatgcaataaatttggtgtttggcaaactggcaatttatagacagtgaaatagattgtaaggtggatggtaggcttatatattttgaaaatagaaacaaatattccagtcattgttaggtattttgctttttaccttcctcccccaagtttcttacatgttgttctcctagaagttgaaagtcatccaatctattaccaaagaagcaagtttagtattttgcagtctatctatacctagccattgagtatgtcactgctgcaaagttatgtggatttttataacaattaaacaacaaggacatatttatcaactggcagtggcaacacactggacttaggtaaaagtatccttcaaatgtctttggttctaatacagcatggcaacacatggaatgatatgttacttacagtgctcatagtaaggatgggtgaaattggcatggatgagaattaagttacagaactgtagaagaaaatacatgccttaagggaccttaggatttcccaaatttcccaagattgctgtagatctgataacttttatgctaatattgatatggttgattaatcaagattgttaccaaaaaagtttcacaaagaagaatctgataaagaatgagctgttcagttgctgggtaactctttagaaactagtcaacattgttgtgctggttttgaccttgtgttcattagccagtggttggaaatacagttattccagcaaaagtatttaaaaatataaaagtatagtggaatgtacctatctctagcactatttacatgctaatagtgaatacttttcaggcaaattctatatgtttctcatggtccactcagatatacagtgttagtcacaaaggtttttccctttcaagaatctaatacattcatcactgggattatatttagcacttaaatagtatcatagcttagcttttagaaacaaacttttacttatgagtctctggtacgtaactggatattaaacttctagccattcaacttttgttaatcacagctccagttcttttcacatgatatatgcaaatttaataattggttaatagataaaagttttctgtgtgtatctagaacataattaaattagcagttgttaagttctcatactttcccatggtgttaacaattaacacattctgccaattactgtagctatttatgtgcttggcacctcctcagctatattttcaaaatatttgttgcagatagcaacatctacttagaaaattcagagccctgtaccaaagaacagcatgtacttaacagatattaaatatttgtcaagagaagatttacatatttagaaaatgtacatatgaattgtatatagtaagcccaacccagaatgagaagctagaaactgaatgaatgagtctctaagtctctaatgagtccctatatggcaagcatgcttaaattattttctccttgcagaaatcagttttctcaggaataatagacagtgtttcaaactgaagaatagtttttttcttatttttatgttcaaggtgggctcttcatgtgtagcaaaacggattaatcattttcttaagtaataatggatatttaaagtgcatttccttaagatgctttaaaaagaaatgtttcattgctaaagttgtatgaaataaactgatgtagactacagtgttgaagttcatcttttaaaaatcaatttaatacataccacttaaaagttcatcttgctgactctgtattaccttgcaagaaatgaacaaagtgttctgttgtttcaaaaactacatccaaacaaatcggaattaatttcatagaaaatgctgaggcattgttagctaattgtaaaggcattgaacagtgtgaggggttataggcaaagacaaaagtgggtggacatttgccatgttttcagtgaggagtttcaaaaaaatatttttttcagaatgtaatgactcatcatacctctttccaatacatattatttattttaaagagagtcatactaaaaacagtctttaaaaactagtaagttttcaatgtttgattgggtattacagatttgagttactctcccaggcattatatcaagaggtcaggggaaatttagtggttcgattattctcctggaatggaggaattgctattgattgttgaaattttaaaatgttcttcttacttttaaattttaaggtatttgtcctgtaaatgttagttatgtccaactcaaattttctctgtcatacattcatgtattttgtttttatttttgtttctcttttaactaattttattttatgaccattgtttacaagttgactaagccctgaagttgttagtagaatgacttgcattttcatgtcatttttttttttaagattaatgcagcaatagcgtcctaagttttaaaacgatgtaaccataaagggttgaggacaacactcttcagacttgctctacaataaataaaatgaagatgatgatgaaacagaagaaaataataataaatgataaatgtcaatacttatgagagtaatgacataattgtatattagttctctacaactaacagaataagagatttaaagtcatttatttatcataaatttagtctcatatattcaatatttctttcagaactggattattagtaggggcaggtatcaggatcattttttccacaaatatagggcctgattattaatttttttagagaaaatttctctatcttccctgtcctggaatttactctgtagaccaagctgaccttgaactcagagatctacctgcttctgcttcctaagtgctgggattaaaggcctgcaccagtacagcccagctatcctgatttataccttatgaatttgtcatttccaccattctctcccaaaacagcaaaacaataaactaagcactgattggtgttttgtctccctaacagaagaaaatatcaatgataagaagaaggtggaatttttacattctagtattctacattaggtagtacagtaaagctgaaaggggcataaatgtatttaaagcttaagaaattttcatgaccaagcctacaagattgaatttgtcatttgtattatgtgaacagactctttgtttgttaacataatgaaattgtaataagagggaaaaaaaaaaagatttcacaaaagcccagccgaaggcagacagctgattaaaagatgaaaacatgtgcatctccctggagcctggacttcctttataagtagatttttagtgacttctcaagtcagggagttttctagaaggaaatggatgtttgtctggggttaggttaagggttagattcccagggctccagtgaacttgtagaagaaattactgaggcgaagcccagataagctcagagctactagaaagcgtgagatttactgtccttctgggccgactgctgagcagaacgcatgcacagtagactggccttcctttgccctgactttccctgtcagtcctggctaaccagaacatccatgattccaaattattaagatgagattaaagtatcaaaagccaaattgcggaactgtgaattaatagtctttccctccttttttaattattctttttgcttttatttcaatagagtggaggcaatctaggttgtgatttctacttgttcataataatagtatttgggagcatatggtagcctgtatcatccagcccagtgacctcatttggcagatctagaaactgaagacgaaagagaaaggactcgctgaaacttactcaggtagaaagtgctagaacacactggaaactctagtatgtcctatggccccattgggcttcctttacaaattgatgaaatgaagatgtgggtatgtttcaaagatgttggtgtgaaccatgtttgttataatattccactccagggaaattcaaattttagacatttatccactctacaatgataaaatatcttgaaacaacaacaaatctcatatttatgcccaagcagcagtactgagacattctgacggacactaaatttcttcatgttcagatttctgcttagctatttgtttaaaaatgttactttgtcttgtataaacatttgaaaatgcatcctacttttgagcatggctgacagcttactacatggcaccctgacactgtaaataccttcttatgacaccactctgcagtttaacatcactgcctctgtcattttattcataactgagaaagttcagtgaataaaaccacgagaacactcatgctgtacaggacagcaaacaccaatggtgttaaatgggaatttgattttccttctctttttcatttctttaacacatacaatttaggcaaactgacagaaattctccaatgttatgatagctcactttcaacaggagtgtgtgtgctttgtggctacccgctgaataagttggttatctagaatatcagaagattccagaggaacatttaaaatgaggggtttttacattttgatcccattacaattgaaaaatgcactgcttctcaggttataaagttcattaattgttgtaggaataattttgtatattcaaattattgaacatgcaggagtcttggatatctattacataaattatacactattaattttgcatcaataatatctgtaagattatcaaatagtaaaaaaaatttgaaaacgaatttgtcttcttgtactatatattaaaacatatgcatgtgtacataaaaagatatgaagggcagagaaggaagaagtaaaagaagaaacaacttaatatttctaataaaatcattactggaagcagaaagactgccagaaagcaaagaaaatatggtactagaataatcaatctccatgattcttaaaatgggagtcacttggggatattgctaacatgcaaattctgtttgaagatatctctgtctctatgcattctgagattcttcatgtctttataactcctgggcaatgtaatgctgtaggacttcatcactttgagcagcaaggtagcacggtttcaggctaatgggtgtaaccaagggtaagtctgtatcttgacaagaaagagtcatatatttgtcagagtttatatatcaagggaatgccatccagccctgctaacacagagattgccatgccattaagaaccttctactgtttctgcttttattagagagtgttgtgaaagcactcagcttctaacgcttgcctggattttcaggatgatagatagagggaaagtaggattttatgtgcaatggaattagaaataaacaagatctagtgagtctatgcattggtaaggcagttgaattgctttttggttctttacaaggtcttatctaataggagatcattagataaggcaatgaagaaagcagaatgcaaccttaagaattgtggacttatgattggtgacctgaatgctcttttccttgacacactgaacatttatgttgggttagatcactcatttttctaaaataaatatgaacaggaaggagccatttggaatttctactgcattttatattttaaatccaatttatcaaacatgttctggttactaggttacaaagtagtatacttggcattgggtaaaatatattgacccagatggcaaattcctggcattctagtttgcatactaaagattcacacaggaaaatgtacccaaatgtaagatggtctggactttaaacttactagattacaaagttacgtataaactaaagaaaaatgggtaattctgtcaagaaattagtgaaatattttgcagaaagaatttgaacatggatgtttaatttttttttattatgtattttcttcaattacgtttccactgctatcccaaaagtcccccctacactcccctacccacccattcccattttttggccctggcattcccctgtactggggcatataacgtttgcctgaccaatgggcctctctttccagtgatggccgactaggtcatcttttgatacatatgcagctagagtcaagagctcttggggtactggttagttcataatgttgttgcacctacagggttgcagatctctttagctccttggatactttctctagctcctccattgggggccctgtgatccatccaatagttgactgtgagcatccacttctgtgtttgctaggccccggcctagtctcacaagggacagctatatcaccgtccttgcaacaaaggcttgctagtgtatgcaatggtgtcatcgcttggatgtttaatttttattttgtgttctttacaaattgctttcaatatgctttaattttattaacctgtcatctactctacccaaatccattccctccctccttacccactaactttatggggaacccctcccccccatccatcaagtacagtttgtgctgcccatatatccttgaatgtgtttcaaccaaccaagtatggtcaaccaaccaaaggccataccattaaaagaaatagactctcccaattccagactctagtacctgttaatatatcctctttttcatgcccgtgtatcttccccaagattaagttttgtcctagcctgtgcaggtcttatatatactgtcttaactgctctggattcttatgtgcaactaccttgctgtgtgcaaaaggcagattttttttctagtgatccattggttatagcacaatttttcaggcccctcttcatcaatgatgattaaatcttgtagaaaggaatgtgatacagacaccccatctatggatgagaattccatagtctgtcattctttacacattaatcagttgtgggtctctgtccataaggacttttaacttaagaacctaatgagaattaccatgaagagagagaaattactagtttacctagttctttatagagacaaagatgctattctttggaattcagcaaaatccggggttgaattgaattgttggaaaaatggtaccacatcagagtgataattcagcagctgaatctctcaaaagtggctttttcataatgacctgttcccttagtggccaggcggaagagacattttacataagcattttccttgaacacaggagcacaggacttctgagggagatatgaaccaaagatgagaagacatgcatcattccagatcattttcaacacacatgtccacagcacttcaattgctctttgttgtttaaagagaaaattcatcgtttgttatggttttgttggaataatgggtataagaaaaacatctgattttttttccccttcttggatttgtaggtggataaccatacataagaacctttgagggccttaccatcttttttatgtctgatgccatggccggaatggaataaggttggaatcctatctagtttatttatcatccatacagactcaagattgagtgtagacacaaataaaaataatcaagagcactaaccattaaaaacagaacaatgagtttgtaatcacagtctgaaaagaaagaaatttaaaattcaggaggaattaaaactataaagatactggaaactgattataatggggcccaatgtaaattgtttattcctactagatgttgcttgtaatgggtaagctttgcctaaaacaccagaaagatctggaagtgccacttcacatcatatatcattcacttttgtaaaaaattcatctagagcacagagcaataataataataaaaaagtgctgcttccaaacttttgattttattgagttccactaagtttgacacaatgtaccctgtttagtaattttttcaatccattttaattaaaatccataaagataattagtgttcctgattctattttttcttcctttttttttttttttgagtcatctgacctgttgcagtctaagctcaccttgttcccctgttcttgttgttgccattgctgactcttctgtacctgcttccaccacactctgacttcagctctgtgagctacggattgttctgatttttgtcaaataatgctattgatctccaatggcagccaataaccaacctctgaagacattgatggtagtagtagagatcagttagtattgttgtctttgttttgttagagtgaaacacagagaatgtattagccatcagaaacaaatatggaaaggctatacaggataggtatagaggtaataagaaggatattaggaagtgataccaacatttgttgagagctaacttacatcatatactaaatctgatactagaatctgtaaacatgtaaggaacatgaaatggggcccatgaaaccatgtcaccagacatgaccttgtgtaaggtttacagtgacccttcatcatcagtggcacagtaagagaatttgtaatgaaagatcctgtcatacagtcacatgtagcagagatgatttaagaatctccatcttttcagccgggcgtggcagtgcacacctttaatcccagcactcgggaggcagaggcaggcagatttttgagtttgaggtcagcctggtctacagagtgagttccaggacagccaagaaaccctgtctcaaaaaaccaaaaaacaaaaaacaaaaaacaaaaaacaaaaaacaaaacaaaaacaaaacaaacaaaaacaaacaacaaaaaacgaaaacaaaaagaatctgcatcttcatctgcttgccctgctacaagttgagaagagtattccttctttttacagacagcttgaacggagttaatattgccaatatacataaaaagcttaagaaggatgggtactgaataaaggttacagatactatatatccagatacactgcttaccctcttcactgtctttctaagtagtatatagatgtcaatttacatatgatctgtccatctcttagtcagtgacacagaaatatactgggcattcccttccaaattggtaaatggtctatgtataatctgtacatgattaatatgcagacatgttttttaaatattttccttttgaaatctgtatctatggttaccagtaaatgatatttcaagttttggacaattgtcctctgaatagcataatatgaaacatttactaactacatgaaattgtctcaaaaactattttaggactgttaaaactctgctgccatgacaaatcaatcctgagacaaatcaaacaacaaaagttagtcttcatacaaagccttactctctaacgcacaaccccctggagcgagcagtcagaggccaggctacacctatgtcaatgccttctgctcatgcagttcctagatccttgctattctatcaacaaagagaacatcaagggctttttccaatcaagcttatgcttggctcactaatgttcaccttccgtttctcagagcatctttaacagagagtgtaaaagggagcctggagagggagggtgctggccagtgtcttttctgggccatgaaataattaacagataccagtggatgttgctgaagaatcacatgttctttggagaatagagattaggtttttaaaaagttctctccttctatgggagggattcagtcatatgaggaaaacagtaattacaggggagtattcagggccatattacaatttggcaaggcctgaagctccttcctccagcagctgctgttctctgtacagagttcctttttcatctcaaataattaacttgagatttagaaacgcctgtgctctcttatactcatgttggctgctttgtctttttaaatagaggtcaaaatgttttaaaatcaaacctaggtcttagagtgtgtctctgttttccttaagacagtggctttgtggcagaggttttgtcatagaatgaagagaatttgcctgcccactgtgctcatgaggcatgaagggcagaatgaagctgtgcaccctggtagcttgttctctgctaggcacttgctctttataatgtctcagcactccgacttgcatgggaaaatattgagacagtttcttggcaatagacatagaaaacaccatagtgtaggccattggggagatctatattttgaagacaaataagaattaaaaataataaaaccatgcatattatatgtataaaaataataaagccatgcatatgttgtcttcagagaatatacagatctacagagtagggttgaagttaataagctggctaaatgatgtagatgtgttcctgtcttgtttgcaacatatgtcttagacagtaattttaacagaaacataactgaaaaaatgatacataattgaggagagtcatggaaaattctaaggaatggataaacaatatgtagtatcacttttaaaaggtttttataaaaatgtaattatcagtgttttatttataatgataatatattgcatccgtggacacaaatcaaatgtctctcctcaacagcttatgttaatttccattttccactcagtctaaggctgtttgcaattaaatttgccaagtattttagcatgtgatatgactcagtgaatagctttagtgaatctggagggaaagtgtgatatcttttgggaaattatagtgtgtacaaggaaagagaaattatacaaataccaataatgatacaattgtgaactctgttaataaggtagttgtttcataggcgttaccataagtgatgctacaggtacattgtgttatatataatataattgtcacataagaatttgctaacatagtgtctccatggtcttagaaatctgtgaaaaaaaatttccagagtcatacaaccatcaggttttttctgacccactgaaatttaaccaacttaggacctgctgtttctatggcttcgaaatcagcaaaaatatccaagatccaagtatcacaaatgaaaacttcagccaggactacatattttaaattgaagaaagaaaatcatgtttacataaactgctactgctagaataaaatacagaaattgaaagtgatcgctgagtgttgaggtttatgcagacatgactacgacatgaatctactactaaaagcaatatttgaaaacttagacaaaagtatgtcttgctactacacacaggccatttagggcattcatggttaagagagactttaatgttatcctttgaataaggatgaagtaaggtttctaagcagcttatgctgtataagccatcagcagaaaggattcacttcttccaaattctccataggtctgggtttctgctcctagaaaagaatgttctgttagcatataggtgaaatcctgtacaaatataaaagataattttggaatccatggattaggggctcagtattctgactctaacacttgactttgtgtgctgagctctgccttcattttaatgactttaaaaggcaaataataacagctaccctacagcctttttgccttaatattagatgaaagtatgcattcaaagtgattagcgtaacctcagcactcctagatgaaagtaattttatctaaaaattataaagtatggttaaacaatgttagcataagatccagggactttaaagaatattgattagtttgaagttaaaaaaaaaataaataaaaaggaagaagctgtcttcataacaaacaaagacaacttgatttttctttccttttctttgcctttcccttttttcctttcctttcctttcctttcctttcctttcctttcctttcctttcctttcctttcctttcctttcctttcctttcctttcctttcctttttcctttcctttcctttcctttcctttttcctttcctttttcctttcttttttcctttcctttttttcctttttcctttcctttttttcctttcctttcctttcctttcctttttcctttcctcttcctcttcctcttcctcttcctcttcctcttcttcttcttcttcttcttcttcttcttcttcttcttcttcttcttcttcttcttcttcttcttcttcttcttcttctctgaattccaagtttttttttctcaattcttttacttattaacattccagagaccaatgaccccctcccctcctggtacttgtccagatttcctcaaccatttcctccttccccttgcctccaagaagttcctctcccctaacctcaccaggcttcccctttcccaggacctcaagtattttgaggattatgctcatctttttccactgaggccagaccaggcagtcctctgctctgtatgtgacagggaactcagaccagccagtgtatcctgcttgattggtggctcagtctctgggagctctcaggggtcggtgttagttgagactgttggtcttcctatgggtaacactccccttcagcttcctcaatccttctcctcaaacattgggttcctcaacttcaatccaatgatttaaatatctgcatctgtctcagtgagctgctgggaaggccactctgaggacagccatgctaggctcccatctgcaagcacatcatagaaccggtaatagtgtcaaacattgaagcattagatgtaaaggatctggttccagaaggggaggcattccttcaaaggattcttgggaggtggtctttgctagggactgatagaaaatatccagattaacagtgcaaagtgactgaggagtttggggctcaatgattcaatgacttcaaccttgtgtaaaatatctaagatcttgtttaaatgtaaatggaaaggcatgcagtctttaaattcctgaatgatataccagattcccagataacaactttcttagaattgaggtgaagagatactaatttactataataattgagcagaaaaggtagaaagaaagcagttgaaagaacacttctgatggaagtaaccagtagctgaaagttagatctaaagccttccttgagaaaggaagcctgatagatagttcatgaacatagcaacatggatacaactacattggcttaaatggttttcctcctttttgttcctgtttacattattgttgattgtaatagatgagtagcaagaatagaattaaaatgactgggaatacaaatatagagcgtcattcaaacaaatacatttgatttaaattgtatacaaaaactattatttcatttgatcagtaaaatttctaaacaggtaatttttgtttccactgtatctagaaaaaaacacattccaagtggatagccctgaatttgtaaacagtatgaaatttctatattcataaaacttggtgtatatttatgagtttagcttatctttcttagggaggaagttggaattgagtataaacaatcatccattttgttctttttggattatcatcaaagacataattacattgactcatttggaccatttaagctctattgttttggctaaaaatgaaaattttaaggatagggagttggttcagctgataagaaaacttactgtttgttgaatgtagttttcagaattcatgtggggcatctaacagctgcctgtaacttcagctccaggaaatcttatgccctctcgtcttgcctgcattggcacctgcatttatctgtatttacccacacatggacaaatgcacataatttaaagtactctaaactgtaaaacacagaacaaaaatttacttaataagatatctacatctttgccagtagagtgtgtgctattcagaatattgtataaataccagacatggatgtatatacaattgtagacagactctaaggctttaaatgtcatatttaggaaataaaacatttcttttaaaatactgtatctgatttatgaatctatattaaggtgtgtgtataccaaaactattttttaaaataaatataaattgatatttcatatagtgttaatttaattattaattttgatagttcaaggtaattgatttaatatttggcatgtttatcatctaataaattttaaatatccacataccacttcagtatagtattcattattgcatagtgcacatataatttatttaaaataattgatagcattctagaagatttttgacaaatatatgcatatttatatatataggatatattaatttttgactattatagcaatcatagcttctgatgacttcaaaatgttatacagcttctgaacccctttttttaagttgcatggtttagcactttattttgataattgctgtcctcaaaaattgctgactgtcagaagttgaactggagacctgcaaatgtgacttgcataagttgagagcctctcccattcttcacactctgccctccaccactgaccctaccagatcttttatttgtcaaaatacatatttgctgcatgtattttctttgccagataaaccggacagcctgcttcccagagcttacagtttggttaggcaagaacacaaaggtgaataatcaccatgaaaaatcatgagcatgaatagtgtagatcagagtcagcagacacctgagcctttgagatgacgtgtttatcattaatgacacatttacctgttgttatataaaacagagaacagtagaaaaggcagagattaaaatcacagtagcatgtatttttgttcatctatatttcctccacctccttctcctcatctactacctacatgctggagaagacattcaagtgattatgaataattgctattgagtccccttccccagaatcctatttctatctgacattttggcaatctatatgtagatgttccatagatatctcagatgcatttggttgaaaataaatgcattgcatgccttcttataaaaccattttcttcttctatgtacttaatattggtcaagtgtaaatcacttcagctaaagtctggggtcctcagccactgtttggggcctgcttgaactccaagtgtaattgatcttcaaatcttcctcaattccttctaactttgcctttccctctcctgggtgagttatgtccattctctcttatgtaccacactagtagagtaaaaaatcagatttcaagttgctaggcagcaacagttgagaaggccataaaaattaagtcagtatcttgtttatgaaacattttccctgtatttccccttttccagagaataaggcatgcttctctttaacatagactagtcatttagactgtcattgattggtaaacatcaaaagcatctcacacagcactccacagtgactcacttgctaaatttcacattcttgcctttcactggaattttatctttctgaagggaattataggtatgaatatgatttttttcaatattctgactgctcagagtgaagatgggagatgatgttgtgtcccatgttagagaaaaagcacacaattcaggaaaatggtcattaactatcagtcatgacgtacacattaaccttcattatctttctgtgctctgaaaatatccttctgctctataccctttagtgagtcattgttaactcatagtgtatacctatttgagcatagtatatccagaggaataatgaatatattgcctcctgtagaacatagtgtttgtgtgtgagtgtatgtgtgtgtatgtgaatgtgtgtgtatatgaatatgtgtgtgtgtgtgtgtgtgtgtgtaagcatgcatgtgtgcacatatgtatgtgtaaaatcatcctgtgggcttgagaggaatacaactttaagcatcctatagtatctaggcaaggaaaaaataaaaaccagtaaataaatacttccatactctctttcatgccctgacctgcagtacttaaacaacagggttctggagggaagggagcaaccatgacaaaattgggatcaggagacaagaaggaacgagacaagacaaaaattctgtccaagtctcagtttactctagggaaatgaagggtttataaagctgaaaaccacaaacggtatttgctcaagtgcacaggccacaccaatattatcgcttggtaacacattgacatcaaaggaatgtccccattgtaaaatgtctggagaacctctatcgtaaagtgtcctgactgagttgtgggaacagaagcaagatagtagaagaaaaaaagagtgttaattgataaatgatagcccaggaacaagatggagactgagatgccaggggcttttgggccccaacattttcacactggctgcagcagtaacagtgcataagaaatactcaagccccacatttgctccaggattttctgtatgttttcttgaaaatggctaatctggctaaagggagataaaatttcaaggtacttctaatttccatttccgtgataaagctgagcatcttttctttcttttctgattttcattattgatggaagaagttgcttaggtggcagagtaattgactaccatgcagtaaaccctgtgttcaagatgtagctctgtgaaagtggagccagaaatatcagaaattcaagaacaccctgagctacatagggagtttgagaccagcctaggaaacaaaaaccaaaaattaaatatgtattgcatatttgtaagtcatctttcaaaacttctgttcaatttatttattcatggttgattttgttgtttggtatctagattttgaagggttttgttgttgttcttttgttttttgcttgtttgtttggtttttggtttttggttggtgttttgttttgtttttcaagacagggtttctgtgtgtagccatggctgtcctggaacttactctgtagaccaggctggcctcgaactcagaaatctgcctgcctctgcctcccgagtgctgggattaatggcatgtgccaccgctgcccggctggattgaagtattaattctctgtcagctatataattgtttcatactgggaaaactgcctctcattgtgcatgcagcctgcccattgttggtgattgcagaggggaagcgttgcaatttcaccccatcctatttttcactcctcacaagcattgtctgagctattgaagtccatttccaaaacgtgcgtgcgtatacctataccttgaagtgcttgcctctgttttaatgggataatttcagagcttcagctatcatattgacatcattgacgtatttttaatgtgtgtgtgtatgtctgtggtaaagaccttgtttacctcttctacatgtgagtctcttaagtactttcaagataactttatatcctagaaggatgttgtttgaatccattttcgtgtcaatacagattaaaaagaaagtttgagtgcttttgaaataatgaggtataaaaaggtgtggggcaacagcccaaggaaggaatcgtgaggagaggtggctttgataagacaattattccttgagtaggtatgaaaaggggaaaggtaaatttgctttgaaatttcttgtgttaaatgattatggctttctgagtttccaaatgactttgttcttcctttgctctttttcttttttaataaatttaataaatttaataaatctaatatgatgtattctttggccacattttcagcctgtgaatccagaggtggcaaggtagtctagtcctcttaggaaagaggagtaccgttgaaatgtgcatatttattggtgaccagctataagattagatttactgagcaaatagattttgtgcagccatccaaaacagagtggttgccagagtgctagaactggcaatagtatttctttgatcctttaccaatcagttatcacattttcaaaattataaagggcagaactatgcccaaggaaagacttgtgatgcacaaacataaacctgtcactgagctctgtgcctgaaaggatgattggtgacgatcatcatacaagcaaagcaccattgttagcactgtcttataattcatggtgaggcacttaggaaaatatgactggtcgtcattatactgcatccattctattttctgtaaggcagatgaatgtggggtcgtttgtttagcataatagttttcagcatggaagtagagagcaagtttattacctgaatttccccttcccctgagagggatttgtttcactttgaagtaggattcttataaagaacccacaagccacagtgcacagggtagtttccttgaaattaaatctaaactatagtctattttacttttccaatttgcctggaatccaagaaacatgggcacagattgttactgggcgcttcggttcgtaaacctgataccttgttttttcggtgtttcaaaggaattaggaaacagaaactggtaaactgaaaatggatttatttatagtctggtagatcatggtgtagaaagaagctgacttccttctcattttccttgtgtattctatgtatgcacacttgacagtttatagagatcatggagacataggttagactataagcagatttagccttctgtctttgggagaagagaacctgattccaagctgtctctcttctctttgcttgcatgattctagtctgaggaaaatagattttttaaaaagacccttcatttcttaaaaaaaaaaaaaaaaaaagaatgggcttatggaatgtaagattatcctctcaacacttacttgctctgcacttggcagaggtctttgtccttatgtccatttccctgattggcacatagtggagacttgtgcaagcctcttaaacattatttttaagtgtatattaaaaggactttcctggctgctgaaggaggaacacaggtgtctctttatatttcccctctttccagagacttagtatagactcatagatgcaatacaaggatcaaacttcagtagatttagccctgctgaaagactacaatactttagatgtggaagttggttaatgtcctacaaagactttctgctaggttataaaagaggctagtaaggactccatttagaagagatgatttaaggacatgaggaataaatgtttggagtagaaagtgggttctgtaagctctgatctcaagttttctgattatcacttctgattaacttatcactcctctgagattgcttttcttctgtaagacagccacccacacataggaatcagcagactactatttagattgtgtggggtaacacatagtgtgtcctaagggaggcaacactatttgcaacagatctaaaggaaagactgtccttacacccccccacacacacacacacacataggtcaatagacacttttattttgggtgtattttcttttcttttttccaaatttttattaggtatttacttcatttacatttcaaaggctatccgaaagtcccctatactctccccccactctcctccccgggacccactcctacttcctggccctggtgtttcccctgtactggggcatataaagtttgcaagaccaaggggcctctcttcccagagattctattttcaacccatattctacttcatgtttcttattttaaggcaaggttgattaagaatttgtggcatcccatggtgcttcctccctgctcagggtcttctcttttttttctcgctttaattcctattgtttctgaatttacattaccacaagggctagttggctcaggaaagcggggagggtgcctgtatttaaataggaacccttcatcaaaggaagactctacagtttcctcctccctttcctagcactccttcagaaaacgggcaaacacccactgtggcttttaggccttttaaatgaggtgggggaacgaatacatttgggaggggtcagtaataaaggatttatttctaattttacaaagatgctgcctttgacagaaggaagagagatgcaggtagagtgaaagctgtcaccaccttaaccttcaacagagcatcagctatattatgtaggagagagataattataggacaaactgtactgattcctcatcagccatgggggagatggaggaggacaagacaaggataacctgcttctatcatttgttcaaaaatctctctctccctcttcctctccctctccttctcttccctctccccctctctcagaacatctggagcaagaagagttataggcatttgtgactcacccacatgaaatgggtgctaggaacaaaactacaaactctgcaactctgcctgtattcataagttctaggccatcatgcccagtccccattttatcaattgttatactaattttatttgccaaagatcccaggacaatctttaaaaccagagctgtcccttgatacttctgtccaatttacaggctgagtacccaaagctctattctggtgccttatgttctaaattatctcatgtaaatatgacaggaaataaaagccatggagagcctcacttttctagcagactgatgagatgtaatgaatgctagaagactgtaaaaccagaggaccaccataacactagttttaaataaattccttctcagctaacagacattcggagtggttgtttaaaagtaaagttcacagcatgtgcatatccatatgtacatatgaaatgaatctgtttttaatccttggaggaaaatgaaactatcccttcagtaccactaccctttaaaaatggagactttgaaggaagtctctaagaacatagaacttatgggatatttaagataaactatagcttgaattcatcagactccttgctttatttcccaccagaaaagggcctcaaaatagaatttctatatgaaacctatgtgaaccaacctagaactgaggggaagttggttggtgactgacctcaaagcactttaataattagcagtattttctcttgcatgaaaggtcacatataactttcattacatcagataaacagaaaatgtggcattgggatcaactttattctaaggaatgattactcataagaatccatagcatttgctgaggtaaccaacaccttccaggactgtgtggaactggatggctatcatggtggtctggagttactgagaactgtccctagagcttctgatatacagcaggccacagaaagattccaggatgaaactttcagccttaaatttttatagcctgaaactgttgctgataggctaggctgcgtggttgaattatatgggcattccatcaacactttgactcagataactggagcttgaggatcctaggtccttcactttgcctaccacatcctttctagaaaatcactaatcttgtagacttttagtactcatttaaaaacctaaataatttctagaacatgtggtttggagggttatcatttgtgatagtcttggcaaaacatcattgtattattgactcaaactatacactatagtaaattattagattgatagatgtagtttgtacatgacaaaggttttatcacaaacaaagcacacacacacatacacacacacatacacatcctcatgtatattcagtaaaaataatggatttaagcagttggttagagtagctcaaactatctgaataattcatgtttttattaaacaagcaacatataaagatttctttgaacaatgtttttttgtttttgtttttgtttttgggttttgttgttttgttttgttttttgttttttgttttgtttttcgagacaggatttctctgtatagccctggctgtcctggaactcactctgtagaccaggctggcctcgaactcagaaatccgcctgcctctgcctcccgagtgctgggattaaaggcatgccccaccatgtccagctcaattaatgttttttatcatagctattatgagtcagtaataatggtctatatagtaaattctcagactcattgttatgtttgtattatttgaagaagatgtacttgatttctactgtctcaattagtgtgtagtaaccacaaagaatagatttttaaaaatgacatttaaggatatttcaattttgtggtgttacacgataagggtggtagataaataggcatgatacaccttattttattgtttatacattggattcacattaccttgttcatttgcttaatataagctctatgcagaactgtgtgcttaaaacagagatccagcatggctttaagggtgctctctatatgaagcagcttcaaggggttagcatcacagaatctggagaggtaattgcgtcacagagcagaatgcacaattctaggtgtggaaggtatatgtcagatacaaataactgagcttgggagaagtagtttcttggaatggttcacaaaaggcaaaatgctgaaactcagagctacaggaatggattactcaccaatggaaaggtggagaatgcatgtaagtttctttcgagtttttgtcccaggccattttcacctaccactccagtgcaagaccttaaagcatttgcttcctggaagctccttaaactattggtaagtgagccacacaaagaacaaagctgactgtacacgttataggaagagataagacagtaaggatcacatgtcagcaaaggaagaaggtgtccatatggaaaaaaacaaaaagagaaaaaaaaacaaaaactgctctgtaattgctatgtatagtgcactccatgcagacaaaactccatatgcttcctagttctaacacagcaacggaaatatgaggtcatatttattgttttaattttataaagcaatcaattactgaaagtttttagagacgagtaaatgcttttgtcatacacatacaatgagaagatttgggagtaagaatctgattgacttcaatcaaagcagcacagtttggagggcatcttgcatgctccgtactaaccagcatctcacataggaactcaatattatggaaagttacaagctgaaaaaaacaaggtaaatgatgaaagaactgaatttgtggacatattaaaatggattaaaatatattaaataatgtccaagttgttccagaagaaagtgtggacagagggggaaagttatgcatgtgaatacacagatatgcacagtaagactctcaatataaataaagtttatttacatatacactcactcacaacataagaggttctgcatgaatattttacagtcagggctcctctccagctctatatagtaatagacaatatggatttgtatgaaaacatttaaaatatatgtagtgcttatatacaagtatatagaacacatgtgttatttagatatgtgtatatgtgttggatagcatttgaaatgttaatgaagaaaatatctaataaaacagcataccaaaaaaaaagtttttaacatatgtggaaactatttgctgttttacatctggcattgaaaaaaattcatgtttttcaaaagtaataccctggggaatattggatgctcaattacttgaagaatataaagcaaaattagataaaataccgctccaatctcaaaatggtcacattgtaaaaaattacatgcacagacacatatcattaaaagtacttttaatttttccaaatacatatcccaatatattcaaacaatagtttccatggaagtaacaatatttgaagtaaaaattcttataaaattaatttgctggtagaagctaaactgctatataatataatatagaaactaaagactccttacagtagcataaaaagcatgtagttatttaaaaataattagttcagtaaaggtgtgcttgaatggaaggtgatgggaaggagagagagaattaatttcccaaaaggcaaatgcagataaaactgtggttggtgtattttgtcctgcaggtacaccttgtctgttctcttgggttttatttcgaattagcatgtgctctaatgattgtacacctccacaaatgacaaaggcacctttctgtcactactcactgtgcaagtgttctgagctctgccttggcttgccccttccatgatttgataaatcaagtgcaaaaacgttacacagaatctttaagagatgtttcaaattacaatgtgtcctacccagcacttcagagttcttcattaagtaatggaaacggtgatcacgagatatttgggggggggtgcagggagagcatccatcctgattcatttgatgtttctgttattacaggatcatacaaaattttaaaatgataactttatgtgcaaatgcaaatagaaaccttccctggtggctatcatctatatgtatctacaaaggcctgggttcagaaaacatcttcaactgtgaaaactttgttataaatacatgtttctgacaggtgtcagagttggtagccttttctgacaaaccttaacacatcccttttcttttttttctttgcttttttattaaatattttctttatatacatttcaaatttcttactcaagctaggaggacaaattattataggaaaatacaatcttaaacgtttttcaggcaggactgtggtggtgcatgcctttaatcccagcacttgggaggtagagtcagttggatttctgagttcagggccagcctggtctacagagtaagttccaaggcatcagggctacacagagaaacactgagaaaaacaaaacaaaacaaagcaaaacatttttctggattcaagatattttgccaattacatgcaatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcctcctcttcctcctcttcctcctcctcctctcctccccttcctcccttcctacttctccctctctctctctctctctctctctctctctctctctctctctctgtttgtatttgagggaataatgaagtttctgtgttatcacattttcttattcaagggcatttatcttctgtgggcctaagattgctgtgagtgctgagaataaagcaagaaacaaagaccaaaaaaaacagaggtttccatgtgatagacatggacaggttacaacaatagtatcttgatcagagggaaaaaaatgaacacaaaccaacaaacaaaaagggcaaacacaaaaaagaacatgcaagctaagggcagtagtgtcccatagaaattaccatggtgacagaaattcttatacacacaggttgtaggtagctatagtatactagatttaagctaagtatgaataataattgaatcttaaactttaccaagttttaattaatttagagagccacaagaggcacatacttacgctgctggagagttacaaaagtgaaggtatatcctggggaagagcagcatgcatctcaaatatttatgttcatgaggctgagtgaggaggatcagaagttcaggatctgccttggctatataatgagttcctgcccatatgatctctttcaaaaatgagcatttatattcatgcagggataaccaagctagtacaaccatgtatggttatagttataagcagagttagcaaagacattggctctgaaattaaatggaatggaggacagtatggatgcatctgtatgtggataagaggcaggaggtcaagtccctgtggggaattggagacattaccctaaagtctaaaatattgtacattcattctaaatcttacattttataacaattcgtttggcttttagtttcttcaagtctttgtaggcacatactttagctggagtatattataggacaaaattttaccaagtttatatataacttcacctgtacttcagtcctttaaggtgcccctatattttctttgcttaccctattggtaaggtatgctacccattctactgtaggtccatccttactccagcaaagttgttctttttctgtctgtctgtctgtctctttgtctgtctgtctctctctctctcactttgtagaccaggctggcctcgaactcagaaatccacctgcctctgcttcccaagtgctgggattaaaggcgtgtgccaccatgcccggctctttttctgtcttgagagtgagatcatctcaaaaatcaaaaaaaaaaaaaaaaaaaaaaggaaacatgttatgggaaaaaataatccaattttcataggctgacaattctttcagattaatgagaattttaggtcacatagctgaagaaactagcaagcaaaattttttcaattaaaaacactaggtgggtaagactgtataggatgttaatgaagcttcaagcattcagaattatcttgacttacatctcactaaagaaatactgtcatacttgaaaacttcttgacatacatagatatttcactttcacataacagactatgagactattattgtagattttggctttatcagtgatttcatttctaaaagaagtcagataactctataagaataattattatgctctctttccaaagtttacttttaattaagaaaatgtttaagcaggactatggcttcctttaattaaattcctttttaaaaattgtcacctcttaatctgctttctctcttctctatttctttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcactcactatatgctgtcaaatattgactagcatgctgatgatgccattcatttttattttctcttttggtttagtaactgtgaaattacacatcatatgccttcttttccttctcaaggtccctatctgcaatgcccagcccagtaaaggtaactgaaaccctgtctacctttattcttcccaataattggttgtaacccttttttatttaaccaatagctttaaatttgggagcatgatttccacaacaaaggccagtttacaggagaattcattctaagatctggggacaaccagatcttagagatcagaatttaagatttggatggtaaacagcacctgaccaacccccaacacttaatagttatgtattgatagataaaagggctcctggatggtgctctgtgatacaacaccctcatagcataatgaggtctgggttctgtctctattacttaagaattgaacgaagtgattaattaagtaaatacataaataaatatgaaataaatacaagaaaaaacgggatggggactgtgtctgttttaaacacatccataaagggcaaccctcgatgagatataccaacagtctgtacttgaacggtaatctttttacatggaaaatttctcttctcatttactccatgtgtttttcacaggaacaaaaaagaaaggaatgatctcattaccagttttggacaaagaaagccatgtttctcaaatcagatcttttctgtcttggttttcttgaatactctgcaaatttctttcccagctctttggcctcaaggcctgccaaagagcccttgtttcccagagctccctttaggctttttgccttcctagcagtccccaattctgctctttgtctgcctctccagccagtcctcacactggtcctttcccagcctgtctttgtgttcttactccatgggaactcttccatgggctcctcatgtttatgcagtctagaccagaggagagccttttatttatttcttggacccagcaggggtttcctgcttggttttctgtgtcagaatctgagttaattggactaatcaatctaacgaatttttcttaagttattctactatcttagctccaagagctagtcattgaagctaattggtggcacccccacgggttaaatttcacttcaccaggcatgctttgtgaggtcatttcacacactggaaataatgccttccttccatctgtcccttaaaaggtttctggcaaatgtatttttaaaattgctaagatagtgggtgtggaaaagcttggtttaggaagatggacacacaagcgagtttagagcagatagtgtaaagtttaccagaaactgaacagaggtcccactgtgtgcactgaatcgaacgctcattatctctacccgaagttctcccttttcatctagaaagcacaggcaatacctgtgctgtggaaatagagtaaagaattttaattaaaaatcgattgtgaatgagattgtttaattattctcaaaattgcgctgctggtagtagtacacacaaaatgagtagcagagggatcatcgcaagcactaagcggagtcatttgaaagggaaataaattaagcatttggcactgagtgatacattgatcttatgggttaatgttaattatgaaggtgttacccagggccatgaggctattctgcaccagagtgtgtacaggaaatctctgtggagtgcccacaacaattcacatatgaaatatgaatcctccagcttaccaattactctcaattcatttttttcctggtatagttgaatcactgactagatacaatacagcaaaaagagtaaagaaaatggcactaaaagcattcaaactgaagaacttaaataacagaaaattgtagtctcaaaatactgcaaaagagcagtctctcttaggtcaggatgtgtcaatggggctcagtcagggaaggcatccttctgccttacacagaactgtcttctcacagagcacttatcaagagagcaaggtctgttcttgcaaggctcatctatacagtgtgacttatcttacctcactgactttcataaaggctttctctcagacagttgtactaggctttatgcctttgacatgcattttatatgaacacaatttagcccacagcaggagataagataggtctatgttttaatatattctcattattcttgtttactagctatgaaattaatctttgcctactattttctgattttgtttggttaaataagtcactaaaagcgatatgaactcttttcccctagttttcagttttttattctcttggctactctgcagacaataataaggactacaaagcatgtaacataagacaaagaacttggaaggcaattgatgcaaaatcaacatcacaatcactcagaagtaaggaaatactacttatctgcattctctttagctggtgtcttttaaactgctggtgtcatgagataagaaatatttctattcacagctttctatattaacaagatttctgattatttaccagaccatcatgatttaatgaagataggtaaaaaattaagaatcattgtgcctctattgcatacaccaacaagattttgctgacaggaccctgatataactgtctcctgtgagactatgccagtgcctggcaaatacagaagtggatgctcacagtcatctattagatggagtatggggtagccagtactagagaaagtacccaaggagctgaaggggtctgcaaccctatgggaggaacaacaatatgaactaaccagcaaccccagagctcttgtctctagctgcatatgtatcagacgatggcttagtcggccatcaatgggaggagaggcccttggtcttgtgaagattatatgccccagtatagggcaatgccagggccaggaagcaggagtgggtgggttggcgagcagggggagggtataggggattttcagagaggaaactaggaaaggggatagcatttgaactgtaaatgaagaaaatatctttttaaaaaactaaaaataaatattaagcaaaaaaaaatcattgtgtccacataaggttcctttattttgcttcctaggaaaggctgttcccataattggaggaaaatattattcaggtactatatagcagagcaaagattgttagcctcttgactctgcctgtattctgtagtatactccaacagttcccaagcacttgatgtcatcatacggatgactgctattcctagcaagtcctcatctccttgaattagccaaaatgccactcttcctgacctcactcaagaaagagcaaactctgagtaaggaattctatgaagaagcatcatcatcaagcaccatactattataagaacacaattattgttttgaaacactgttattagaaaaactccctgttatgttcttctgtgaggcagattgctactctttcatggaaggctgcagaacaggtgttctgagttagatttagttgttaagcattgtcatctattcgggttctgtcagtaagattagtgcaagataacacaggtatcctggtttctagatgcttagcctctagagctgtgtttcaatcccatcttttatcctcttagcatcatttctggactcttttttcttgagaaatgtttctatttggatagaatgtctcacactgtttcttgttcccagccattttgaagtgtcacagattgatatctcagcaaaagaactctgaaatctacttgtttgctttccaatcctgactccaccatttgctgatcttaggactgagcaatacacttagcatttatgcacagtagttttttcatttgaaaaaaaaaaaaaaagacatactcttaaaaaaaaaagacctctttgcatagttgcgattacatatacaagtttaatagattacatatacaagtttaatagaatgtaattcccagggggcatagttaggaaaacaggctacctgtctcttatcttttcactaggtgtaaatccaaaatgtctcatttttatagccatttcatttacaatccccaaggatttaggttttgggagtaacttaaaattctctctctctctctctctctctctctctctctctctctctctctctctcgtgcttttattttcctgtgtttttgtgtttatccttaaaagttgtgtgcttgtataaaccatggaaagtttgaaaggagcctgtaattactcaagagttctttgctcctaaatcctcaacaacaatcatttagtttgttgtcagagctattgtgcttaattaatatttatgtacgacttagtgaaatcatgaaaattaacagatgtccttatctaaacaggtggtgcatgtatcaacaatggcaataagaacagtactgctgcagtagcacttctttatatctgagtcatttccaagttgagttagttatcttggctttcacatttatgtcccagcctggaaagcacacaattgggccaataaacttggttatcagtgcattctaagatattcatgtgaaatgtgaaccttagtttatatttcaaaaactaaaatataaagagtagctgtcctagttacttttcttttgatgtgataagacatcattaccaaggcaacttataaaagaatttattggggaattacagtttcagagggtgagtccatcaccatcatggtaggtagcctagaaggatgcaggtatgcactgaaggaatcctaaagggcttatatcttgactcccaagcaggaggactagtgagagaaagtgtgtttgtgtgtgtgtgtgtgtgtgtgtgtgtgtgtgtgtgtgtgttagtggcggtgctggtgctggtggttgggagtagggggtgtcaggcaggctttttgaaaacctcacaacctgctcttaatgttgcaactcctcgaacagggcacatctcaacaatgccacatttcccaattctttgcacatagttatacaaactgggaaccagcaattaaatacatgatgttgtggagcccattctcattcaaaacacctcagtggcattgtcagaaagttgttatagtatctcacagaaaattccagaaatcatatagagttgacaggctgcctttctagaatgactgaggacacggacttctttgttattaaaattgtagtgcttcccaagtctcagccagttgtgtatacattgtaggaaacagcaagtaaaacagtgtaaaagggctctatatcaacaaacacctctagctcaacatcccttattctgtgctgtatcagtgctggatctctatagggcttttggacagatcgtattcttagtcatatgactctctctgtttgcaagatattcttaagaatttatcattttatttttatttgaggctcattctatctcccaaaataaaattaacttttcacctgagaaagggaaaatgtccactaaatagataaacatcaaatttgaaatgaattattaatttagaagctggtatttttcaatattaagttgttaagtttgtttcctatttaatactcttccctatcctttgaaatcagtttacaacttggaataatttttacttggctcaagtctattgatcatagcactctctcttaagaggactgaatgacaatttcataaaaattctgatggaaatccactcactctttccttcagctcctaaatataacaccacttgtctcctgcataccagatactaattcaggtgttgggaataagtgagcaaaacaaagtgaaagttagtctggagcgctcgggtgtttgatggggcagcatagatggtaaatcagtagcaaaatttagactgcagtaaatagagtgttggataatgaaaactgatacttacaaaaggtgatgggggtgaacatctctgtagagataacccaaaatgcacacgccttctggggaaaaatgtgcttgaaggggctcatctttcagagcaacaagggcacgggagctggacctgatggatggagaaatcagatttgtaggagatgaggcttcagagacaagtctagggtgagatgggaggtgacaccagaactccttatgatgagctagcacactgtaatttcccaagcccaagagaatgcaaaaatgtctggtttcactttgctgtttatttttctcttcttcagttatccagttgttgaatgattgactgtttctgcacaggttacttcattagacctagaaaacaaaactggaataggaaatattttcctattctgagcttgaactatttactctctagagactttcagtcagctcagaaagtttaaaagtcctcaactttgtgcctctgtcttccagcaaccttcatttgcttggtaagtgcactctcttctatgtaatgaaatatttttatacaaaaatggccctgataactttagctgaactgttatatttgtcttccttcaagacggaaatttcaagacttctcattgcattcatgatcaaaccctaagaatcatgatatcatcctaaaggattctatggtgtgtgtgtgtgtgtgtgtgtgtgtttgtgtgtgtgtgtgtttgttacataactgcatgtatatttctatctagcacgcttttcctcccttgcctaacaaagtgctattattccttcatggcaactccttcataaaggtctccctagccttttctccgagagttaattacttctgtccacgttcagccctgtacttctgtcatctcaggcatcactgtgtattgttaggattttatgcttccacttttatttcccactagaatagaagttccttagttgtcaaatgcaaagcttatttgttcttgaaactctgatacctagcaaaggacttggcacacagtcagtttgaaaatattttgtttttgatgaaaaaataccctattaaagatgaggcaaatggtcacagcatgaagtaaatagaatatgcatataaattgggtttttattatgtaatctttcaaaaaaatcattatttgaggggacacatagtatttatcagaagtcattatttaatatatgtttacatggacttattatttagcattcaccatattttatgtattttaaagcatttcacagaaaatctcacattcctttgccattttggtttgaaatcacttaggccaggtaatgggacacacgcctttaatcccagcacttgggaggggaagaggcaggcggatttctgacttagaggccagcctggtctacagagtgagttccaggacagccaaagctatgtagagaaaccctgtctcggaaaaaaaaaagaaaagaaaagaaatcacttagattttcttcattctctcatgtatagtagaatagactaccataagatagccatctttagcaaattttaaatattagactatcataggtttataagtaagtatatgcattcattaaaccaaagagatcatcactggattgtggacatcctagggatagaggatatagcttattcatctttgcatctcctctgcagactgctggcatgggaatctatattaactttctgaaacccttaggaaatacggtgtgctagtaaaagattaactgactttcagaaacaccacacacatgatgcatgcgcactcacgcatacacacacacacacacacacacacacacacacacacacacacacatacacacatactcataccctcatacacacacgttcacataccagttgacaggtgagtccatctatttctcatgttaagaacatttgtacccaatgaagccataatatgctgtttaaccatggttatggatcttccacagagtattaaaacagaaaacacttgaccttgagaaaccaatatattcataaagtacatattagggcacacttctagagatctctaagacaaattttaataaaatactaacatttttaaaacaaaatacctgaatcattttcactgaaaaacatgagaatagaaaagaaaaactaacacagaacaaacaaaacccatggcttttaatttcaaggctctctctctctctctcactctcttgcttcactttattatggcttatatggtaataaaaattttatatgccccagtacaggggaacgccagggccaaaaagtgggagtggggggtaggggagtgggggggagggtatgggggacttttggggatagcattggaaatgtaaatgaggaaagtacctaataaaaaaatatttaaaaaatagtcaataaatggacaaataattatggcttgtaagatacttaacttgggacgttgattttgggctgattgattgactttgagttctcttccgctcctgtgtaaactctcagtaatatcgcagtggtcttttctccccttattgaaaaaaatagttttccacttacaatgtagtttaacatttctttattttacatacttttatagtgttttatatttatatttaactggtttaatttgcctagttccttcatatgatataagtacaattaagtttaatgtgtttttcaaatatatgcctcttcttgattatccattagttctgaaagtttcatcacactatgagggaaaagctagagacatcctaggaaacttctgaagaaaacacctacactgatgtggaacaataggagatttccagagtaccctcttgtgatttccacattacccaccccctctggtggctattcttggttctcaacttgactacatctgaaattaactaaatgctgaagctgctgggcccatctttgagggattgttagttgggtcccttgaggtaggaagacctacctgaagttgagatcatgggaggtctgaaaacccttttacatctggagcatgcctttgcatagcagcttatataagtgacaagggagaaagataggatgtcgctctgtgtctgtatgtctgtgtgccgtcagtctctctggcaagttcatcctttcattggcattagagcttctttgtcaggtgtgtactgaagactagctgagacttacagctttttagcctgaacagctaccagattcttggtctatctattgatagatattcatggttgagttgggtggatcacagtctaaaagtccctctaggaaatctgtgtatctatctatctatctatctatctatcatctatgtatctacctactgacctatctattcattctacaattctgttcttctagagtcataactaatgcactatcaggtttaataaacatacataggtaggtgaagggggtttgaaagcagactctcttcacaatcattatccaggagggacccaggctactccttgccccatgtagaagggattttcatacaagtggataaagtgttgctgttaaagtttcacttcagtttaatttaacttattttaaaataattttatcttggcttgaatttgaaccaaggggtagactaagggtactaagagcctgcacaaatcaatagacttatgctcagctgacagtcccgctttatttggtctcgtgtgactaatggactaagctaattctttaaagttgatgtttttaggaaattaaagatgttttaataattagagaattagttctttagaaatctcttggcaatcttatctttaaaaacctaatgtctgtggggtttttttatgcataattgtatcaagctcacaatatcctatggcctagggaggtagcagtaatggtgcttcttcatctgaatttctcacttttatcccccaaaagtgcattttccgcaaaattaaggtgggagaaaagaagtcatttcagctatgtaaaaggttttgttgttgttgttgttattgttttgttttattttgttttgttttacaatatacgatggccttggcttccatagtaggtaactggttcatgaaaattggctttccttttggagttgaaaatatttggacttaaaagaccaagtaggctggtgtatggtggtccataatcacttgtttcaaggatattttctacctactgtctaatctgttaatttattagtgaataatggaaagtacttcctctccagagttgtgtgtctttctcatatctgtaatggagaagctattcttttcagagccaaataaaataagtatgcatgattaacctatccagaagagagtgagatcaacttgaatttaccacaaatgtaaacacacatacacatggaaaactttagctttctatttgtatgctttctcaaataagtagaattcacacatctctccaacacacacacatactcagagactacagttcttaccacatatccaaatacactctgattatatatgcattcaatgctaaagatggtaggcctctaacagtgtgcaagaagaaatcacttgacctccctgtaaagtgtcaataaatattaattccttagttttatatgacacttgggataattgccttgcttaatttctattttatatgtttaaatatatttattgaaatatagtatgatttattaacattataataacttggtattattctgagtactatggcctgtaagataaataactttgcccttatagagaaagcagaaggtgtaatcattatgtacagtaaaggtattttgaaggcatatttcatattaaacatacaaataaaatcctacccaatatgattaaatctaaagggatataggaaagtgaagcataccttatgtatatataaaattttatcaaaatgaaaggtaacttatcctatgatatatagtcctcaatccatgtgtgtccttctgagttcacaattaatacatttgttactgatattattttttggatgaaaaatctatttaatcaaacaaattggctaatcacttgagtaactaatgatcctccagagatcatccagagtagaaaaatatttaaaacataaaataaggaagtttaaattggtaagagagaggaggactgttgatagtttcttcaagtttcatgaatacacactgtcagccacataggtgagtacttttggatttttacacaatgtcagaatttattgagtcacaataaattctcaaggtaggcaaactgcttcagatagatattcctgcttctcttagcaactgtgctggttggattttttgtcaacctgacgaaatgtagagtcatctgggaagaggcagcactaatggagaatataattcagcagattgtgcctgtgggagagtcttcaggggcatttcttaatgttaatgattaatataggaaggcccagaacactatgtgtgctatcactctgagaaggtgctcctgagtagtataagaaagagggttaagcaagccctgatcaggcagccaataagtagcaatcctctatgagctctccttcagttcctgtctctagtttactgccctgattgaatgtcttcctgtgcttcccttagtgaaagactgggagtagtaacaagaaataaacatttcctcctctatggtttttatcactgtttcatcacaatacctcaaagcacactggaacaatatctctgccctaagaaaacataagttccttatttctattttattcactaatatccactttcatatcatgcattccatattgcacagcaaacacatccacaaatacaaacaaaacaaaacaaaacaaaacaaaacaagacaatcaaattatttgatagcctgagaggctaaccaaagggatgcaggagtttctacactgataacaaaccctacctacactccagggataaagcttctgatttcactcagcctttggaggtcacaggtttgagagtgaagctatagagttgagtttagatatagaggtgaaagggttggcccagatccagaggaagaaatagaccaatgaatgaaaggcaagtccaaaagggcaaacaggataaaccgacaatagttaagtagaccagcttcttctaagcccagatgaagtgtaggaaacaataagatgtctctgtttgtcagtctttggtgcacaaactacatcatgagattctgtattggcaggagccatcacccatcactaagcccagtgcttctttttttttaatgaggtcagaggaagagattacacccctgcctgggtctagagattacacccctccatggtcccagtacatttcataaattaatagcatggtatcttttctactcttgggaatacttcatttatcaatttgtactgcataggtagggctggatgagatactatttttggatccatctaggcataaaatcatcccctttcctctgaatggaatcagaaaacgattgtaagcggactaagagcagggcacagtctcaaagataatcactgctttaaacagtatggagtaactcagaacagttcctgagctcccatcatgactcgatcacaatctaacaaaggatttgccaggtgttgtcctttccctctgcccttaaataaatgtctaatatcttctcttgattgtttataggagacaaaactatcaaagaattttgagatctttgccttgggctattgaaacatcaagaagtatggtttcatttgtgagaataagaaaacattgctaaaagtgaaggtatttgtaattcattcttgtgacttctggtctgtgtgtgacatttcaacttcccatgttataactttttatatgcttttgtagcaaaaaaagtgggagggagagggaaacagagagagagagagagagagagagagagagagagagagagagagagctaacaaccaaaaatccttccatgcttcttgaggacctggaagtagttagattcagccacctctttagaaattttctcttatagtcaacccaagctctgagaaggcttaagctaaaaggaagcttgcttaggatagttaaagaaagtataagaattaggccttgtctacgcagactcaaatggaataaaagcaactgattgaaaatttcagtgagattcaattgtattctttgtatgaagaaggttgggattaattatgcattgaggggttacctgaaagtgtggattttggcactcatgcacatcagagtgatttaagtgtctatgacttgcatataacaaaatgaagatattgcagtaagaaagaaagtacttttattgaaaaattttgcagtaagagacagaagccaccatgaaagataaaatttctttcacagaagcaagaggagagattgtctaaaggttggggtgagctcatgaaaaattcatggcaaatatttggaagatggctttgtattccaagacatccttcttctattttgaagatagctagtctaatgacacagagaaatccacttgagggaagatcagttcccactgtcacacagaaactaaggaatacagggttttctactcggtagattacaattaagaggattataacctttaaaaatattatgaaattggcaagaggctttttaaaagttctacatgccagaagagcagatgaaagatttataattaaagagtttctaaaaataaatgttttaagtaaagaaaatttaaggagccaaatatcagaggcttgcctaagttgtagcccagctgaaagataggagactatcaaggttgaatgacaaactcacagtgctctctaggagccacatgtgaaagggttggtgagaaagaatatctctttggtacttgaaattaaacttaaaaaaaaaaaatctagccgggtagtggtggtgcatgcctttaatcctagcccttgggaggcagaggtaggtgaatttctgagttccaggccagcctggtctacaaagtgagttccagggctaaacagagaaaccctgtctcgaaaacaaaacaaaacaaaacaaaacaaaacaaaacaaaacaaaacaaaaccaaaaacaaagacaaaaacaaagacaaaaacaattctaatcaagtaggaatttaattagaattaaaatacatatttaaaattgagaggcatgtagttcactaagaattttactcattgttgagtgacatcccaacgacagcacttccacaagttgtggagtgaaatgccagcacattccatgataaaacttcatctgaagtataacccagcatgaacagagatccatttctaagtgacaggctcactcattatttttccccttcactttgactcctatggggctttccttcaatggccccagtagcttcccccttttctgattttggattttaaggatttaagtttcctctctttgcagttctattaatcaacaataggtaaaataactgaaaattttactaataaaagtaaccttgtgctcctaataccaaactgtcacatggggaaacatattgaagtaattcaactcagtaaaaaatcatcgcctgttcgctgatgccagaatggaagaagaaagaatgattatcaacaaaatctgtcctacactgttaagactctcattggtaagactattaatagaatgtttattccattcttaaaaggcttttcagatattgtctggcattttttcatttgtattatacagtgttgttctttattatatattaatactagtagacttgccagtactaaattcacaacatattcataccatcttcactggctgaaattgaacatgggtaaactccagtcttttaagagagccacaaataacaatgcctttttgcaaagagatgacagaatttgccagtagagtctatatatggcttgctaatccatttgggaaattttagatattacagtgggtaagatttccttagagcattcactgagcaataagtatgtataaatggaataattccttagaatgacttgtaaataaggatggaaaattagtgcactacttcagattttgtacagtaaatgcaaattatgctatagaaatttgtcttattaaggtcagataaccaggccaactcccatgttctgccccaggggtttctaggttccagaagtgttctagacaagcaataaatttcccttttcttatgaaatgaccaggctctgactattgcctttagtggttttgaatccttgctccagcagcatatccctgcaggctagctttagattataccagtacagaccccatcactggaattaagaattgaccataatgcaaaacctggagtcatttatcagaagctcttatccattgggagcttgaaatgctctcttccctcttgggaaattggagctcctaaagttttaaaattttacgtgtttacattctgcctagtcaaacacatctatatcaaatgaagaaaaacaatacccacaaagattatgtgagctgtgcattgtaggaaattttattgggtgcaggaagagaatcaattcagaatcccccttcctgcctagctttgcctctaactgatgccatttcttggtgattgattcatgctctcatggttagggaatgagacattaatgtgagtgagtggagatacacttatgaatcagctattttatagacaaattgcatccttaagagaacttccctaacccattccactctggagacccttgtgttgtaatcaagctgatgccttctgagagaagttgctcaggtactgcccttatagaccatctccctcaaattgtttccagagtaagcccagatactgattacctcaaaggaccaaatacaagtcagatagttctaagtataagagctcatattgttagcagaaatcttaataatgttttgaaataactgtttggaaacttaaaaatatgtatgataagaatttccatgtaccatgttaaaatttcaagactgagtctagcaagtataggccagtataatgattctgtctttagagtctataggtggaattgaatcaagatcaattgatagacctccctctctttcttcctccttacccttttacttcctcctcctcatttttctctttatttcttcacacacatgtacacctgtgcttgtatcacataaatctatgtgtgtgtccacccaattcctactcagttgcttagtgtgaaagtctcttttactggccttgtcacaacagcaagtgtttttgagtcacaatagatgagaacatggtgaaagaggcaaagaaaaaaagccaaccctcattatgaagattctaggaattgtatgctattgattcaagcttattctattatgaaaaactgtttccaaacctagagttttcagctttaggacaagagtcctaaaagacaaattaacaatataaaatgtatcaaatttatgatttaagtaatgctatacaagacatgagagtctttgggaattaagtttaaaggacaggatgataaattttggtgaatgttcagcattgatatttaataacatgactgtgatatgacaaaaggataagtcctagtggtaaaaaagggggcggggttagaagcaaattagtcctgttttctggaattcttgcaactgtcttttttcccaagtatatcgtaagttgtctgtcacaggagattgagaagatgagcaaatagtcttttgcatctattcttgggttgtgtattgcttaccatgctctgtacctctatgcttgaacaattttataatagaggttttgattggcaaaataagattatatatgtaatcttcagcaagagttggtactgtgtttatctcaaggtaccaatactattagatgcatggccttgatttaaagactctccaaatttatatcctatttccaaaatcatattagtttacctggcatttaagagatttaagccagagaataactctggagttacatagaatctaaaagtctgatactcatattttatactatcttatattgtctaatgaaaaaaaaattctcagaatgaaaattatttgagaaaaaaagattagaaaactcaacatacattctggatataataaaggatctttcatgagttctacaaactcagtatcttttaaagataaacaccactcttaccttactaaatatagtattaattttcctggatttgtaaaacaatcaaactatgttaaattaaggaagaaagaaaaccctttaaaaccaatttctgtggaagcatttctcatatcaaaacatggtaattaagtttttcaatcagtgtgaataaccttatttttaataatggtctgctgtgcctgatgtagttggagccaattttcctcaacactcacagtagtaataatgccttgtcctcaccttacttctctttctatatttctgtgatcataagccagtcatattcctatttgaaatctctgtattattttccctacaacttatataatcttcccatatccttctgggcacaatctctgaaaaagaaaatcttgtctgctatatgattttgtaattcctgctctaggactgtgtttgtgtctgaattcgtgccctaattctgagaaccctattaagtccagtttgactcttttaccaaggcaccaaccaggatccatttagaaaccttgctgaataagcagatgggaagaatgtaaatacatgtagacttatgccataacacagaccctgaatggcctacagatatgcatgggtgctggtgctaaataagagctggcattagtcttagtttagaactggaattttaaactaaatcttatttgagctgcaagattgatgacctttaaccctctcaaaggaatacatgaataaatgtaaaattttattacattctatagtgcaccttgatatgcagattaggggggtcttttgcattggtaggatatttgtgaagactatttctgaaaaattcttaatgaagtaaacaaagtaattgaataattgagataaaagatgcaattattcagatatgaagtggagttctggtatatctgtgttgtaagtcgattactatagattcataagatggaatcgcacttgtcccttctctggtacccacgcatatagtacacatttgtgttgtatgcatcaatgaatttctcagcatttatttctccatgtgtccaaagtgatccagaatttagtgacaaataagttcaaaaattggacacatactactttctcatacccttcttttttcttgttctaattcacttaagcagtgctatacaaagcccttaatctagtcctaactacagtgccctgcctttctctaacatatgacagttttcttatttatcctactttattcagagtgctattaggtaattgtatatttattattaaatgtaatttttgtaaagcagtgattattctcatctaaacacatatttcaacacaaaataataactctattgaacataaaagtgcttatctatattggcttagtaaacagatttagtgacattcatatatatactaactagatagatatgaagtgctatgttagacattaaaaattatatgttctcaaaactcagtattgtcctccaggaatttatgatagcattatggaaaataatgcactttcttggtataatgtaatgattccaggaagtctaggaattggtatggtctgtaacgttggaaagcagaaatgagttctaacttataggtcatgatgtgattaatacaagacttccaggatgtgtatggtaaagggagtgtttgttggggtgggggacgactcagaattatcaccgtaatacttttacataaaactttaaacaatcaattgaaagtaggttcatcttatataaaacctcaactgtgaagtgagttagaggctcttcatctcatctacaagatacctttggttatttttgaacaagggagaaatatacactaatatatggctgttgaatgtggcataataatcagttgttaaatgttctacttagtgtctgtctgtttgtttttgccaatttgacaaaagcgaatcttggaagaaggaacctcagttcagagagtacttctattggcctgtcggtgagattctgaaacattttctgattaatgattgatgtaatatatccaagaacacagtcagtgatagtttgtggttgggagatatgagccaaataaaccccactcatataaattgcttttcactagtctttccatcaggaaatgaaagcaaacaagcatcaactgaagtaagcctattaattgatgtgatgggttatgctctgatcaattataaattcccacatgtcatggaagtaaccaaatgaaggaggttgattttatggttactataatttgttgactttcaagctcaaatagtacaattgagagaatgccaacattttcagggcaaatgatctacattttctaccagaaacaaaactacttcactaaccctaaaactttgtatttccatgagtggctaacattttaaaagggtacttagttctggttgagtcagcttagttatttgttgtgcttattatattttatttccatttgggagtgatgtgggacaattcttttatgttttataccccaatattttatgattatcttttgttggttgtttttgttgttgttgttttgttttgttgttttttgttttgtctttgttttttaatttgtgatagggtctcttgtattactggctttccttgaactcactacatacctggacacaaccttgaacttctacttctcctgcttataacatcaaacttctaggactaagggtgtgtgccataagacagttaacataatctagagtagagaacctatggcttcatgtatgctagtcatgcattgtgtcatctgaggcacatcccaagcccctcaataatattattccatcagaatacagtttctgcaaagaaaattacccaagggaccacagcctcatggtccattattgtcatcacaatgtatacttcactagggatgttgggtaaaccacagctttaactaatttttaataattaatattctgcctggtaattaaaagtatagtaattaaattcatatgtgcacattgaaacaaaatgattgacagtttagtataataacagtagttagtatttatctatctatgacttaatactaggacaaactttttatctcagttgagatacttgagaaacatcttaaattttcttatctcctaatgagaaatgtgcccctctggaaaaattctatatggtttacttcctatttattatggtttcttaaacacctgtgtatattgacccatgttttattgtgatatgttggagagatcacatgagtgtgagtgtgtgtgtgtgtgtgtgtgagagtatgtgtgtgtgagtgtgtgtgtttgtgagtgtgtatgtgagtgtatgtgtgtgagtgtgtgtgtgagtgtatgtgtgtgtgagtgtgtgtgagtgtatgtgtgtatgtgtgtgtgagtgtgtgtgagtgtgtgtgtgtgtgtttgtgagtgtgtgtgagtgtgtgtgagtgtgtgtgtatgtgagtgattgtgtgtgtgagtgtgtgtgtgtgtgtgtgtatgtgtgtgtgtgtgtgtgtgtgtgtgtgtgtgttatgtaggaaatggaagtgaatgccagcaagtaaggagttcatgctccaggagtgaagtctttgaggagctgcgtaacacaataggcttccttttacgtttttccataagtgttgttgttgtggttgttatagttgttgttgttgttatgattattattgctattattattatgattgctattgcttacctcaaatgttgctagctggtattccctctcggtccacttactttgtgaaaggatacacaaatactttagaagtcttcatttcctgggggaagtttgagtattttgtgttctgttattttaatcttactccttcagaacttttttcaccttcaagtgaactctgtattttccataataaataccttctaagttttcctaccaaagccttagcttgctctcatgttacatccttacacacttgcagatacaagtgcatgaaaaacagtttgctttcaatttcatgataaatacaaactgcttgatctcacaaatgcttcatatttccacattccaggccagttgtttgcttctcacattttaatgataagaaattatactcactctcctctctctctttctctctctctctttctctctcttccccacttctccctaacccttccctctttctttctctccccccaccttgtgtgtgtgtgtgtgtatgagagataaagagagagacagattctttgctgatatcaagacaatcttttgaaaatatttcacttgcaatatgacataaccatatatagatatagctttcatctttcagtttagaaccatatgccattttataaacctcatttaaatgtgaatggattgatagatttatataactcaatggaattctagtacaaaagtaattaataaatttggcaaatacgctaagagtggcaaatgggtttcatcctgaatgtcagttctgtctgataaaatgccatgatcccagttactctaaggaagattttcacctgcatctggttcaccaggaaagaatgtcacactcaattagtgttgcctttgatgtgacaggaatagcaattttggggattctgggaatgatttcatatagcttactaagagcaagaagcactgacggatggagaattactatgaccaaggtgtttagaatgaaaataaatgtgcatttgaaagagacatgtttatttcaaaagatgagcggaggtttagatgtcagatggaactagtaagaaaggtggttgtagaagttatgtgtgcctgagcctctttcctccaagtgttcttcctgggcagtaatctggaactctttatagtaactgacgttcaaatctaagtccctaacattttagcaccatgttctcactgaattgtttcctcgtctacacaattaaacactgggttggttgctgtggtgtgtaggaggtgctcctaatgctgggtacacatgtatcatattcagtagtagctgctgctgtgttttattctatcagcaaacaaaatgagtgaattctgacagaatgaaagctcttttgaatcagtaaacactgcaagcttcctttgatgctagcttcccccttgtgaagactggagagccacagggcagggaagcaggttggctgtggcctttgaaatgctttggggaaagctaaagggaaataatgtgcagtttcagttttctggtagtccttctccctcctcttacagtattgtagctgtgttctctgattaaagtcagttatttagttctttgcttattcaaggaattcttacattaaaaactgtatttctcaggcaaaatatttttatgtttgaatgacttcactagattttaccttcccccacgcccactcttcaggaattgtcacctattaacatttttgttcgaacatatctaatcgagaaggcgacttttcaggttcatgttctaattgatgaaaccaataattaaaggcatctgtgtcaaatcaaaacatatctagaattcattagtgcagctgtgtgctagggaaaccatgtggcagattggattggtgatgacataagagagtgatttgtccttcggtctatggacccccccaaacctggcagacattcagcagcttgtatatgttcgaggaacatctaaatctaaaaatcaatgcagtctttttttctatgacactgaatctgaaactggttctcccatatctgatgacattagctttcatttgtcttgtctctaaagtctcaggttgtcaggtttttattattgcctcttctctgcctttctcacaggattttgtggctcacaaaaaccctggatgtttttgcttttaaagaagacaagtgagcctttggcttgacttcattgtttatgaaagtgaaggttccatttataatagcctgctctttagaaatgtcactgttatacactcttttctttgcaaaatctgtactggggtaactgtcagaaggtcccatgtagcacaatggccagctatcacaaatgacagtgtcaacatctcggtgcattttaaaactgcatatcttaattttaaaagttaacctatgcttgctctgttttaccaccatgtgttgttttagtttttttttttttaattttttgtctgttttattttttatttttattttgtacatactcaaaatcctgacacattttgagtaggcactctgaaagtgtttaactatcacagagaggtctccagtaaagctaaaatttgaacaatatactcctgtcctttgctttgatcttggtttgttcctgttgcaatttggccttggagatagatccttatgtagctgatagttgaatctccctcatgtaaagtgtctacttgtcaagtttactgctaattatggtcccaaattcattcactgattttcatagaaaagtttgaaaggatactgtgctatctatttcttacaattgacagtactgaaacacactgcgaaaagtcacatgtcaaactgaacgtaggtctttcgaactgtaaaagcctttccaatgtattatgttctttgtacctcggaatctattctttgtgaggaaaaaaaccaaagtgatacaatgttatacattaggaggcaaataatcaggattttagaatctgttgaattataagaaaagatgtatgaagaaagaacctaataaaaaggtgttgtagggccccacaaattaaaaggaagtaaaaactggacacttcctttaatctttaagagatcacaacagaagtgaaaaaaaggggtggtcataaagtcaagttacattttcaggtgtgtgacccaattttagacctggagcaggttcataaaaggcctggcccagatccaaaaggaaacagcggacagcctgccttcgttgacactcagtcacatctgcccattgtacaataaatttgccttgatgcaacagcatttaagaaattgaatgaaaatgttcatgactgatgcactacaattagtgctgaaattcgttccctggggaacgtaccaatcaactgactatcaaagacttacacaagtactcacacaaatagcttccatgccaaccatgtttgcatcctttccacttcttgcaatcaaggttcattttgaagcttctttccaggaatcaggacctcagtttgcacggggaacaggaaggagatgtgttttcttccttttagggtggtgatttgaaactaataactctctggtttttggaaaatgagaaataaatcttgccttctttagcaccagatttgaacagagcgtaccatgcgttggcataaagactcttccttgctgtcgctttcatttgcatcctttgaaagcacaaaaatgatccagatacatgtattcataaagagaagcattccaggtagtgcattgatgcagacttaatacactaaggtatatttacaccaaagtaaaagcatagcacagtaacaacaaaaaatttagtattactccttatactgttattaaaatgagttctctagatatatattacaatttttaaagaaaaatctaactacttccagccaaatatattatttcactaataatatgtttttcattcaaatgtatataatagaagttcactggcatatggagaaaactattgaataaatcttctgtaagcataaatttagaaacattgcttaggatcaaaggaaactccatatctcaatctgttcttcctaactaaggtcttttcatgcagaaaagaatttgaggttctgttgggaaaattatacaacttgctttctggtaagtcatgcatcttcactgtttgacatcgatcaaattggcttcttagagctttgcactatatccttttctgtatttgctcagtattgttcacttcaagatgttactgaattacttagttgaggctggacaacagatatatcccttccatctaagtaccctaagtaaagttccctgagtgccacagtttcctgatcctaccatccttactgggcttgccaccaatgatctttcgcttccattctctgtgccttttccactaaaatttgattttcagagtgagagtttgagagctgcatctgctctctacaggctactgatgttaaaagtccctcatctatgacagtcatttcgtctccccacttcacacagtgagggaagaactggtgtacaagtagaaagtgttgacatgctacaaggtgggcaaagaaagcatggaagttatcatagcatctaccttaccaaggtctctgctttctctctttgtgtatatccaatacacagctgggtggttagtctctagtcctctggagtatgaacattgtttggtgttagaaacagagcagatgattttcaagagaaaaatcagaggctggtttgtggacaagaaatgatggggagaagatgtagcttttttttatcgttataactaaactgctcatagcagattatgaatccaaacactgaaagtggtagcagactcaatagaaattcatgagttaaaatttgcatcttaagggcaacagtagctcaaaaaatatcctcctgaaaggcatttcaccttgaagtattgtcatcttcagcagagagtgcctctgctgctctggagcattgctaagagttcagacacaattttgcatttggcacaaagccagtcaccaaaatcaagagagaagtcgggattcaggctttttttttttaaattggatattttcttcatttacatgtcaaatgctatcccaaaagtcccctataccctccccactgccctgctcccctacccactcactcccacttctttgccctggctttcccctgtactggggcatataaagtttggtaggccaagggtcctcgcttcccaatgatggccaattaggcatcttctgctacatatgcagctagagacatgaattctgggggtactgattagttcatattgttgttccacctataggattgcagaccccttcagctcttgggtactttctctagctcctacactgggggccctgtgttccatcctgtagatgactgggagaatccacttctgtatttgacaggcactggcaaagcctcacaggagacagctatatcagggtcctttcagcaaaatcttgctggcatatgcaatagtgtctgcgtttggtggctgattatgggatggacctccgggtggggcagtctctggatggtctaggatcaggcttctttaggtttccctcagcattgtagagtggcttcatattattttcctttttttctccagacaaaaagatatgatctgttttgagcctcaagcattcgttgcttacttttgttagttattctagttggcagaggcctgttacggtctgactgaaatgtgtcaggagcagcaactgctgtaaccacccccacacacatccccagcctctggcacagttttgccactctcaagctattgagggaatcatacacaaaatgcttcttgacactgggtcccaaccacacaaaaagatcaagtagagaggtggaagatgatataatttgcttagaaagggaagctaagtctatctatcagtaactttcctttattgagcctcagtctgcagaaatgagaaagacatagaatttcagatgaactacctcctactggcaggtgtatcagtggtgttggcaatctactgcaaacttgcatagagcttgagggccattttaccactcacagaggaaagatatagatcatgcctttggaagaacagaacataaacgttaagtaattcagatgtgggccatcataaaagtacatgcagccacgcagaagtatatttccagttccagttccaaacagcttcaggtgcaaaagagaccataagacacagcttcatggatatatatatatatatatatatatatatatatatatatatatatcacaaaagctcaacacaacacacacacgcacacacacacacacacacacacacacacacacacacatatatatactcaatatcataaaagaagccttggtctaggaatatgggaagggtaatgaatgtcttaatgatatctaattttcatctatccagtacttgggagcaagcaagtttaaatttgaaaatgaggacaggaggaatttctagacactaagaattaaatatagcatcaactaatcttgtgatatagagtaggtctctcctataaaaataaattatacttttgtcattaattgtaggttgactcattagtttatttgttcaaagattgccactattttataccataagtttttgtggaacatagatttttggcaagacccttaggtcatttgtgagattctaatggaaaacttgaagcaacaattcattgtaccctttaagatttattattattattattattattattattattattactattattatttaatttgattatgattaattgagaatttcctacaagactgtgcaattttcatcaaatctacacccatcccttttttccaactctttccatagacaaactaccatttttctgtgtcaattttatgtgcttttgtttaaatctagagactgtttcttgcttacagtatgtgcttgaatgagagcagttattgaaacacagacatcctgtcaggggctgcatccatagaaaactgatttctgtcttccatagccatctgttgcccatatcacttcagctagaggtgggaagttgatgtcctccccatccctggtggaattttgtttggcttgatattgttaatgaagtttctgttgctgtaagtcaatgtttgaaagatccatgtcatgactgggatgcactgcttcacggaagttctctactacctcattttacactctttttccactatgatccctgtacctttggaggtggggtcatgtgataaaggtgttccatttagcactagggatgtcatagcatcttattctatgcatttcgatgggttgtaagtcactttattagttattcttctgctgttgtcaatcaaaatttctctgatggaagataagagataaactaatctatgggtacaaaaaataatcacataaattatccactccataaatcgtgatcacaagaagtacacattaaatatgaatatgcaaagaagcacaccaactggttgtcctgaaaaagagggtggaaaagcttctatgatgacagaaaaggactatgccatgattaatgtaagggtaccctgcaggtgtcgaggcaggaaagtaaattgcaaagaggtaagaataaaaacttggttcagatgatttcatcaatctggcccaagatttcagggagtccgatcttaggtattttattcctaacaaattaaaacacagtataatctgaggggaacagttttcccggtggtgcacaggaagtataattacattgaaattcaactcaggatacacgtcatttcttccaagacgatgggctatagaaataggctacctatactatcttaaggcccttggaatgtgtctagcttagtcttggtcatacagatagcataaaggtcatttgggcctttagccacatcttgtaaaggttgagagagcttgggagatcctctggttatacaaataatataaggtcatttagacgatgaagtatctctggtcctggtgtgggagcttgagaaactcctggtttcaagagtcatttaaattaacagtcaacagatatcctgcttgtagtagcttgatatggcctggcccaaaagataacataagtcactggactattaatcactttgaattcccagtgttctgggtggaagaacaaggttatttgttttttatatttgtttttttttcctacatatttccctttggaaagagaatcctgcatgtttctaatgttcactgaaaggctgagttgattagagaaaaacaaaacaaaacaaaacaaaacaaaacaaaacaaaaaaccaaaaaactccaccaagttttggataggttttataaggagatcattctccaggctcaatagtgatatttaatccatgttctaggccataaacttcagtgaagaacttaaggtctggaaagaacacacctgcatggtggtaggcatatagaaactgaggccactctcctatcccccttggtaacatgtagtgtaaagtgacaaactattataaaaaggacaagtgtagccgcaaaggtgactgtttagtgtatattgggggatataaagaaagaagaataaagagaacaaacatttgaatatgtttcaagacagaactccatggtaatttgatattgataattagaaaaataaagtgcttgtgcaaaaaaaaaaagtctaatttaccctgtaatagcccaaagaaaatcagataactatagcaatccaaaaataaataaataaataaaaatggtgttaaaagataaatttaaaaaccttgattaaattcattctgccctagccctaatgtgcacacctttgtttttactggtagctaatttagaaactgcatttgaaaaatcttttaattgtaccttaattagaaagctaacatttttgttataagatagtaattaagagcacaggtattgaactctggccccctgaggattcacatctgctgtgccatcactttgcttagcaatcttccttacctccacatgccctagatttttcttttcttttgtgaggtgggagtaataatagtacttttttcctactcggttgcaaaaattaaaagagctgatgtacagatgaagtttatagaagagtgaataacaaacatacggtacatattagaaataaaaattccaaataaacacactcagataacagttaacaaagctttactctatgaataaagaaaccaccagtcaactgagatgtaagtacatttagctgtttggcactatttcagttggccacttacatatttgtattcattgctgtgtataactgtgtatacaggaccataccacaaccaatctatgtcattatgtaaatatcgatttgcattcttcttttaactcaaggttcagttcagattggatgtttattaagcaattctgttttttctagcttttataagatgtaaaattatcaaataaaaatgttgttttgcccagttttttttctgtcccctgtgttgaagacaaggattatatttcagatgtgtatatgatagtttggaccaggatggaagtacaacgatatcaagagaaagatttaattctggaaaataaacatgctactatctatctcacagtggtgtgcaagtgtaaaattaagcaagactggtatataatatacccaacagactacttaagaaatcataagaggtatcctgaatagccaaatatttaattggtaccttaagtattatggattaagtatcgtttgattaatagcagagataaatttaaatatgtagcataacatcagagactggaaactgatctacgccttttattgagaatctgcgaattgaatttgctatcaactacaaatctcattctttccaattaactcttccccactacttaagcatctgaaaagagacagtggtggccacaggagtttatcaccaaggacaggaagagtgattttagtggtgaactatgataaagacaccagattaccaatttagagacccaacattgaaagcctttagcttttgtgtttctccttcctgtaacagacaccccagcttcctgattttctccctaattcatctctctcctgatgagagagtaagaatggcttagaaatggatttgctaacatttcaattactcatgctactttgcttgtgggcaatcacactaagctgaactagcctagctctcagacgttgtgcaacaattctattagtccttttattcctacctctacatgccaactaagcttgtcatggacatgaaagatattaatcacaattcattcatgtggtactgaacagggatgctaatggccttgttatccatgatttcataagatttcatacgcctgaagtatagagacaaaagaaagctatgtgaaggaaatatttccagagtgtcttatcttctaaggaaacatgagtagaaaatttagtactaatggaaaagatgacaaaggaggaatatttcattgtaactttctactctctccctaattttgtcccctacccctctttttcccaacaaatctgtgcaatattgtgtgtgatagttccaaatcaagggggttggaaagaaatagaacgaaaaggaaaggaaaggaaggaaaaggaagggaaaagaaggaaatgcagttgttttattaataaaacaaagtttattattacatttttgtaacaaagaaatccaagagaaatgataaaatacatatttttatacgtagattagactaaaattgttgaagaactcatgttatttttttcattgtgattcatgtctattatgtgaagttatcacttgcctgaaagtgtgttctcattgacagtgttctgttcactatgagggatcacatctttccttatctttataactcttcttccttctcttcattactcttttccttcttgcctctcttcatccttctaccacatctcactgttctaatgcatcactgtttcttttctccctttgtcctctttctttttcattctcttctcttttacaaccacagtgtcctcaacatccaaacatatctcatttgctccttagaacaatgcaatgatgttaaacttttattattcagactctgttttcaacatgaggtttggggaaggcttagtaacttgagcatggcttcctgagactcacttaggtagcagatctcaaatctttgtccatctgatgcaagcatctgcttatgcacaaagctcttccttctatctcctgtggtattctaagtgatattccagtgatgcttgtatttggaggcatagacaaaacactgcttgtctgaccctatttctaaaggtccaaatgtaaaatcaatgaagactttacagtaaatacaataaaagttggcagatgttatttctactaaaaatttaaaagggtatgtgctcacatactaaagaaaacacagagacaagcacacacacatagagagactttcaaacactaccctacacttataaaattcagataagaagaatccgttgtttgctcatcagagctgtagtgatgaacagagaggtatgatgtagttaaattgtgaagaggacagagatgagatagaattgaagactgtctgtaaatcatcccagaagtgtgctctgtcttatcatctgtcaagtctattgaactggtttcacacacacacacacacacacacacacacacacacacacacacacacaaataaacttctgcttatgctgccagaatctctcccactcaaaatatgccactcttactactgcccagtagataccaagaggaaaaggatgttgtagaaggatgttttcaaattcatgcaggcttctaaaactacatgtggaaaccatttaggccatcctcaaatttcttttcactgtcctattttcaaattagaggaaaacacatttctttccatttacctatatatatatatagatgtgaatatacattttattatggattctttttttttaaagatttatttattattatatgtaagtacactgtagctgtcttcagacactccagaagagggagtcagatctcgttatggatggttgtgagccaccatgtggttgctgggatttgaactcctgaccttcggaagagcagtcgggtgctcttacccactgagccatctcaccagcgtgaatatacattttaaatagatgatttttaatggcaaataaaaccttctgaaattgtatattagtagaaatccaactggcttttaactgctgagttttagaaatcataagctctttactttaatctaatcaactctttaatagtttaatttttcccaggttttaggtaattgacagtggattggtgccattatgtatttaattagttgcagttcatttccaggtgtcattcctgaagaaaatatgtcacatttctgagttgagtgtgatccactcctctgcaccatgtgtcgttttgcctgtgtacgagtccatctacttaaattcaatgtgtctgtatgcacataaacaaagagagaaaaagatggagacacagagagagtctcaactctgttgctagctagatatgactaaaaataccaacacactcttctcaattcaatgctgatctctaattataacatcttcaaattatgagtttttatgttcttgcttcacctggggatgacttgtcttagagttctgtctctgtggaaggtacagcatattttctttgtgatcatttaactgacattaccaggtcacctgctggatgcttaagtcctggtctgcatgcctgtggtcctatcctggagaactcctgagtcttttgggaaagaagaacaaacaggccagtacttaaaatgcactgggatgagctatacacaaagcaagccaacaaacatattgttggaacattttttttccaggtcatctactgcactttgtattttaagggaatatttttaatagatgctaagccctaggttgtcaatactattgttgttgctctatagatagatgaactgaacattaatgacattgtttcaggaaatccaattccatggtactttcaaaattagtatcattcaaaaatatttgataaatggatggattttcaagaataggtaaacacagagagttatgtaactagcaacctggatctagagacacaagtattgtcatcacctctagatatggaaaggaatgatttcatgagacaatggcagaaactttgcaaatatcacattaaaagaactggaagttgtttgaagatctcagagagagccttacagagtgggagggacagaaaggatatgcaatttagttttcctggctctctcctgatttcctgtccaggtttccagagataaagtcaattttatattaaaagggaaaggagtcacttgatggtgtgatgtaaaccacagtcctatcagagagaagagaaagaagacaagatggtatggagcataaagcatgtaggctatttggatatttgcagatgcccattttgcagaatgcaagcacagtttttaatccagcaaagattctgttgctttcccccccatgccatcagctccagcaactaaagggtattggcttccaacaccttacattttctcacattagctgacaacggtaccatggtttcttcctacactttttattaaatatctcttttataatgttaccatatgaagtaattggctttgttacagcattttcatgcatatgtatcactattctttcttcttattcattcatgctcacgcccacatgcagctctgaagtatcaacccatcctcttcttgcaggagatatttcccaactgtttctcatgaaatgatctgtctgttctctcaaaaaaaatctcttgctctcttcttattgtctcctttgtatgtaaatgatccattgacccctcacaaacatatttaaatcaagactctggatgaacaaataaatatacagcatttgtctttgtaaaactggtttgctttacttagtataatgatctttgttgcatccattttcctgaaaatggcaagattttatttattttgtagttgaaaatttttccactgtgtatatgggtcatatgttctttataagttcatctattgatgaagctctagtctagttgcatttcttagctattatgaataatatagccacatataagatgtgcaagtatctttgtagtgtgccacctttgaatcctttacgtaagatctactcttctgttcttcactgactaaagtcggatttccaacattgctcaaccactggaaactccttcccctacattttattttattttttattttttattggatattttatttatttacatttcaaatgtaatcgcctttcctggtttcctctctgcaaacctcctatcccatcaggttccctctgcttctatgagggatcacctcccgcccaactacccactcccacctcaccgccctagcactcccctacactggggcatcaagccttcacaggaccaaggacctctcctctccttactgccagataaaatcatcctctgttatatatgtagctggagccttgtgtaatctttggttggtggtttactctctgggagctctgggggttctggttggttgatgttgttgttctccctatgtggttgcaaacccatttagctctttcagattttccccctaactcccccattggggtctgcatgctcagcccaatggttggctgccaacatccacctctgtatatgtcaggctctgacagagcttccagggcgacagctatatcaggctcctgtcagcaagcccttcttggcatcagcaattgtgtctaggtttggtgtctgtatgtggaatggatcgccaggtgtggcagtctctggatggcctttccttcactctctgctcaacattttttcctttagacaggagaaattctgggttaaaaaatttggagatgaataggtggccccatcccccaatcaggggcatttcagctaatctcttcctggttgtgtcctgggagcctcttgctttcctgccatctgggacttcctggtggctgcctccagttccccatcccccattgctacacacctctgtttaatttcctgacccttagtctatcatgccagtctcttcccatacctgatcctgccttgccctcttttctcatcaccctcctctcttcctcctaagtccctcccaccttctacctcctgtgagtattttgttcccccttccaagaaggaatgaagcatccacactttggtcttcctttgtcttgagcttcatgtggtctttgaattttatcttagatattccgagcttttgggctaatatccacttatcagtcatactatgtgtgttcttttgtgatgggctacctcactcaggatgatattttctagttccatccatttgcctaagaatttcatgaagttatttaatagctgaatagtactccattgggtaaatgtataaatgtatcaaattttctgcacctccttttttaaataccctgattagctaggaagaatccctgctatctgcccatccacccatgtttgattataagggaatgcgtatgtatttctattatataggaaaccatcattctactttttctttcttgcattgagaagaagcctccagatggcaatggaatttcatgatggctgttttaattcatggtttctataaaaaaaaatgagtaacaatctactaacgttaaagcatatagaaccatatactcttactaggattttaccttatttattcaaatacacattatttaagaacttgttatttttatgtctccccttttttttcaattggacttcagtcagagctaaatgtattcatacatattttctttctcactatattgttgatcatccataggtctgtcttatcttcagataattacaccatgcaggtactattccttaagtgctcaataaccttttagagtaaatgctcttttgtctgcctgtttgtttttttttgttttgttttgttttgttttttaatttttatagttgaacattgtgagaataagaaagagtatagctgatgaatgtattagtaattaacaggggggggggctatatagtagggtttttgacttccagaatctctgtgtttgccgggcggtggtggcacacacctttaatcccagcacttgggaggcagaggccatttccccacctcccaatgtaagagatccatacattgtttctcactcatcagagaaaaccattccctacaaccctcccatgaggtacttttctatgtgcagaggcaataaacacctgacttaactacttcaccccaagcctcatcttttcttaccaccataatgagtggcaactttcaacataactttggaatgggctcatccaaaccatagcatggtagttcaaaaactttctcaagttaaagtggctaactagtactagacaatgagtctagtgagtaacatagattcaggccaatgctgtgatacagggtggtatagaaaaatgattgtggtaagacaatggaattactggtgacctaggctgatttacacagtgtcaaacactgaagtaattcagatgattagattctattagcttaggttaatctagattgaatcccaaggccattgtaccattgtagtatgtgactgattcatgtatgaaattgtctcctagttcttacctcacttctaggaagttacttccatgcttataaatatctcattcttttatgctatatacatgatactactatatataaatattctgtgctatcaactggtgcttacttaaatctttgcatgccttgactcaattagttagaaaatctgcctcatagcagtttgatatctatgcaaatatctacaagttttcagctattcctagtactttgaatttatccagaattagtcttctattttaagttctgctatcttaatttttaaagagacaaacttaatgctgaccttctgagtgattttatttcatggattattaaattacaccaatgtgtagataaagtaagctttaaggctatagatactgtttaaatttaaccctctattgaactctagcaaacaatagaaacattaatttatatattttcctttgagtaatttttcatgagtactttaaggactgttctcctaagtattattaagtattagatagctgagatgaaggctttaaggtagtctttctgcaagccatctttggagcccatgagttgacctcaacatttatgttctgaataaagtgggcattgatttacagtctcactgtctataaaatgctttgtcccaaacatgaaaatgatgtctgttaacatgtgaactgcactgaaaagtcctccagaaatggtctattttgaaaggtataggtcaccacactctcacatcaaagtgtgtaaacactatatgttatatttattgtacacggagcaaagactctcactgtttttattctcaaggagaaatttccagagttagaaagaggacactgcatttggtagacaattgttcacttttctcatacttacattcccagttgtttttaacatcaacacaagactgctgtaattgtgcacagcacctgtttacacttgcaaaccttcgtatatgcttttgttggtcccagagatatttgtagcatatgtttcccactttcccttttgctccttttctcttttcatttccactctggttatttatgtttttcttattttttttttaccctctcttaatctagcttcatgatgagatgctagttcactgcaatgaggaacttactttccctgaagatgtaatttagagggcttgatttaaaataggcactgcagatgttttcaccaagtgagtcctttaaagcatctccttgggtgagcaaggtcctctgcctttgtgttttccacggttgcatagttagcatccaaattaatgtgcagtgatgactgccctgcaacaaagcggggactgtgggatgactcattgcataaaatgcatttatattcctctagcaatctgtatgtgtattctgggttccaaaaaaatatacacagatattctagggctaaagcccactcacaaacagccctttatgcagtatttttgcactattattacccacaacacaaacaggactgcttttaacaattctacaaattccagctttatttgcaactctatgtactgtgctgttaaaagtcattaacattgttttcttcacttaaaagaaattaaatgtgtctcataaattaaaactttaacatagtttgtgtctactaaaggaaaggacaattagaaattgtccaaattaatactttggcaatccggcagcaaccgaggctatttccaagttgactacaaagaaaataccctgtgtttatcatgtgtaattggcaattgctagaaaatgatgtgatatgtgaatcttaaagtgatgtaacattttatatactttttaaaataacagtgggttatgaaaggttatagagtagaatctatgatagataacattataattctttacaatggaaacattaaaagactctcaatcagcaacattaccaaacataaaaatatcccactgagcaggctctatcaagtcaactcactatggcataaatgtgcacatatattggcaaactttttatatgtatgagttttttatatcttttgaaatacatgtacatattaaacatggtgaatatataaattaattttttcagtttatctcagtactttcagaattattttgtccttgcctttcaaatactttacataatttgtgtgtgtgtgtgtgtgtgtgtgtgttgaggggatattgaagtatagggagcagacaaagtcttgagtgatagtgtactgttttcataaacaattccatattaaggaccccattgatttagacctatggaaatggcaaaaccctggataaaactcagggaaatgccaaagacttgccctggtccagttatggatcttgactgaaattattaaccacagcttccttcgatcacatgatgcaggctgacaatgctctcctacagacccagtgatcagaattatctagcttctctccttgatcacctgcatataagtctgtctccacattcagctgtatatactaatgtactattttctgtgctgcttgtgccagcattatagtgcatgtaccacagaatccgagcttttctatgcatgtgcctgtgatttctttgttccctgttaccccaggaagggcaaatccaaagccattcaggtctcaatactagagttggaagacaagaccttccttttactaagcaacttctctactattgaattgtaccattagcaactgatttaaggtcttgcatgcccttctgggccggaagtttctcctcagagcatatttctatccaatagaaagggttggtaatatggtagctggcaagtaagttagttcacaagatctataaggagtgtcagaagtgaaagtcctatgcagagttaaattgttctataaaggacagtgtcagtgttacatattcttaaagccctgtgtgtaatactggatatgtgtatacatatgtattcgtgatctatattcattcatctttatatgtactataaattgaaatgctccattatagaattattgtataaaagtcaaggttaaaaatgctcatgcagtaattaaaaggagaaaatagaagttaagaccaagatagaatgattccaggacatgcccttacaagaggtaatctgaaggtggtggattttaattaaaacgaaaccactgtgtcacagcagcactgatttgattttgcctacctgcccttctcagaaattatagatttgaaagatgtaattaacagaatattaaagattctccttcattcttcgttacgtaatgagttccctgctccttcccttagccagagctgacttcctgctggtgtaaatccttttaagttgtgtttgaacaccacatgaatcagtgacactaattagtgaggccaaactctggtcctcaactctgatatgagggttctttccccatctgcccttctctgagcacaagctcctggtgtgggtgaaggcaaggagacatagtcccctgtgcccacatttctaacaagcctaaaggtgagcacttatacaccatgaagatttttaagggatgtgtattttgttgattttgaccaatatacacagaagtgatgtgtattcatttggtttcaagcatcagaagatatagacccaaactagggggttattttagaattagttcaactctagtatttgtgttgatgtaccatctcaccctgaaaccattttcattaccagataaatctaatttaaattgagcctcaataagcagttaggaaaagcctattgctgcaagtttgtaatcccaggtattttgaagaatgaggcaaaattcccatgtccaaagcctgtctttctaactaagcagaaacctatccaaaaataaagtaaacaaaagagctgaagaactcttggcagagttcttgcctaatatgcacaagatgctgtgttcaatccctagtgttagaaaagtgatcatagtcatccttgaattttctgcttggcaatactactgctaattacatgtcgcaactgtggagaatacagaaaaagaaaaacacaggaccccaggataattcctagcttgctgattttgttttcttggcgtgtgtgtgagtgagtatgtatatatatatatatatttctactgctgtatacatacagagacacacatgtgaatatgtaacatattctaatgtatattctaatatgtgatctaatctagaatagttagaacacacagtacactattctgagggttttaagtaattagttatgcagtgttttactttcttttacaaccagcactttaagagtttacctttctccatgaacaagaacaagaaagaataaaatcttcagaggaagtcattatattatctcatagaaacatagagtcatattatgagtatgagaaggtatgaagtattgagagagccacttttaagttgcatgtactgttataaattatagcagggagaagtcatttctagcattctatagcaacataggttcaatattccacatattgaaaatgaagagaaaaccttgaagggtttcatcacaaagagaaaaatctaatgatgaagtgcagattcaatgatcctaattaggtcattaaacaaatgtgtacatgtaccttgtaagggatggcataatatataatttgtacatatacatatgcacacacattatacctacacattatatacatgtatcatacagctccttataagtgtgtagaattaatttcaatttagtgtctaaatgctttacaaacatctcacctctctacagcccatcttccagcactatctggtccttatttaattttgtgaagacccttggagtaatgtacacagcaaaataaaacatattttatgcagttttcatctctttgattttgtttaagatatctttgccttggaaaagtatgttaaaaatgagactgtttaaaacgacgacccaaccataccataatatcctgtcttttaaccctaaagccatctggcttagcttccctccattaggaaacccttctctaccttcttctcttgcctttgttctgtccaccctgcttttcccttcacgtctcttgagctttgtgttataaaaaagaattggatgtctcttgtgagactatgctggggcctggaaaatatagaagtggatggatcacagggcccccaatggaggagctagagaaagtacccaaggagctgaaggaatctgcaatcctataggtagaacaacaatatgaactaaacaataccccccccccgcccccggagctcgtgtctctagctgcatatgtatcagaagatggcctagtcggccatcagtggaaagagaggcccattggttgtgcaaactctatatgcctcagtacaggggaatgccaggtccaagaagtggaagtgggtgagtaggggagagggtgggggagcatgtgggggacttttggtatagcattggaaatgaaaatgaaataaatacccaattaaaaaaataattggtgatttcaatgggcaaaatgtcttaaagtagagcacagagaattacctcaagctttgccttttgctgtgggcctctattttttctcaatgtctgtactagtgactaattttcacattgacacatttacccaaatataaaatcacatgtttgcaaacatctaagctggaattaattaaatcaggggtataaatatagctattaattattatctacctcccattattttgagaatatacaaatgagcgatattttccattcccggtcttcacttatacacagtgctaccacttgctacatctgctagtatgttcttgagaaaaacagttttaaaagaatctatgcacttgtaaatatctctgatctggaagatgctagctttcctcatttctgaaaacagtttgcagaattccaggctgtttacaatgtagagagacctaagccttatgggaaaagaccaggaatgacctatattcagcgttacacatggataaacactggggtgctttatgatgatctggaactttcctgttcaattgtttttctaaaaatggaatcaaacccggtctttggtacataattataatgtagaaacagccttgtgaacttatatgagactcatgtacccctaatattaaccccttctaattataagatacagacacacacacacacacacacacacacannnnnnnnnnnnnnnnnnnncacacacacacacacacacacacacacacacaaacatacacacaccttgacatttttctcttactccagtttacttaaagttagcacatcatttgtaagttgactcaacaattaactagcacttgtcacttacaatttaaaaaaattttttttcggagagccacactgctaaagatgtttgtatcctgagcatttgcattgtcctctttcataattacagctgactgctactctgctttaaaaatacattgatagatagaaacctcaaaggaaaaagaagcttatcatattatgcatggccccgagaagttagaaaatgtacagaattaaacaccacccccaggagaaatctgacggttgccagccattccagaacacacttgtaatctcagcacttagaaggctgagatagaagaattatgatttaaagataagtctgggcaagggacccatacctttttgcaaaataaaactaaatataaataaattaatcaatttataaagaccaaagaaagaaagacacaaccaaccaaacagataaacagaaaccaatgcaaaccagaaaacagacctctgacgttcactttacttttcttactctcgtctgataactgctcatcttcaacctaagaattactttttgattgctgtgataaaatataatgacaaaatgcctctcaaggagaatttattttggcttacagttctgtagaatacagtcaataattgtagagattgtataatagcctttaggaacatgaagctggatcagtgtgtattcatccgcactcaggaagcagagtaagggagagaacaggatgcagtgtgaggctatatttcctcaaggtctgctccagcgacatacttctattaagttctaacctctgtaaggtttcgttaccttcacaaatagtactacctacaagggactaagtattcaaatacatgagtctatagtggaaatttcttattcaaaccaccacacacaagtataaaaattatctcttatttaaaactgtagaattgttttgtttagactaggattgcttctttgtgttgcataaatcacttgaaaattttaatgactggctatgttcacattgtattggtgaaaaatcatccatattgtgaaaaacctgtagcttgctcatgtttccttgtggcctcagaggagttctagttgtggcctaccgtttgctgaaaagtaattagctccgctttgaaaatatgttctgagtttaattacaagactgacatcaaaatgcagatctaaatacagcatctattgatcagagtgggtgcaatcatctccacaaaatacatgtctgtctgtctaaatttctttctttctttctttctttctttctttctttctttctttctttctttctttctttctttcttttttccttccttccttccttccttccttccttccttccttccttcctttctttctttctttctttctttctttctttcttttttctggtatatctttttaactgaagttcctttactattattgacctgtacaattactgagaaaaaaactgtaccccgaacagaaatccaggccatactatagttttacaaaatgttctaaaagacgtgtgtgtgtgtgtgtgtgtgtgtgtgtgtgtgtttggtaattttgaaaggtgaacccatcatgacatgtttgctagatgagtgatttccccctgagttagacaagccccaacctctttataattgacgcagtgtcttactaggtagacagagctagccttgctttcactttggaggacaataggctttgatattgtcatcttcttgtctcaatgtcctgagtaattggtattataagcttaagacatcaggcccaacttaattataagtgtattattatctcatataccttagcttggtaggtattcctaagagtccaaagcttgtaatcagaaagcacactgagtctgaagtagaagtcccatccttaaataaggtattttgatataggtagaagaattcctctgcgtaacgcttggagtcctgacttttttgatggctagttgtggacccatattataaatgtccagacatcactcaaaactccttctctcataaacccctcagaactacacaacaacttccttcttggaggtcaatttgaaacatttggacattgtgtgatgggtagagaaagaataggatatagtgctttctgggaaaagagccaggtagtagttgcaggaggacactatcagtcagtacttgtttactcttctctctctgtttgtctctgtctgtctgtctctctctgtctctctgtctctctgtctctgtctctgtctctccctctgtctcacctctctctttctaagtgtgtgtgtctcctattatctccttgacaagtaactttcctccctagtcaaggctggttacaataaggtcattactctttgacaaagctatgatagaagacaaaagagaggtagtggagatgattagagggataatgaagcttatagatgaggtaaggtataaaatgagaatgtttcatctagaaagggtaaaaggaatctgtgagtcaataccatatcatgaaaatgaccacagtaaaaacttcccaagtctttcttcctgaaattggcacttagaagcacaagggaaattaccttgattttgattatggatgacttaaacaaaaaactttgcattgataggcagtgaacacgctggctttgatggagttacttaggctcgttgagctatttcatttgtactgaagtgatataaacaacatacaagcttaagagtttattatagtacctggctttattgaaatcaacagcaaagacatattcaaactgtgaaggttctacatattaaatcattagaagaaaggatgtgtgactgactccttgcaggcttcctcttaatgcagtgggacaaggcaaatgctacatagacaaaatgatgatatagcagaccactaaattgtagaatcatctcaagaacactaggccttcaagagaagtcaaagataatcaaatagaggcttcctagctatctccctttctagggtctagagaaagacatttctgtgtctgttcaaactgtgtttcttgctttaactctgattcaaaattcttaaaatgcactttgccttaccctttctaccaaagagggaaaatgtcaatatgaaaacaaaggtgatgagtttatagctgtaatgctcaaaagctaatgagggtcaagcctgatagaagataataaaagtgggaccagagctgatatctggtgtcgttgtaatggtcagtattctacatttttcccagtattagttatccaaacaaccaaagataatgataagatgtaagaagttaacttcttaaaaaatgagtaccattcattggccaacttgcactcattcatgaatattcattaaactgtgttcctacccaaactggagtattttgtctcagaggacaactgatagagcacaaaaagatataatcatcacccacttctaatttctcatgtttttaggattaagaaaccatgacaaagaaagagagaaaaccccattctatttcaatcacttctgttttctatagccctgggcagaatgtgaaatgtgtagcaatgttttaaatcaatctcaatgggaatacaggaggtgcaacagaaaacagctttcagatttagatttttgtgtataacttaaaaaataaataattgagttgctgtgtattggtgatgtttctaagttggagtatttgaaactcccagtttccacaggatacctagagcctatttcagaaattttatgttagtatagacaaaaaacaaacaaacaaacaaacaaacaaacaaacaaactgtctgctttccttctttttcactagtgacataggtgtctatgctttattacacaaaaaggacatttcagttggaaatcctcctataaaaacagggaagaaaggaaaaatacagggaacagaggaaatgaaacatcatgtggtcattctacatagtaaaaccacaccacagtcttttgtgccttaatattttatgaaaattttgttcaatgctagcaatcagttaaaattagaaaaacacttcacaggcctattttctaccagtaacactttaacattttctattgtctctctgccttgttatgtattatatctgttatcaggtttcctcttaaatggcaccatcttttcatgtattgaaaaccataatattacatggttatattatgtaacctgataatatttagtaattaagacataatgaagaggccttgtaaataagattatcacatttaacatctggaaggtgcttgttagggtatgtttttgccatatcccttttgttgtttgttttgttttgttttgttttgttttgttttgttttgttttgttttgttttgctttgttttgtttgcccagtgctgatgcagaaacaaaacccagaccatcaccagaccggatatgtcgccttgaagttagccttctcatcttccagaatcatgagaaataaatgccaagcgtttctaaattacacagtctcaggaattttttttagagcagaacaaagtgactaagtcactacctcctcccagcttcacacccacacatacataacagttttatcttattgtcctagattcttcaaattgttcagcacagaattatatacttccccagaatttatcataggatttactgcttctaattttctaataactccccaatgttcttctatttcatgaccatgagatctttcaggaaaatcaaaacaggacactttagaatagtttaaactggggaattatttgttgctgattgtaaaatttcttatatgtgtcatcttgaaagctcggttctcaagttgatgcttcaattaactgccattgctcccatcagtcatcattaatgtaatgtagagtgtagccagagaaaaataatttaagaggggatttttgtcttgtatttcaaataagtaatatacttaatcactccattgaactaatataatctactaatactattattttaaggaaattatatttctgtgtcctagtttaaaatttgtttcttgggcctggttttacacatgattagattaaatttttctataaataagcaatattaagctatatgataattcagttattcagattatacaactgatattttttttgtttacttaatttaattgtcaatcaatctatactttaaaacaatgacaagagaaatataacaattaaaaaccctcaacaacactctagaactgtgctttcttttcccttccacaaaatgttgtagcatcatttattctttttttttatattttttttacgtattttcctcaattacatttccaatgctatcccaaaaagcctcccacccacccccactcccctacccacccattcccattttttggccctggcgttcccctgtattggggcatataaagattgcctgtccagtgggcttctctttccagtgatggccgactaggccatcttttgatacatatgcagctagagataagagttctggggtactggttagttcataatgttgcacctacagggttgcagatctctttaactccttggatactttctctagctcctccattgggggccctgtgatccatccaatagttgactgtgagcatccacttctgtgtttgttaggccccggcctagtctcacaagagatggctgataattcttaactcactttaatatttataagagtcttccctaataaagacctgtgtgctggtggggaaactttcatagtgtatacggatagaatttgtttgtgtggacacttctattcctcccatttctaactcctaattatatcttccctttgatgacttatgctacaagaacacaagtgagagctgagcagaagagtatttccctaactatgtctgtctagagttgagaccaccatcatgctcttggtgtatgagagccatcataacttgactcttataatgatgctcatgtatcctacccctgatatttgactcccaactctattatataagaataagaatgatggtcttctcaacatattgtacaaatcttccttagcctgtaagcatcccaaagcattttttgattctctgttattctgtttactcctgcagttagctcttctgtacaggatccaaatcattttccaggtttgctttgctccctgctatgtgtgatcagcatttggtgtcagtttataaaaatctttcagcagagagttaaaaaaatgttcctggctcatctctacctcctcaaccttgtcttcactcttcaattgagagacattattttctttacatttgggtttggtacagcaagtcataactcacacaaaagtctttattgagtaatctgatcattcctttctaccatacagagaatatatatgtactatcgcctacatttgtagctgaacttttaatacaactctgtccataattctatctattctgctctggcacgcctgtgcctttattacatgtaaaatcatgtgagtagcaacttataactctctgcattacaagatgatgagcactatgcaaaacatcatttactataacttagtttcttggtccaagtttttatttcagaattctgatatttaaaaatgtcagatgtatagtttggatagagactttattgacacattaaaaagaactttctaaactttcatcattgctttgaggaagcatttttattaacagatgccaaccatttgtgtaaattcaggaaagaagatagtgaaggaggtattttccagtttctgcccacccatgaatttaacttcactgaaaggaaaaagagtattaaaaagaggacaaagataagcatcattatttgagaaaatataagaatagacaaatgagtatgaggtaatttgaggaattttttttatcatctgtgggaaactggcatgtatatagaagctggttggattaagaaagattgagtctacaatgtagaattatatacatacacatgtacatatacacataaacacatctggagaagtatcaaaatcatgtaatggatgtttatgtatttatatgtgcaaacatatttaagtcatcctcctttaggaatcggaaaggactatcttgtcttcttgagatgtgctgctctgtgccagtgaggtttccttttcagtgtctcccaaacagctggtccacactaggctgtttctgaccttgcatttgggttcttattgcatttgtcgactattcttagtctctgctaatgagatcgttcagagttcgctttgaggatcacatcttaatcacttgatttctgcagacgtttcctttctccaaataaactcttcaaaacgcctgcgattttgtgctcattaacctgggaatggcttctctaactccaatctgaaaattctctcaccatctcatcctgttgccctgatcaattttactttaagcaacaattgcagagaatcttagatgctttctagtataaaaaataatcagaaaccaaatttctgttagcaaatggattttcccttagtgaaaaatcatggatcttgctcctttgtactgtagcagagctaagaaccattaaaacctaatttttgactatttccttggaatcatcaaatcattgtgtgttcaaaaaggtgtagatggcacagtgatgaataaaatggctaccaagtaaatgaagacattagtgttcatttccagagatgttttaaaggactttttcttattttacttaaaattgatgcaatatggttttcatcatgaaaacaaaagctcccctttaaacaaatgtaacattagaactaaatgccagtttaaaaccttactgaacagtgttgtggagatgaatgacgtaactggtacacaacatgcacatcagctgtctgacctgaacaagcatggaaatataggtcatggcattgcaaacctgtaagtacagttttaagaaggctagagaatgtttgaggcaggtagatcttttgttctggctgacagttgaatctagccaaaatggaaatgtctgggttcattggaaataaacctgtttccaaaacataagaaacaaacaaaacaaaaatgtaacattaacaacacacacacacacacacacacacacacacacacacacacaaacacacaacacatacctacacatacacacagacatacaacttcatggagaacaatatataaagatatcggaaatcaaccttggcctcaaaaagcacacactcacataccattgaatccaatcctattctatatccacatatacttaaatgcaaacatatactccttgtgtgtgcgcgtgcacacacacacacacacacacacacacacacacacacacacagagagagagagagagagagagagagacagaaagcattacaaatcatctccatttacttctggatagtaggttgcttctatatatttcttaaaaatctccctttgacaaattgtactaaaattcatacgatttacaagaactgtaatcctgaggtgtaaagcatggcacttctcgtcttattgtcaatgtgtttatttatgggattgtattttcttggtatcttaaaatttattttcttcttatgtgacaaaagaacagagggctgacaagttgaacacagtttttgataaatataatttatgatgttgaaattattctgaaatattgatcttatttcagatgaatttgacagacttttagcacaagaaattctttgcagattttctgatgtgtgtgtgtgtgtgtgtgtatacaatgcatagaggaagcacttgatgtcagaaaaccatggcagccataccctattgcctttttcctccccagagtcatcataagcttctacctgcaactgattataatagcagattcaacatgaaagtatggctgccatccagggcacttgtccacaggaaacatcacatatttccatgacatatctttacttcagacagctccttcagaacacttcaagacatatttttctatcagaagtgaaaattaaccatgggagaaaattaaacttgacttgaaagcatttttccaagcatacagttatgagaaatggtgttattttgattagatgaatctctttacttatccagaaaaggtctttaaagtagaaagagtctagaggatagtcttcagaggtttaacctggggaacacatttgcctctgggggagtaattgttgaaatattaggctctcaaacttgggtaattctcttcccagaggaattttagttgctttttgcagaaggaagtattgaaatctctgacatttcagaagtcttaaccttggcacagacttggatgccttgatatcttcactggaatgagagacaacagaacacatttgtttgagatagacagatagcatatagatatagacagatgggtatagacatagacattgggtatgacaaacttccatagaaaagataaagatagcagaagcagaagtagatgtagagatttggactgaaccaagtcagcacagaggatattttcaaaggtctagtaatggctagggaggtagagccgatcccttgatacaaacgcttttgcagttatatgggacaagacagagttggttggggagcaactgatatttagacagctgcactgggaggtggcagagggctttctcttttgtttctctcactgtcattcccacatgtaattcctaaggaaatcttctcaactctactgcccaaagaattcccaatgttatcagcttttctagtcccatcactgccatcaaagatcacactgtgtgttactgtgtcatattatcatttaaccagtacttaattaatgttcaaagctatgaactgatgtctattattttctttctttttaaaaatctgtttaattttaatttttttcatttagtttttacatcccaattgttccacgccccccccccacacacacacacaccagtccctgtctcacagagtccctcccacaatcccttatccccttatcctctactcctttaagatggtgggtcccatttgggtaagcacccaccacagctctcatacatgaagtctctgcaggattaggtgcatccctgctagggaacagattcctcaaacaggcaagagcttcaaagacacagagagactgagttgttcatctacacatgtagcaggagccttggtggggcctgtatatgctctatggttggtgactgagactgaaagctcacaagggttctggtgagttgactctgtaagtatttctgtggacttcctatccccttcaggacctttgatcttccataagagtccctgacctccatcctgtatttggccttgggtatccacatctgttttagtcaactgctgggttgagcctctcagaggacagttatgctaggcttctgtctgcaagcataacagagtatcatcatcaatagtgtcagggagtgtcagggattggtgcttgcccacgggatgagcctcaagttaggtcattggtttgctattcctttagtctctgctccatctttgtcccggcattttttaagataggataaattttgggtggaaagttttatgagtgggtttttgaccctatccctccactggggcttctggttggctactggaggtctccttttcagattccatatacccactgctatgcatattggctaaggtcgtccatgctaactgctgagagcctctcctatatcaattctctggcacttcctagagatttccccaggtccccaccctggtagctacagacttccatgcaaactgctctaaagacttcccactgtataagaatacaaaggaattctctttttaaatggatgttaaatccatgaacgtccaaggatgaactgtggaagttgtagttataaacttatttgaaaataaaagtttttttttgtataacttaactgtgggtataaagttatttgaaagctgcaggtacctcctaaatacattaacatgtggcttatataatatacagtggaagagtaaaatgccatctgacagcttgtaacgtagtaattataagctaaacagcaatggaaacatcacagtttgtatatttgcttatcatatatattaaattaattttatttagtgtatgtgtctgtgtctgtgtgtgtgaagtattacatttaaggacagcatgctttagaaaatctgagcctataatttaactcttttgtcaacttggaatatttttctcccaaatgatttgatatctgagtttcttcttgtcatttcttcatttataacccactttctgaagcatttttataagtaaatcaaactaaattttttttttgtctttgtattaactccaccaatcttttttttttttttttcgagtcagggtttctctgtgtaactctagctgtcctggaactcactctgtagaccaggctggcctcgaactcagaaatctgcctgcctttgcttcctgagtgctgggattaaaggcgtgtgccaccactgcctggcattcaatcaatcttttatttccctctcagtacatgtctctgagtagtatattattaaacattttgattactatctatccaacctaaatagttaattttcatgatatgagactgcaattctatcaaactcactgtaaaattcttagtgccttgagtcatctctggtgtttggccaactattcacttaatgttaaagatgaaaattaggagagaaatcaatgctttatatcagtgtgataatgttctaatagaactagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggggaaggagaagaagaagaagaagaagaagaagaagaagaagaagaagaagaagaagaagaagaagaagaagaagaagaagaagggaaggaaggaaggaaggaaggaaggaaggaaaggaaggaaggaaggaaggaaggaaggtagagagagagagagacagaaagaaagaaagaaagaaagaaagaaagaaagaaagaaagaaagaaagaaagaactagattggtggagaagaaacaaaaatgcttttatatattttgaactacatatagagatatccttttgaaattaggttagacacttttaccaaagtggcatggtgtagagaatataaacttttagaatataagactagcatcctatctgaagtaatgatgacataagactgaatatgagggagtatatacagaagagtcaatatttgtcttggataaaggggtggcaaaaagagtcttccagcacatgggaagtaggactatgagtgcccgagaacatctgggtggatgcaaaaaataaaactctcacttgctttaaaaaggagaatgcctagctttctgaaaatttagacctaggcattttctggtagattccttgaggaggatatgatttttttcgaatatggacaaatgttaaataggtttacgttttacaggggtcaattcatttagtcctgtgtgttctctgtaacacagtgactatcttgtgccactctggcatagaacacccactacacaaaggtatacatggtatacagtttgtcttctctcatgatggtattgtgcaatctgtaccctatacatcttatcaggggattaagaaacattatgacaatgtcctagtttgtctcagaaattcagaagtagagatgaataagtaatgtcacagaatcacaataatcaagaagaccatcagtgaaaaacttgaagctttctgaatgtgttagacctaacatctttcgaattttcttctggttagagaggaatagagtgtatcacccttggggatgttttctgactcctttatgacattagcttaatgacaacagccagagacacatgaaaatctgattctgaggcttacagccagttcacagttccctgagagatgattttctgagatttcatctcacagggtaacctgtgttagagaaaaggctttagcatttttttatcccctcttcctttccctgaggatctccattgttactgttcggggttttgaaagggaaacacagtcaggtcagagaaaagacccacagaatgttcgtgccagtggacaaaaatgtgaaaatactgcttataattcatggtggtctactctgtgtcatttatctttacgtgtgtgaggagtcagataagtcattcatgactctgctagccttgaccatccttcatcactacacttatggagataaatgccacagctaccatatgtcctttcagagtagagattcaaactagtaagagcagaggtcaggctcatgttattatttaaaagtgaagaacagtcggagtgtaccatttcctgtgttcacacaccttgttccggctcagcattatctgctatagaaatgaatgtgtagtatctgtacattgatgcacctatagatacctcttcatttcaaatgaaaataccatttccaagaaaatgtaaaccatttatactgtggaaataaatagattaattaatgggagtatttgttatccaagtgattagaggcaaaatgaaaacaatacagtggaagtaaattataagaaagtgtttaaatgtctttttctggtcaaatcacatgtgataggaccaagtcaccagaagaaaaaagaaaaaaaagagtgagacatgatattggaactgtgatattagagaaaacagtgtggaaaccttggctttataagctgtggcacaagagggctatagtgctacagtgaagcaagtgggttctttctcagctctgcacttgaggagtactctacaggacaactaagcaataagacctctttatcactcaattgctggatcgagtgcatatagaaggaagatttttccattgtcatcaaggcattgcttctttattaccttggttgctatcctctataactagcaagaatgtcaaagtgttttccacaaatctgaaccaaatatcagtgctataatggtttattgttggagtttatgtttaaatcatgattcttacaaaaaagaaggccataaatttgaaaaacagcaaggagataatatatagataggatgagggcaggaaagaagaggaaaacaaagatataatcataatattttctcaaaaataataatataaacataaaacatagtaaatattaatatatttgactgtaaatgtgtaatttttacatgatttaagttaatgaactaatttatgtacttttcataccaatatgagcaccctctcatccaagtctccccttacacatctccccctcccattcacacttcccttttcatctgacaagggagagacccctcccctgggtataacatcaagtcactgcaggactaggcacatcctctcccaatgaggccagacaaggcagcctaattaggaaaactgaatctgcagacaggcaacagattcaagtatgaccccactccactgtttgggggaccagtatgaaaatcaagctgcacatctgctacatatgtacagggagaaaatgcctaatctttaaataactcttggtaatacctttgttgtaattaaatttaagttcaaaatctggttgcatttttacctattgctttttccaaatatatatatatatatacaactctcttctctctctctctctctctctctctctctctctctctctctgtgtgtgtgtgtgtgtgtgtgtgtgcatgttaactgataatactttgaacactgaacagaagaaaattcaactgaatattaagttttataggactatttctctggagaaaatagtgaagagggttaatgatagcaaaaatgagatattgaattagaatatagaacagtataattttgcaaagtaaaaagaacggtttgggagacaattttggagctgtctagaatcttgataacagaaataacattatatcggtgttgggttaattgtagacccagaagagaaggtatatgtatgaatatggcctgagttattatgaaaatcaatggtctcaacaaagtgctttgtacatattttattttataactgagtaggttacattgctcacaaaatactaaaatacgttcaatgtgaaaattgtgtttaaatatacacttttatagtatacacactgtgtgctttcaagtgacagacttaagaaagtggttacatattctgatctgaaagctagataaattcaacagccaatatcaaattaatcaggaacaggagtgccctctctccctgtatctattcaatatagtactcaaagttctagccagagcaataagacaacaaaaggagttcaagtggatacaaattggcaaagaaaagaccactatttgaagatgatacgatagtatacatgagtgaccccaaaattctaccagagaacttctacagctgatgaacaacttcagcaatttttagattcttaagtggtttgtagatgccagctaaaaccactgtagtactgcttcgtttgttaatatagagtaaatccaaaattctagcgtggtgacactcaagggtccaggagtccacgaagtaagacatttggagcaggtacacagcacagtgaccactgtggaataagaaaaatgaacagaatagcttcttaggaatcaagtgtgggatatttttcagaaaggactgacaagtagatctatgcaaaatgctactgaactttgatgaatatgaaaattgggacttggtttggacgtgattcagcaataaatagatgtttttccctttcatcctttggttttcactttgcacagttcttgctatttcatgcactttcctcgaggtactgttagtaccatacccatcaacttgtagtcagtccatgcttcagatgcaaggataaccaagatttcttagaaaattaagatttgctaatagttattatgaagttgagtttacatattattcagattaatcacttaaaattacatattaccactaagatctctttcactaaaactcagtttttatttgcttaatgctaatgttgactagtagtaatgaattgctttgtaaatgtgtttcttttattatctgatccaaatgaagcaatcatacacattaaaacacccacttttgaaactcacttgttgagctatcaggatattctccctgctaagacctccttgtccaagttagctaaagttcttatgttcatttcttcctcactgcttaaacattcaaatatgtgctgccttacccagtgttggctcacctcttactaacaatagattcttggtgatgtcaatacccagaccagtatttggtctcaatttctgcttgggtgatttccctatctgcagttgcctggctttcatctcactacaatttgcctgtattaaatatatgttcaaacttgagataaattactgtaattgttaggattaaaaagtatttgtttttttttttcaattatactaaaagaaacacagattctgttgtctagtgtaccactgctttacacactgtgtggttcttaaattttgattctatattccatcctctttgtatagtacttctttaaagaaaatatatttattttttctttttctttttctttctttccttcctttttttttagatacaggagaaaaattactcaaataaaattataagcagatgtgtatgtgaaactattaacatgtaatttgacaatactaattggatgatgtttaactcttaactgcccatttattttaggcattgtctgatttgatctatgatgtgattatgactaggacactctatcagaaagaaaaattgacctgcataagttcacaaatctaataaatgaaaaccaagtgaggactgcagatctgaatccaaaagcatgtttttcctgtcattagaaaagtgcattattccaaatggccagtggttaaaatagatgccttggctttcagcccagagctgtgttaaaatacagtggtgattcaataaatattgtcaccagtggtatctgtgttgttggtcatggcaggtcaagaaatgtgctggattgttctaatgtgtaaggtttaatttttttgtttttgttttttaggttggcaaacacgttgcctatttacttcatagagaccccaatggagaacaaggtgggtgatgattcatgctcaatggtttccacaatatgctgaacactacaatagcagctaacataaagtggctcattatatgctgtcaaatccaataacagcaatgacagacttccctcactacagcaatttgtgaggagtccagccactccaaaaagggactgaattaaaacaataataacaacaacaacaaaccctacaaaatagcagaaataacctatccactgagtcttattttctgattctgtgtaggtttccctttgaaacaggcttcatgctttctgattcaactaaagagataactcaccttgagattagcttctcttgtgaaacctcttcctttagaacattgtgcagaataaataatttgcataggttttggggttcataagcacaattgcttatgtggctctcctttgaggacagctctgatataccacccatcatatctcatcctctgaatagccaccatattctctctccctctccctctccctctctccctctccctcctcctctcttcctctccctctccctcctactctctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctctctctctctctctctcaaacacacacacacacacacacacacacacacacacacacacacacacacacacacatacaaacacactttttttttttttaaactttctggtaccacagcacccacaatggcaatctttcttatagagacctaaggtcaggaggcagcaggctggataaagactctttatgactatgcatccctttgtgtcaataaattgtaatctcgttgaggaggtctacttttatcaagtgtctataaatcatgttcatctcacattactgtgtagtgaccaattcagccaattattagtctgggaaaagtgtataattaaagaagcagatagtgtataatattcgtgctttctctatcccttagcaaaagcagtaacaccgagtagatttaaaaaaatgacacgtttgcttagtgaaagaaggaagaaatgaataaatccatcaatcagatggttctctgtggccaaattaaagaccagactgagaaattctgattacttgaaatcatttttttcctctggccacaaggcataatgccctgaaaatgtttgtttattttggaaggcaaaagctgatctgcagctattttctttatttttatattcaaatgcctataaaacagaaaaacactggagacctattcattgctcacaaatgatctatagggtaataatgtgctggcttttccagctgtgatgcactttggtgctatcttgggtttaattgaaaatatgctgtgaccttggttttgttcactgggcgaagggggatataattggcatgaagcctctgaagaactctcttttcaatgaatgtcatttggttaatttggggttcgcctgagggaaataatgtgtgaagtcctgtaaatacaaggtgctttttattcacatggcattaacatgaagttaacaacctttttttttttaaatcagcattttattttgcaaaaccgatttgttgattcctaaatgctatcagcatgataatagtattgtccttaacagtctcctgctccattataattaaataaacagctttcagattgcagtccaaaaatgtctgtgctccattcttaacttaaggagtttccatagaaaccatgggcagaaagtttaactgacatttattgggcttgaggctatagggagctttgatatctctattttcctctctatcgttctgtatgtgaatcttcttagctttattaaacccttgaaaacatcacttgctccaagtctgctcctccctctcctcttccctcaaccttcctcctcttctccctcctccttcttttcctcttctctgtctcttattaacattgaggaagtaatttggactcagttagatttaacaaatgcaataatactaaaatgcactctgatacttaagtgtaattgtgttattagctggaaatgcttttcttcaaaaataaaaagaattgagagtgaagttaaccaatgtaatgcatgctggcaggaaggaaacattggtggctggttgcaagtttgtgatgcatgtatcaagatcctctttcttctctggatgtgactattccttgatttattcaagcaagatggaatgttttctcttagtttcaactttcagaaggaagcagaacgatagtttgatcaaattaatccagaatagaaaatagaacaaaatagaatagttgttccgggggaaaaaaaaaaaaaaaagactatcaagatccatcgactttgtttaagctgtcacctaacacacttaacttaacagcaatgaagctggtgccacaagtttagatctcacccgactgattgtaacattgtagataggtacggaagtatgccatcttagcttcacaataacaatatgaaggtgaacaaatctgaaccatgaggttttactaagattaaaagtaataatcgtactatgtcttgggacaggtagcagcctgtcatctttaatactcaggaggctaagtaaagatagtctcaatttcaatatctatctgatctatagagtgagtttaggctgatccaatctataaagtgagttcaaggccagcctggaaaattcaatgaaaccttgtctcaaaataaaaactaaaatcaagtgtgaggggctgttaatatagcaaaatactagaccgtagggtctggattaaatatcaattgaggtatcaatgcaacagtaaattataatagcagtcttttgctgtggtttcataaagaagtagcaaaaggagtttgtgctttatgcaaagtttctatagctatttggaaacacagcacataatcagcacatatacattatagcagttcaagggaaagatttaatcagacataggatcaatcactaactacactactggggaaaaatgtcaaacttgcaattattgattcttcatctatatgtcagaatcatgagtcttacttcttggacctgttctgggataggcaactgtatatataatctgcttaacttctgtgaaaatgtgcactatgggctgtaacttctgtcagtctcactctctccatttttctgaggcttttccttctcaatattaattcaaagtataaaaaaaagcaaacaaaagcaatatccatgtttaacttagtgtatatacatatatatatgtatatatatgcatatatacatattagaataatctcattaaaggtttataaagattaaaataacatgaaagcaatggcagaagaaaaaagccctactgagtagggtacaaaatagagattcagggttgctaagaatatgatcctagtatcctgattgagatagctgactttatcctatttctaggagtccttttcaatgctagaagtctcaaattcattattcctaatttatgacatctcttctaagatgtaagggctaaattccaatggatgtgacttagagtttatctttctagtgaaggtgaagggaagatagtccactgggctggaggtgaagaaaggagaggacagatatgtgcatctatctcagagccatgatgagatgcttcttcatgctctcaaagaactggcaaatgaaaccatataatggaaaagtgttaattttgtatagcaatatgaatgaacactgtacgttggagaaaaatagtaagaaaaaaatgccttcaatatattctcctttttaaaagaacctaacaatttccctttcgctgataaaaggtgatggctaactgaaaggttagtaagaattgctgtgatgaaaacatgatgaagtatagctagaaccgagctctatgagacatgaattctgggaagagctgttgcttgtaaactaccatcaaggcatgtacccatgggaaaacacaagtacatagggttaaccaggacaaacatttttcttatcattttgtgggttattggtgctcctttctctgctgtgtgcctgcacctgcttcacaaagatactcctacatttctgttagaagaattgtctttagccacaatctccattttaagttaaatatctaatttaaaggcaaatagtagagtgcctaaaaccacccagacagacctacaaatatctgtgctgttcaatgcagtcctagcatacaaatcagacagcccctttgtcacaggacttcctttcattagggttcctcacatatataatgtgatccatggtacaattgagagtcatatgagtgtggtttaatttcttttaattcatagatgaaaattaactataaatagaagcatataattatcatccatgaattaaatgcaaccacttggctgtcttcatgttagttgagaagccaacatagttggagaaaacttcagaagggtctactgtaggtggaggctacaggcagttgggggaaaaagaagcagttgtctccagagacaaagtctcttgtgggttatctagtcccaagtagtcaagtgggcattcctaacctcatgagcctatagatgatactaattcaactaggtaggttttgtgtgtgtttgtttgtgtgtgtgtttgtttgtgtgtgtgtgtgtgtgtgtgtgtgtgtgtttaacaataatcatcatagaagaagtgataggagttgatggagaaaagagtaagagaggagaaacagaggagtagagggatgtaaatacagtttattcatgtatgaaattctcaaaattatgaaagctttaagaactatgaaagaaaaacagagaaaatacttatagaaatgactgtggaaatgttttaatagaagttcatatacaatcacaaattgtgggccagaattttacctatagacagaactggtttctaaaccctgacattcaaattttacatgcttctgcatgtctgttcacatggcagttgcagccttgagagtgagaatagggaattcagtatcaatagccacactcaccaacatttactttctttttgtggtgagttttacttatttttcattaacctttatctttctactatgcatgtgacagaaataaaacatatattgtttatagaatgtcagaggaagtctgagttacattatttttacccaagatctggaatatccataggcaactgtgccttctgctttctaaaatattttttttgttctttttctgttgcttaagtttatgcaatgtactgtgaccacattcccctactcggttatcttgattcccctcccacaacttgtgacccacttactcttcacaaccagttctacttctgcctctatcttttctctctcccttcttctctcatgtgcatgtgtgtgcatggggggggggcgggcttattttgcacatcctgtgcaattgctattatgtgtcattgctattatgtgtccataattgcccttatgatgccatatccaggagacagcattttatagtgagcctttccaccctcaggctctttttaaaatggaatcactttttttttttaaatgaactgtacagagaacaaagacagatggtgggagaaggaaccaagaaagatttttttttatctaatgtaacaaaggtagattaaatactgatgatgtaaagagcagcatcctctggccttcttcctccttgtcccttccatatgctgaggggtacttggttgtttaatacttttcatgcacttgtctaattatctcttttgtcattgttactacaaaatgttcattagaggcaaaatgaatacagaaacacaaaagtgctttaactttttaagatactaacaaggttagttacgtggttaagtgaaactcattcatattagaactgagtcctcagctcacaaggttccatggtaactggagagcaaacacaggactgtgcagtggggcaactcacttccaatatgcataacctaaagctaaagtgaaggctgggctgtcttaaaatcaataaataagaatccaattttcagatgtctgcatttgctgaatggttccctcttttgtggtcattaaggtgaaacaaagaaatcactgattctagtcatttccattatctgtcttgtcatcactgaggtttcctcattatgcactgttaacagggttgaggttacttgaaactagcttccagttccaattaggaggacatccctgctatctgcattctgattaaatgtgttgcctggaaatcacagaaagagtctattctatttcctccccttgcttagatctcataaacacagactcaattaaagagtttccttatcagacttctgtgggtcattttcctgaatttattaaactcctaagtcaagctaaactataagaattgtggcttacagattcagcaagggcctaaactagatttctggggcttgcccctcccatgttttagacaaaaacttacacagaactcagaacatataataacatgagctcatgagtcctggcaaaataaaaacataagtagatgctaaaaatcatgacactgttatcaggctaaattttaagatcatgcaagctatcccaggccatcattgttgcagaagttttcatggaggacactaatagtttcctgttcctaataagtactactgatgtctcgctctgccttacatattctctcttcagtttcctatcgacgtctgtcacaaagactaatcaagtctcttcagctcctgtatatagagaacacagaactgcatgtgcattttcaccacttgggattatttcattcctcctagtttgtattctactagacttcactacaaggtctcctgactcccattcatgtttaccttcatgcacttgccacctaactggtatttgttttcaaactacccattgtcatcccaattcttcaccctcctcacaactagtacagctgtaactctgtttaaatttttctagagtttaatgtaaatccttgggcagtcacttatcaattgttgaatgctgtaaaatccttaacagaagacaaatggttataagtgaaaataggtgagtacattgcctggctctcagtgggcactcagcaaacattagagagggcaatgtctgtctgtcactccctcagaacgctacatagttttctcattcaaatcaacatatgctactatgtttcaggtctgcatggccttgtgactggataaaccctgttgtttctctctgagctaataattatccactaaggacacactcactcattcagtatagcgcatggcattgctttatgactcaatcatttatgctaggctagttttagtattctgcttcaaatgatcaatgagggagacttacagaattgcaggaattccctctaggtgatgtgttggtaagcatacttagacatatattaacagtgctgaagggaactttaaacattctctttctcaatgctactataaaatgaatcctagatatgtctaatgatttttgctaggggttatatatatttatggttttggttactgtctaggaaattggagctgtgtactctttaataatgaacaaggaagtaggtactgagggaaatattggaaggtggtttttacaatgtgaatgactttgtacacatgctatttattctcttcagattgcttcacatagcaatttaaattgcattactcattacaaaaatccatatgccttttgggtgctattgttgctttgtttgttttcagcctatggaggcaatgatgaccttggcacaaggcatttcctaaggattaatgagcagttgggggttaatgactatcaattcctcccagctagtcatcaatccaaaggaagcaaaggcagcaaggccattaactgcattaccaactttctgaaatcagattcttctttgtctgccttgctaaggactttcattttggatgaacttgttagtttgttcaaaatttttcacttacctggacagggacagaaaaaatgttacccattatttgttttatctatctatctatctatctatctatctatctatctatctatctatctatctatctatctatctatctatgtatctacacacacatatatataacaaatatatatatatatatgagagatacgttcatgaaaacaaatcactttttagttaatatgtatgtcatatataaatatacatatagatatgcagatatctgcatttatatcaaattattggtaataaaagaaaatatacacatattgagttcctttgggctactttgattaccacaatctgacaagcttggatttgtttttatcttttcatccttatttactattcccaattcaaagtctgaagggattcatcccatttcatattaaggcaagctaaaatatgtgccaatcttctgaaatatctttcctcaatatacaatatgaaggctggtttgatagtatgcttgatggcctgtttggagtttttagtatagtttttttttatgaactatcatttttcattgattcttatcacatcattgttcttcattgatgttaataacacgaatatgtctccatttgacaccagtcaggtgatgaccaacagcctgaaagataagtcaacagtaatgtaattttgagtggcaatatccttttagtaataaactaaactcctgtgaaaatgaatctgaaatagacacagtcatagtcctcacctgttgaagattctctggtattttattttctcttcctgcatctaggctcttccattgtctgttttgtctattgtttatgtgagacagaacaaaaaaactgactgtagttttggtgtttaagatatatggcaaatacgtgacaccatggcaacctacatccaaagaatttttctgtagacatttttcctgaacacttgctgaggaactgaatttaattctttcatcttagtaacagaagttgatgtcttatcccaagacaacagtaaacacacttacaaaaacacataacgaattgacacacagagagataccagtccaatatattatttctaaatttgaaacagatctacaagtactacagtaatagatctatgtgcatagaatgtaatcatttttgaactgtaggattctatgattagacaatgataaaacacttgatacaatgaaaacaaaaacaaatatcaaatatttaaatacccttctaatttttctctttattatctcttctgtcaccataatagcacagaatataaaacaagacacacaaacttacactagtttcacagaaaaacattgcacagacatatttctgagttttaatttgtttttcatttggattggttgtttaagtaactgaaaactgattacaaacaacatttttaaggccacctctttcttttaaatcatatatatatatatatatatatatacatatatatgtatatatagtgtgttcataaatatatatacacacacacatatgtatatacatacataggaaatagatcatctgcactactttcaataacttatttaaatgcttattatctaattcatttttttacattcttaattcatttatgttttatattttgggggggagttataagaaatagtcatccagtccattcttcactatttttactgataacagaaataacttaagtcatattggctctcctgaattttaataatagcctttagttatcaattattgcaaaattggtttatctacatggctccttactaaaatttaaatacgttatataatcaataattcaatataacaactatttactaaatagttagatggaatccagttttactctttaagaaacttttgagtaaataaataaggtagccacctagacaaacattgacattcatgaataaatttgctaagtttaatcttggctttactgaccactaggggaagaatggattagtaaaaatcttaagagaatagaattagttatggtaaataggttctggttggacataatttaatgaaataatctgagtgaggaattcaaagccaaaagaagaaaaaaaatatctgaaggggaaatgtaggatgatctgattagaatgtaaaacagaatgccattgttactgtagtaagactctcagtaaacaagtcttggacaatcatatgctatagcaccttggagtgaatacttctcatgccatgttaaggcactgtttatctggagataatttggtcctacagggggctgtctggaaatattggaagacattttatttttcacttctgggattgctgctggcatctagtgggtgcatgcagtaaaggaccgaggaatttattgtcagatacactttgttgcctagtttctcatctgatactaacttcagttactttaagcaaaaacattactgtgaacaattactatgggaaaatatgaaaacaaaataacagctttgaggtaaggaaaaacatgagctaatcatttggtgtcctgtgaacttgaagaaaaggagaagaagagaaagagcagggtctttgggccccagatattatagtatatgcacaaaggatgctacttgaagtataccatgcacatttctaagagctagaatgttctgattgcataatcagaagaatcacacacagagcaatttggagtctgagactcagtggtcctcctcttcactctggctaagcatttagctaaacaaatagttgttataaaaacacaaacatggtactgaacaactctaatcccaccaaataatttgaaaaacaactctgtcatctatattttatattttcataaataatcaatctcaaaaaatggatatgattctaagggattcacattcagacagaaggctcatactagctatctttattttctttgcatcataagaaggcaagtaaacaaggaagccaaaactaaattaattttatgtttagttttgccaagaggttactgattgtgggtgtgtattttttgatttaggagaagttgactttttcttgctaatatgaagttggagctgtgactgcctccttagcctgctcatctattataatgtgctgctttggactgtgacagtagctcaaggaaaccattttttttcatggattttaagaaaaatgttcctaatgggtctgtggagcacattttgcaatgataaagaggccatggcctttaaagggcactcgcctttactgactttatgatttcttatcctctcctttaaaaaaatgggggtgggaggaaaaggatagagaaaaataccaatagctggaaccggagcggtgaaggttacttaccagttctgagggttaggagccatgaagcaaaacatggaaaggatctgcttcctataagtagaaccttttcagacagccatgttattttaggcacaaacagcagatggcattgtttggtcaaacatcaaacagggctgctaggataataaatgaaaagggaaaatgaggaaaatcttctctactttctccatccaaaaagcactcaagaaagatcaagaagagagtgaaatgatctgcaatttgctgtgtagttccagctctttagcaaaagtaactacaaaccagaaatataactcggaaatggatgaaattcttgctataggaatgggactctactagatgctaaggatccattaataagttccaggctcccagaaacagttggtttacagtctcaaccatctacacgctgcctttgtcaatttacccattttctcatggatgcatgctttaacaaatacttgaacagtataattttagggaattgctactaagttatgtgattatcagcactctgataatcttgcatcaaggcttaataggaaataaaagaaacacttgtgtttagaaaaataatatacatttatttatatatatatatatacatatatatatacagtattcaatctcatatatacatatatacacatatatatgaaattgaagtatttcaatattttacagtggaataaccaggtatagtaatttacaatgacattctgaataggtaaatgtaaaaataaaattcttgatgtcactttcaatgatcaaataaaaggtgatatatttctctctctctctctctctctctctctctctctctcttatgggtatttgcactatagggaagcatactgtaaaggacagaggtataccaagttgaaatatttggaaagtaaagaagggtccatgaaattgaaggaataaattacagtaaaactaaaacataacaaaatgaattagaaacatattcagtttgcattgttttacaagaatatggaggcaaaataagaatttcaatggaaagacaacacaaacatgtttatatatttaaaatgcactaaatatatttcatgaagaattagatatgacaggccaactgtgaaaagggagataagatattttagagggtgtccaagttagaaatgaaatgtcatggataagaagggaaatgctaggctatgtttaggagtactgctaaagaaaagagtgctgggcatgatgagaatacagaaaaaataaataaatcatcgaaaactacaatgttgccttgagctacttggtatatgttactagccttgacagtgggacagaggcagttttctgtatatgctatgctatttaattcatgcagtctttacagtgtatgcttatcagatcttatcacacctacttgggaaaatgtaactcatgacagacttttaataaagtttgaatgaataataatggtaaactaaccctgcaacagaagtcattttagtccaaatcctgcttttattccactaagtactactgtaagaaactagaaattctcccccatgtactttaatatgtttctaggttgtaacaaaactgaagctgaatgcatgcctacttcttccacacaattcaccatatagatttgagtagcagcgatgattcgtgtgtgacttcaggatgaaattttttactctagctcggtcctccatctgtgcaatttatatttcatgttcttggagatgttaactaggctgggtcaatttcaaactttgtaactctgtcgtaggcaattcaactgaagatcagcaccatgcaattttaaagtgatgtgtggtgtgtagattattgaagtcactttcccgccataaactggactttccccttcaatttctgttctccacaaaggcagaaataatgtcttcacaatatcccttcatgcttaaaggtctcaatttttttgtcttaaatatatttattgaagccaatctaaacagttatgttagatgtgcagcaagtcccaatggatcaagttatacatccaaatttaactcctctgcatcaggagtccttgactttgactgtaagcttaatttttattcttccttttatgactaatatcaatttacctcctagaccactaaatttcctcagtataaatctgtttctatacttaattatacttgaaatattttctgaaaattatacaataggttatgcctacatcaatttttaactatgactcagaacatttaaatattttctacatcaaattgcaatgcacagatgcaaatatacacactttcatgttctgagtgtgaatttatattatccacattgcacccataacaacattcaaaaattcagaagactttcttgatttagaaattttgtttgcttttttttttttttttaataatccttggtttattttccagagcatagcattatgttggttgttaccacctgggttgtcttctttttttctttttctttttctttttctttttctttttctttttctttttcattttctttttctttttctttttctttttctatttttctttttctttttctctttctcttttccttttcctttttctttctttttctctttttcttttcctttttcatcttcatcttctttttgtctttgtcttcttcttcttcttcttcttcttcttcttcttcttcttcttcttcttcttcttcttctttttcttcttcttctcttctttctctttctccttctcctcctcctccatcacctcctcctcctccttcttcagctttttctttttcctttaataaaccattgtctctatattcagtttttactcatttaatcatattctaatgtcacatataatcactagtcatatattacaagggtgtaagtcaaggtttcttaaaatgcaaatgtggaggcagattctttctcataaaacgcactttctaatacctaaatgtcattttagaaacatttttgaagacactatgcttgaagaacaactgtctgttgacttgacaggtcaagtctgagagttgcagccatttaaaatctgtactgttctcattatcattacctagagctggtcttgagtatatttatctataaaatgttccttgaaattctgcatgcatatgtactcctgcacaaagctcaacattcttggaaggctgcatttaaaaatggggtgtaggcagtattagaaaatactgttaaaacaaatttgatttaaaaaggtcagctcccattggtaatagtgtgatttaatttgagtctttttctcttatagtatttttaaatataaaaagatgctgataaatgatttttcagcagaaaattttattgttgtgacaggaataaactttagtaattttcttgcaaacaaatcagggtaattgtgattaatttgatgagaagaattcaaccagtaaaatgtcataagaatttcaaattttcaactacttttatcttttctttattaacttgatgagatgatttcagaagacaaaaaaaaaaaaaagaagagaaagagagagacacagagagagacacaaagagagacagaaagaatggatagatgttaggtgatagagagatgataaaaggtcaatagatcaatagatagatagacagatagatagacagatagacaatagagatggatatgatatatcaaaatatgtttagttgcttataacctaaaaaacaaaacaagcaaaccaacaaaagaccccacacattcagggatcagtggattgatatcattaaaaatgtgcacaggaagaaccattactatatcatttagttcattagttcctcacaaacttaaagaatttattttcacttcctcattttttatttatttattttgctatatcagcttcagtgttaggttttttttttttctttttgaacagaatttcagcagcactatatatcttattcgctcagactataccagaaacagaatatagaattagtcatccatttagatatctaaccacatccccattttgttatttgtgaggggaaaaagattctgtaatctacctaactgccaattccttgtatttaaccagctaacttttgtcccatgccaagcaattgactaatttttaacaacaaaagtcattctgcctctgtttacttaggtaagaagctagtggtatatgggctacaagttggctgtcaaatgtattctgtgggctatacttttcaatcattaagtgtttggcctgaagaaaggggacaatattttgaaagatgtgacaattacactaaaatcaaatgactgtgcccataaacaatctttttaaaaaggcttataatccattccaggtactagggtgtctagtagggtcattgtacacatatttcatagcaaatatatttaacttattttttaaatgtgggtgtgtaggaatcatctacagaagaaggtttccatgagtgtttcaggaggctatattgtgagttacccattaacatgcttcactctgccctactattcctaccttaattcatcactcttattctatttttcttctttctctagtacatccttccattatgtctctactcccttgagagtacccatctatagcatcttaatacttgcctgatacagttaggaattccaaattaaatataaatacctaaagatacaaagctagcatccaaatatgaaagaaacatgcagtatttttccttctggatcatgttaccacatataagataactgttttcagatcaatgcatttaacaatgaatttcataattttacttgtttcattcatattcactgcttgaatgaacatgtagctaggtaagaatatttagatgattttgggtatttgggtgagtgtggtttaactatttcatgtggaatatctatttctatctattttataatcctacatactaattttcatagtagttttaccaatttgaatttccataagcaatgaatgagcatctccttttctccatagccatgccagtatctactaattccgaaaatttctgtctattccattctgaatgggtaagatgaagtctcaaaaggcttgctgcagactggactccatcagtccctcaaccagcaggagaatcagggttctggtactcaggtggataaggagtcagtgggatgacaaacaggcacagacaccagagagagtgctgtatctgaatgtaatttctcaaagcaaacatcagaattatagtacagaagaaaaacaaggaagttaggtgatacatcagtcaaggtacatcgagatgcataatggctctttacacaaaacagagaaaatgcatacataaaagataacaggaaccaggcagtgtttataactgagataaggatcagccctatctaaagtcagctattcacaggagccagatgaaaaggctaattcacccaggtgcaattctagtctgtttttaaacccaccaccaggggtcccttagaaaatacctaattatgctattctactaaacatagacaaagcaacccagtaaggaaagtggtcccaaatgcaggcaacaaactcaaagacagcttctgctcccatttttaggagctatacaaatgtattttgttccaatttctaattggattctttttttctttgttcagttttctgcgtaacttgtatattttttaaattaatttatttttattttacgtgcatttgtgttttacctgcacatatgcccctgtgaaggtgtgaaatcttggagttacagagagttctaagctgcattgtggattttagaaatagaacccaggtccttaggaagaacagtcagtgctcttaagtgcaaagtcatctctctaatgccatcttgtatattctgaagacaaatatcattttagaagtataagttgtaaatattcttctcatgaggtaggctatttcttcactctctcaaatgatgataagctttgctctaaaggaatattttaatttcttgtggtcccatatagtattcagagactccaatggagcataatttaaagaatgcatatatatatatatacattttagactgacttacaggccaacatccatctagtgcaacaatggctttctaccaacagaaagtacaataatccaagaattattcagtccatgagcctggatgtctaagctgctctttggtatgtattagaatactgaagaagatgatttcaatgccaatgaaggaataaacttacccgtaagaagtaaggttagtaggcaaataattatttgttcaatttcttctctttaggctgtcagtagaaggtgtagcctagattaagtatgtattttcccttatcaaaagacacagattagtgatggatcttcccacttcaaataatttaatcaagaaaaatccctcataggtgaatcctaccatttggcttgggtattagttagttccagatgtcaaactgacaaggaagtatagccatgccatctggcaactactggtcttaattattgaactatcaagtttcaattcataaaattcaattataatccctaatttttcctctattagtctcaaggcatagggcttatgttgaggtccttgatccatctggagttcagttttgtgtaggttgagagaaccttcttttagtagacaacaattaacaacctatcacatttgaatgttcagagaataagagactatgaaatgatcagccctaaacaagacatcttcatctaaactacctttttccgatgttcagagatcatcctgaaagaggacaagaaaggtagtaagattgagaaattttaaaaacatggtttcccttgtttaagtttatatttaccatgaaacagtgtttcgctgacacaatagagcagttacaaagatgaactcacagtagttgtaacagcgtggaaaaggccggtataagctcatatcagacaaaatttcagcatggatggaagagatatatgcaagtcttagtcctagctgaggagttatgagcagttgacaactgttgtgataaagaatgttagttttctttaaaagttttccttctgtttgattgactctgctttatggagttgccatatgccagaatatttgggaagcagaatttggataagatgaataaaaaaaaataaattcccaaatttgggtggtatattagtcaggactttctagagaaatagaacttgcagaatgatgagagagtgtgtgtgtgtgtgagaggggggggggagggagagggatggagggtcttagactagtccagctagtctataatggctgtagtcaatgataggtccaagcatccagtagttgttccattcttgaggctgaatatctcagctgttcttcattgtaagacataatacaaaaaatgtaggcacaaatttcagtgaaggaatggacttggtagggagagaaagatctagtatgctaagaaagagagcagcagaagattaaacgtggatcttctcatctcgtaaatatgtattagaagtgtatcttcctgattcaaatgatttaattaaggaaaaaaatccttaacctttgtgcccagccatttgggttttagtaaataacagaaattgttgaagtagcaataatagccatcacaggtaggagtgaaatttagtggaggtagaaaagagggaggtaacacgataaaaatacaagtatgaaattctcaatcaataaaaacataatttaaatcacacaaagaaagttaaatggagatgtcttattgatatacagtctctttctttttcctttcctgtttgtatctctctctctctctctgtgtgtttgtgtgtgtctgtgtgtgtgcttgtgtgtctgtattttgtgtttgtgtgtgtgtgagagtgagagagaaagagagagagagagaaagagagagatagaaagagagagagagagagagagagagagagagagagagagagagagagagagcgatgcagagatgaagaggatgaatttgagattcttattatcaagattcagattgggctaggaggagttctgttgctctttgagaacaacagattctcttattgagaatccttaaagatatatgtgcatagtgggatatttttaattaacctaatacatctatctatgtcctctttttaaattccttctaatgtctatgttcatcctgtatcaataatagaagactgagttttaaggtattttcctcttagccatgattattcatacactagtttattttttttaggatattttcattatttacatttcaaatgttatctcctttcccagttctcccccagaaacttcctatcccattccctcttcctctgcttctatgagggttttctctcacctacccacccactcctgcctccctgccctcacattcctctacactggggcatcatcaagctttcacaggaccaagggcctcttctcacattgatgcccaacatggccgttctctgctacatttgtggctggagccatgtgtccctccatgaccactctttgattggtggtttagtccctgtgagtcttggggggaaggggtctggttggttgttattgttgttcctcctatgggattgcaaacctcttcagctctatcaggcctttttataacttctccacttcagaccccatgctcagtccaatggttggttataagcattcacctctgtatttgtcaggcattggcaaaggctctcagcagacagctatatcaggttcctgtcagcaagcacttcctggtatcagcaatagtgtctgggtttggtgactgtatatggagtggatctccaggtagtccaaactttgaatgtccttttattaatgcatgggatgcctaaggagagaagacaggcgtattgacaaaatcaagatatccttcaggacatagctaaaagtatcatagttttattcaaaaccccacacaagtccatttgtaagtaaatgctgtgaaatggcatagctttaaattgatttactttgatgtgataaaatcatcttataaaagagatggtaaatctgggcttttgatgtaaaataacataatttagattttaaagtagcaaatcttttattgatagtaatttatttgattcaatacaaggtaccaactattatttgctataggttataaattagattgaacaaagaataattcatgaatcatttcttatgactgattcatcagaaacctcattaattgcaataatataataaccttgaaggaaaccagaactagaaactaccactcagccatggtatagagggacaagagaattatgtaatctacacttaacatcagtattcctgaccatactggctaattcttatagtaacactgaccaggagatggttaaacatcaattaaacaatagcaaaatcatgttgttttcttgaaaataaatggatctgatgaacactgcattaagtaaaaaagctagataattatcacatggtatctttaatattttaaatctaaattttgaataaaagagcatgaacataagaaagatgcattaacggaataaaacattttctttagcacttaatttttaagatgtgttacaggtgtgctctatattatttagtataggcactaacttgtaggatgtgacagtcttaggactttggagtgaatagcagtgttacctttcacagaaggtacaaatataaaggtgaaataaggttcccagttttaatggcactgagattcacaaatgtctatgaaatacattcaatattaagaattctctattataagatctactgtagagaacatggggcattatccaagcattagtgctacacacctttaatcccagcactctggagacaaagatcaacagatatttgtgaatacaaggcttggtttacaaagggaattcctagacagccataactacatataaagaccttatcttaaaacaaacaaatgaaacataagaggaaattatggcaaataacagaataaggactttctctaggacttattaacaaactatactgatacagtccctaggattttaaggtatcatggtatgtgagctggaaaaactgaaagaggaacatgccctgagatgccaaccttataaaaagcatgagttggtttatgaatagatgattttacattaaagcttttgatgttcaataatcttaaagaagtgtatattgtcaaaaaaggaagtcatatgtaaaactgttctaaaccacacatattagaagtttacaatgtcaacatcattgaaaattacagtactaaaaatattaacagaatttaaaatacacatttgtaaaggttgtttgaagatttcatatttcttcttttcatcatattaactgtctatttccaaactcttcccaggtctatatcctccttccattctcaactaacttgtgacctctccatcaaggccaatggtgtttactaaatattctaggatgaatgaccttccattaccctgtagtagaattgccaggagctataattgtagagaaaactcactgttcctctccagaagctaacaattgtaaatagttcctgatatagcagggaaacttcatgctcaactcctctctccatgatgggatttggtctggtttgggtttgcacagatcttgtgcattctgtcacagtcaatttccatccatatatgtgatatatgtgtgtgtgtgtgtgtgtgtgtgtgtgtgtgtgtgtgtgtatatatatatatatatatatatatatatatatatatatatatatatgtgtgtgtgtgtgtgtgtgtgtgtgtgtgtgtgtgcactcatacactatctctgcacttacagttttactcccaatgcttgttctacaacgatccctgattccttggaagtgaggtggagtatatatgttccaattttcgactggaaattctgcagtctctgattctcgacaccttgtcctgttgtggatctctgtatcatctactgcaagcatagcttctctgatgaggattgagagatgccttaatctatagatatagtgataagtctttcgtagttggtttgatgttatgtcattttaaccgaataaatggatcagtttttgtttctagggtatatgatctgtctagcatatgtgcttgtgaataatagtgcaaggaattatgggggatggacttaaaactaaacagagagtgattagttatccccatgacattcataccactaacacagaaactgggcacacttttttgaagtttttgaaggttttgtttaaatttacagaaagagataacttacagattgacccagtatatttcttcattcatctctgacaaaatacaccacagcaattttgagagcaacaatttatttttggtacatacaacattaggaatgatcttgtctgtagtgtcgaaagcctcaggatggtgtcttaaatctgtgtggctgatgcatgctccatttactatagcagtgctctacctccaaaggtcccaaaacctcctcaaacagtgaaatcagctgacatgtaacacttgaaagcaaagtcttgtcttcatatagctggggcaatgagagccacccaatctactccccagatttactaaagagtcaggccccgttttaaagggaaagttcttctggagctgttcttggatgtggaggataactggtcaagagaggtctgcaaataaaatgaatttttagtcatgttttctaaaggagaagtcagagttattgtcataatagctagagtccatcaggtcatacatcgggtgagacaataatggatgtgtgtttcagaagtggataattttagtcctttgtgcagactatagtaaaggacttacccataatacttgttactaggtcttcaggtgagcaaggcaaaagggtaatagtggtaaaggtcatgttttcatccagaaatttcaaggtcttggaagcagtagtctctctatgatcagcaaagatctcaaacaccaaactatcaagacaggtacaataattatattagaaagcgccaccttatatatgaaaatatcactagttagatagtgcatattctccacacttgtaacagcattgtcagttatgtttgcaatagacacatgagaggctgtcacatggggcctctctcttctcttagagaatatatatatatatatatatatatatatatatatatatatatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcttttagtctcctgcaacaggggaaagatgctgtgacctagatgtactggctctttacatgcacctcttgtcttagctcatattgatctgttttccaaatacctctttctttcatcaatcagttactacagaacctggaatatggaacattttttaaatgctcccctcatccatcaatttttcatcagtgtaactactctgtgattagggcctggtgtcaatatttttttctcataataattaacatgggttattttacacatctattcccctgatatctcaccatttgaacatatatctccacagggatgtgggtttcattcttcatcttttaatgtccagtacaaatcaagttgtctggctgagacacaacagaaatacaaacaatgataataataacaatatctattatttactcagttttcacaatgtggaatgtagtattttaatttcttaatcttcattaacgaggttgcctaaaaactccttaagaaagtgaaaaaaggacattgaactacagaaagcacatgtaacttccccaatgttgtacttaatataggctaagattgtctacttttaattggaatgcagagaaattcttaccccttcccttctttctttctaaaaggttaatagaaacaagaggttaagaagagaatttgggatgtattacatacaggcatgattcatgatcagccagttcaattagtaaaatattcttagaagttgctgtttggaaataatttaggaaataaattattttaattccccaaatgtataagaatccatagtaataaggacacaaggtaacaatactgttacattatccccccccccccgtaatcaaactttacatttatcaaagaatcttaacaggtgacccctccaccaatcagcaggctacattataatgacttacatatgtgaatctctatgcaagctcatgctcataatacaaccccctgttggtccactctcacagaaagcatgaattaagttgctttttgctcacatcagaggctactctcatgggaagatattttaaacacattgtgaaacatattatgtgctgatccttgttcttcaccagcttgttcataagaatctgatagctccaagttctgtttgtacactttaaccatacgacttcttgcatgtttttttttcttttctcctatgactcttattcttcaaaggggtgaaaacagtgcccatgtcagaggagagattcaaatattggaaaagttacttgacagtggcaggataatacaccatgtgcagttgcatacttgataacaagtttaccatttctcttcatggttaatggctagacgtaaccaacttaaaattcttaataatattcaacaaggcatcagtcaattttcccactagattccagaaattaattaccttttcctgaatatcattgcttatctattctgtagtgcatggtatctgctatatcagatggatttcatggatgtgtcctttcttaataattttgcataggaggttttggttggtgaggtgtagtccctcagtactattttctgtatatttctcatctgagatggatgctaaagcaaaaatgaagtccatcacatacaccttggagcatttggtgactacaaagttggcagttggtaagcaccacaccaggggactcttccatttctctaggactaaacatctgattgtagcaaatagtgaatgactgctactttggactactgacatctttctctctaaatattggcaatgtattggcaacccacagacagctattaaatttgtttaccatgaaggctatcatatgttttgactgttaattttaccaacaatggccttagctcatacataggtaaccaacaatactctaggaagaagtttaaagaagtaatgactattttttgtttctatttttttcagactgtttgaactccagaaggaccaacaccagataaattatgaatgttgaacaagatgaccttacatccacagcagataatgataggtcctaggtttaacagggccctatttgaccccctgcttgtggtgctgttggctcttcaacttcttgtggtggctggtttggttcgtgctcaaacctgcccttcagtgtgctcttgtagcaaccagttcagcaaggtgatttgtgttcggaaaaaccttcgtgaagttccggatggcatctccaccaacacaaggctgctgaacctccatgagaaccaaatccagatcattaaagtgaacagcttcaagcatttgaggcacttagaaatcctccagttgagcaggaaccatattcgaaccattgaaatcggggccttcaatggtctggccaacctcaacaccctggaactctttgacaatcgtcttactaccataccgaatggagcttttgtatatttgtctaaactgaaggagctctggttgaggaacaaccctattgaaagcatcccttcctatgcttttaacagaatcccttctttgcgccgcctggacttaggggaattgaaaaggctttcatacatctcagaaggtgcctttgaaggtctgtccaacttgaggtatttgaaccttgccatgtgcaaccttcgggaaatccctaacctcacaccactcatcaaacttgacgagctagatctttctgggaaccatttgtctgcaatcaggcctggctcttttcaggggttgatgcaccttcaaaaactgtggatgatacagtctcagattcaagtgattgaacggaatgcctttgataaccttcagtcactagtggagataaacttggcacacaacaatctaacattattgcctcatgacctcttcacacccttgcatcatctagagaggatacacctccatcacaacccgtggaactgtaactgtgatatcctgtggctcagctggtggataagagacatggccccctccaacacagcttgctgtgccaggtgtaacactccccccaacctgaaagggaggtacatcggagagctggaccagaattactttacatgctatgctcccgtaattgtggagccccctgcagacctcaatgtcactgaaggcatggcagctgagctgaaatgtcgggcttctacgtccctgacttccgtatcttggattactccaaatggaacagtcatgacccacggggcatacaaagtgcggatagctgtgctcagcgacggtactttaaatttcacaaatgtaactgtgcaagacacaggcatgtacacatgtatggtgagtaattctgttggcaacaccactgcttctgccaccttgaatgttactgcggcaaccactactccgttctcgtacttttcaactgtaacagtagagactatggaaccttctcaggatgaggcacggaccacagataacaatgtgggccccactccagtgatcgattgggagaccaccaatgtaaccacatctcttacgccacagagcacaaggtcgacagaaaaaacattcaccatcccagtaactgacatcaacagcggaatcccaggaattgatgaggtcatgaaaacaactaaaatcattattgggtgttttgtggccatcacactcatggctgccgtgatgctggtcattttctacaagatgaggaaacagcaccatcggcaaaaccaccatgctccaacaagggactgttgaaatcattaacgtggatgatgagatcactggggacacgcccatggaaagccacctgcccatgcctgcgattgagcatgagcacctaaaccactataactcttacaaatctcccttcaaccacacaacaacagtaaacacaataaattcaatacacagttcagtgcatgaaccgttattgatccgaatgaactctaaagacaatgtacaagagactcagatataaaacatttacagttacagaaaacaaacaatcaaaaaacaaaagacagtttattaaaaaaaaatgacacaaatgactgggctaaatctactgtttcaaaaaagtgtctttacaaaaaaaaaacaaaaagaaaagaaatttatttattaaaaattctattgtgatctaaagcagacaaaattatgtgtattcctcagaacctgtttttgctgcacttactattttcccacacctcctccctcccctccccaattgccatatttttcatagatctcaactcccccaaagaactggtctaggaaattttgtaagaattctgttacactttgagatttttatggtgaattctagtggtgagatccagtctattttgtctctttctctctctctctctctctctctctttttttcatttttttctttttccttcatgcccttatgaaatagtcaaatggggaatgcaatattagaaatagatttttaagaaagaacgaggtaaaaatgcaagatcttatatttttcatgtaatgacctgttctgtatttatgaggaggacattctgtggagaaagacaaaaagtaagcaaacaacagattaatttacatatgagcatctataaaacccatgacttttaaaaagcaaacctctagaaccagaatttgtagttcaaaagcttaaaataagattataaataaaatattgttggtttttctgtacc

SEQ ID NO: 78 - DNA, 3474 bp, Mus musculus
aacccccggaggaggtggcttttgggtgccttgctaaaatgaaggatacgggacgcagctctctcttggagcagaacgcagaggataaggtgatggtgccagagagaagaaagaatgaagctttttcttgtgagacctggatcgtaacataaatgtgtatatggccacacggagagcattggggggaaaaatgaaataagctgatgtcagacctgcggggtttggtgtattctgacataaataatcataaaatagctgtccccctcccccaaggatgtttggaaatgaagaactgaggatccacaaagaaaaagtgtgctcatttttctctgtaaaagagaaagtacgccaaggagatatttttggaatgaaaagtttggggctttttttagaaaagtaaagacctgatatatatatatatatatatatatatatatatatatttcttttggaatttcccacaagaggagaggaaattaataatacatctgcaaagaaatcccactgaagaaaagttgaccgtggaagaaggaagcattgattgggaaagaaatcagcagaggacccttggatcagtgcccgtgttgactaaaattgaaggataattgcagttggattttttttcttcaccaacctccttttttgtgtgttttctttctcgttttcttttggtgtcaagaccgtgcattctttcttgttcttaaccacctggatttccctcgggatgtagctgtgctgaaatacagttggcaaacacgttgcctatttacttcatagagaccccaatggagaacaagactgtttgaactccagaaggaccaacaccagataaattatgaatgttgaacaagatgaccttacatccacagcagataatgataggtcctaggtttaacagggccctatttgaccccctgcttgtggtgctgttggctcttcaacttcttgtggtggctggtttggttcgtgctcaaacctgcccttcagtgtgctcttgtagcaaccagttcagcaaggtgatttgtgttcggaaaaaccttcgtgaagttccggatggcatctccaccaacacaaggctgctgaacctccatgagaaccaaatccagatcattaaagtgaacagcttcaagcatttgaggcacttagaaatcctccagttgagcaggaaccatattcgaaccattgaaatcggggccttcaatggtctggccaacctcaacaccctggaactctttgacaatcgtcttactaccataccgaatggagcttttgtatatttgtctaaactgaaggagctctggttgaggaacaaccctattgaaagcatcccttcctatgcttttaacagaatcccttctttgcgccgcctggacttaggggaattgaaaaggctttcatacatctcagaaggtgcctttgaaggtctgtccaacttgaggtatttgaaccttgccatgtgcaaccttcgggaaatccctaacctcacaccactcatcaaacttgacgagctagatctttctgggaaccatttgtctgcaatcaggcctggctcttttcaggggttgatgcaccttcaaaaactgtggatgatacagtctcagattcaagtgattgaacggaatgcctttgataaccttcagtcactagtggagataaacttggcacacaacaatctaacattattgcctcatgacctcttcacacccttgcatcatctagagaggatacacctccatcacaacccgtggaactgtaactgtgatatcctgtggctcagctggtggataagagacatggccccctccaacacagcttgctgtgccaggtgtaacactccccccaacctgaaagggaggtacatcggagagctggaccagaattactttacatgctatgctcccgtaattgtggagccccctgcagacctcaatgtcactgaaggcatggcagctgagctgaaatgtcgggcttctacgtccctgacttccgtatcttggattactccaaatggaacagtcatgacccacggggcatacaaagtgcggatagctgtgctcagcgacggtactttaaatttcacaaatgtaactgtgcaagacacaggcatgtacacatgtatggtgagtaattctgttggcaacaccactgcttctgccaccttgaatgttactgcggcaaccactactccgttctcgtacttttcaactgtaacagtagagactatggaaccttctcaggatgaggcacggaccacagataacaatgtgggccccactccagtgatcgattgggagaccaccaatgtaaccacatctcttacgccacagagcacaaggtcgacagaaaaaacattcaccatcccagtaactgacatcaacagcggaatcccaggaattgatgaggtcatgaaaacaactaaaatcattattgggtgttttgtggccatcacactcatggctgccgtgatgctggtcattttctacaagatgaggaaacagcaccatcggcaaaaccaccatgctccaacaagggactgttgaaatcattaacgtggatgatgagatcactggggacacgcccatggaaagccacctgcccatgcctgcgattgagcatgagcacctaaaccactataactcttacaaatctcccttcaaccacacaacaacagtaaacacaataaattcaatacacagttcagtgcatgaaccgttattgatccgaatgaactctaaagacaatgtacaagagactcagatataaaacatttacagttacagaaaacaaacaatcaaaaaacaaaagacagtttattaaaaaaaaatgacacaaatgactgggctaaatctactgtttcaaaaaagtgtctttacaaaaaaaaaacaaaaagaaaagaaatttatttattaaaaattctattgtgatctaaagcagacaaaattatgtgtattcctcagaacctgtttttgctgcacttactattttcccacacctcctccctcccctccccaattgccatatttttcatagatctcaactcccccaaagaactggtctaggaaattttgtaagaattctgttacactttgagatttttatggtgaattctagtggtgagatccagtctattttgtctctttctctctctctctctctctctctctttttttcatttttttctttttccttcatgcccttatgaaatagtcaaatggggaatgcaatattagaaatagatttttaagaaagaacgaggtaaaaatgcaagatcttatatttttcatgtaatgacctgttctgtatttatgaggaggacattctgtggagaaagacaaaaagtaagcaaacaacagattaatttacatatgagcatctataaaacccatgacttttaaaaagcaaacctctagaaccagaatttgtagttcaaaagcttaaaataagattataaataaaatattgttggtttttctg

SEQ ID NO: 79 - protein, 566 aa, Mus musculus
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIRDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVIDWETTNVTTSLTPQSTRSTEKTFTIPVTDINSGIPGIDEVMKTTKIIIGCFVAITLMAAVMLVIFYKMRKQHHRQNHHAPTRDC

SEQ ID NO: 80 - DNA, 4115 bp, Mus musculus
cagacacctctgctgattgactcactcctggcttgatacatctgccttggggacacgaatccggaatctagtttccatcccccagccccctgattttggatgttcttttgattctccacagacctgggaaggtaaccgcaagccataccatctgcagctcacagcacctcttggaggttactactgacagttttcattacacaggcttctgtgagtgcttatgtgtttgtatgtgttcctgcgtgtgggtgcctgcttcctcgtaaaagagattgtgtgagtgtccgtactgtgtgtggggatttgtgagacaagcaaaggaggtataccgtacaagaggagatctaaacagcgtgataaaaatctccaggcactggggctcacaatctctagccccccctcctcacaccgccccttctttgccctactcccccggctcctttcgtctttgatgagtttttggctcactttttggcggagtctcttggacatgttctgctgttgctgaaggatcaaataaatggaacctttgaaagttgattatttttctcttatgtgacaaacacacacagagagagcgcgaagaggaaggaaattagagtgctgtatgacaagctagaggatttaaatttttccttggtgaactttgaggatccgctgagaagaaaccaaatgaagtgtttaccgtcattatctctatttgatgaagaggatactggggctcaaagagacttaataacttgtccaagatcacctaatgctgaataatcaagaatgagtgccatgaaagaacaaagaccagcctggaccagcatatttttgagaggataagccacagggtagcagaaatgattcacttgatggcatgcctgtttgtttacccagagagagtggagctgaggaagttggagcttccattgacactctaaactcatgaattaccgaaggaacgaagaataatgcatgtattttgacacaatggagacatcctgacacctcttctgaatctcagtaaattaactggattcaagcttggcaaacaggaaaactggtacaagacaacttgctacagctcaccactcaccagaggcagtgaaaaagaaaacttaacagggtaaaggatgtggacctgtttagacaaatcagcagccatagctcaatccactagcaaacaccattcatgaatcagcaactgcagtttgatccagaagaaacctccaggctctgactattggcctgagtccagagaattggcaagatgctgcaggaatatcacacaagtactttggtgtgaagaaacatcaccagtagagatccaggacacgtgttttacttctttgaattctctcaggaagagaagagccagaaagacccacattaaggttggcaaacacgttgcctatttacttcatagagaccccaatggagaacaagactgtttgaactccagaaggaccaacaccagataaattatgaatgttgaacaagatgaccttacatccacagcagataatgataggtcctaggtttaacagggccctatttgaccccctgcttgtggtgctgttggctcttcaacttcttgtggtggctggtttggttcgtgctcaaacctgcccttcagtgtgctcttgtagcaaccagttcagcaaggtgatttgtgttcggaaaaaccttcgtgaagttccggatggcatctccaccaacacaaggctgctgaacctccatgagaaccaaatccagatcattaaagtgaacagcttcaagcatttgaggcacttagaaatcctccagttgagcaggaaccatattcgaaccattgaaatcggggccttcaatggtctggccaacctcaacaccctggaactctttgacaatcgtcttactaccataccgaatggagcttttgtatatttgtctaaactgaaggagctctggttgaggaacaaccctattgaaagcatcccttcctatgcttttaacagaatcccttctttgcgccgcctggacttaggggaattgaaaaggctttcatacatctcagaaggtgcctttgaaggtctgtccaacttgaggtatttgaaccttgccatgtgcaaccttcgggaaatccctaacctcacaccactcatcaaacttgacgagctagatctttctgggaaccatttgtctgcaatcaggcctggctcttttcaggggttgatgcaccttcaaaaactgtggatgatacagtctcagattcaagtgattgaacggaatgcctttgataaccttcagtcactagtggagataaacttggcacacaacaatctaacattattgcctcatgacctcttcacacccttgcatcatctagagaggatacacctccatcacaacccgtggaactgtaactgtgatatcctgtggctcagctggtggataagagacatggccccctccaacacagcttgctgtgccaggtgtaacactccccccaacctgaaagggaggtacatcggagagctggaccagaattactttacatgctatgctcccgtaattgtggagccccctgcagacctcaatgtcactgaaggcatggcagctgagctgaaatgtcgggcttctacgtccctgacttccgtatcttggattactccaaatggaacagtcatgacccacggggcatacaaagtgcggatagctgtgctcagcgacggtactttaaatttcacaaatgtaactgtgcaagacacaggcatgtacacatgtatggtgagtaattctgttggcaacaccactgcttctgccaccttgaatgttactgcggcaaccactactccgttctcgtacttttcaactgtaacagtagagactatggaaccttctcaggatgaggcacggaccacagataacaatgtgggccccactccagtgatcgattgggagaccaccaatgtaaccacatctcttacgccacagagcacaaggtcgacagaaaaaacattcaccatcccagtaactgacatcaacagcggaatcccaggaattgatgaggtcatgaaaacaactaaaatcattattgggtgttttgtggccatcacactcatggctgccgtgatgctggtcattttctacaagatgaggaaacagcaccatcggcaaaaccaccatgctccaacaagggactgttgaaatcattaacgtggatgatgagatcactggggacacgcccatggaaagccacctgcccatgcctgcgattgagcatgagcacctaaaccactataactcttacaaatctcccttcaaccacacaacaacagtaaacacaataaattcaatacacagttcagtgcatgaaccgttattgatccgaatgaactctaaagacaatgtacaagagactcagatataaaacatttacagttacagaaaacaaacaatcaaaaaacaaaagacagtttattaaaaaaaaatgacacaaatgactgggctaaatctactgtttcaaaaaagtgtctttacaaaaaaaaaacaaaaagaaaagaaatttatttattaaaaattctattgtgatctaaagcagacaaaattatgtgtattcctcagaacctgtttttgctgcacttactattttcccacacctcctccctcccctccccaattgccatatttttcatagatctcaactcccccaaagaactggtctaggaaattttgtaagaattctgttacactttgagatttttatggtgaattctagtggtgagatccagtctattttgtctctttctctctctctctctctctctctctttttttcatttttttctttttccttcatgcccttatgaaatagtcaaatggggaatgcaatattagaaatagatttttaagaaagaacgaggtaaaaatgcaagatcttatatttttcatgtaatgacctgttctgtatttatgaggaggacattctgtggagaaagacaaaaagtaagcaaacaacagattaatttacatatgagcatctataaaacccatgacttttaaaaagcaaacctctagaaccagaatttgtagttcaaaagcttaaaataagattataaataaaatattgttggtttttctgtacc

SEQ ID NO: 81 - protein, 566 aa, Mus musculus; identical to SEQ ID NO: 79

SEQ ID NO: 82 - DNA, 2105 bp, Homo sapiens
caccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcag

SEQ ID NO: 83 - DNA, 2105 bp, Homo sapiens; identical to SEQ ID NO: 82

SEQ ID NO: 84 - protein, 640 aa, Homo sapiens
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTKIIIGCFVAITLMAAVMLVIFYKMRKQHHRQNHHAPTRTVEIINVDDEITGDTPMESHLPMPAIEHEHLNHYNSYKSPFNHTTTVNTINSIHSSVHEPLLIRMNSKDNVQETQI

SEQ ID NO: 85 - DNA, 40535 bp, Mus musculus
  misc_feature (1)  (40535): n = A, C, G, or T/U
aaaccacagccaacttccgaagcggtctcattgcccagcagcccccagccagtgacaggttccattcaccctcgttgcccttctccccacgacccttttccagaggcgactagatccctccgtttcatcccgcacgccatggacaagttttggtggcacacagcttggggactttgcctcttgcagttgagcctggcacatcagcagatcggtgagtggcccgccaccgcgcctgaggactccagctggatgcctctgggttgaatcgccctggggagggactgtagtgaattgggctagcaaagcaaagctgggatttggggctatgctattggaaagagtttacgcctgggaagtgctgctttggtgaaaggaaaagagaaagggagaagaaagtttgctgggcaagttgcccgcagattttgggcgaggtccccatgcttgctggagcacatggctcaaaagtaactgtactcttggatgcccgcagcctctgtcccgactaacaggctctggtgctcaagggctccccaagcctggctaactgtggctaggcaggtagaggcagacactggaacagacctgtagagcactccccaaggtgtgcacatagctacaggccagagattgggcaatgagcttttcagaaaggagcctcgaaaagctgaagacagtgggtcccagctttgactagttttcgggggctcttaaagtcagctttggtcaccaacggctttattttagcttgtgggagtttgaactggtttgtgtgaggctctgagtggcctaaaggttccaacatggaccaaggaggacacataaccggagcaataattcgaccagccgcgcagtgcttgcagtctaggcaaagtcaaacagcaacagggttcatatttgctgcctggcagcctcagagcaggaggggacctgtatcagggtaacctgtgaactttagcgcagtccctaatatcccatctaaatgtggttggtgactttggtggctgtggagaggaggagcttgggccaaatatccagtatggctcattttcaagcgtcccccctcctttatctatatatgaacagataattccacgaaggctttggttatcatcagcatagttaaattttctttgaagaagtgccagctaggtcattaagtcagctcagacttcagtgagttcctctcaacaagaattactaaatccagttctgggggtaaggggtgccaaactgggtttttttttctttttagacatggtacgttgggattagaaaatcgcacctccattgttgaatgttaaattttgaatgctgatgcagaagtaatgcaaataataattgcagtaggacactattggccatttgtgtgtgtgttctttgctgtgctatgttaggtaattcacataagctatctcattttatcctcatggtgatttggtgacaaatgctccccccaacaccttaccagtagggaaacagaggctcagagaggttaggtgacttcccctagtcacacagcaaggagtggggctgggtgtgaacttgggttcattaagttccctagcttagactgccatgggatatctaaaagcaagtgctagacaaagttgaaaagaccttcagggacagtaacagtctagccagcagaggctgcagtggaggctcccatagggagccagagctcctaggatccattggaaggcagaaacattcaggatggatgagggaaggacagagagagcctggacctgacctcagaggacaggaggaaggttggcacactgctcccacctttgttggggctgaggagccgaactcccacattttcctggcctgtctcccggctattctaaaaggtctactcccagatacctgttgcccttccaaccccccctggagtcaggttctgaggccagcaggctctcttctgccttggggtttctaccttcttgttgtacagtgtggctccaggacaagtagagctggtgccagtagcagcagctccatggaccctggcttttacgcccttgtaaagcagatgaaggaactgagactctgaaatgagatgtgacttagcacaggatgtgtgtgaaagagaaaggggagggagaagagaggcatcatggttgccccattctgggagtgactggtttgggaagatgatgaggaagcactgagaccagcaaagttgctggtggtggggctgagggtggggagggtggggaatggaggtggaggggcgttggggaggggtggcgtaagaggaggaagcatccatcactgtgctggcagtcaaacggtagagaagtggtggaggcctaaagcaacttctcccccaagggaagaaagtggccctagaccaaaggcagaggggacaagtgtccacttgcatctctcctctccctttccaaagatcgtggttaggaaactgtacctctattgttgaggaagatggggttcattctgggagttcttgggacttggggacagcaggcaccgttctgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggattggtgagttgcctgttccgttagggtgtgaggacatctttgaaatactgaagtctctggagtactgtgggagccccagtgtttcacctgaagtggtgaggaggaaggtgcggtcaatctggggtgtggcataacatttttaaaaaatatttttattaggtattttcctcatttacatttccaatgctatcccaaaagttccccataccctcccccctccaactcccctccccacccactcccactctttggccctggcgttcccctgtactggggcatataaaatttgcaagtccaatgggcctctctttccagtgatggccgactaggccatcttttgatacatatgcagctagagtcaagagctccagagtactggttagttcataatgttgttccacctatagggttgcagatccctttagctccttgggtactttctctagctcctccattgggagccctgcgatccatccaatagctgactgtgagcatcaacttctgtgaaaaatatggaacgcttcacgaatttgcgtgtcatccttgcgcagtggccatgctaatcttctctgtatctttccaattttagtatatgtgttgccgaagcgagcacgtggtataacatttttaacactttcagtgctacctacacactcatcacagttttgtattttatggctcaatatattcagtttgagtttaagaattatgatcaccatatcttaccctaaagaaaaatggtacccaagacaaacctttcttgtttcatatgactcttgagcattactgaaaaattagaagtaccctatttttcatttatttatctatttgtttatttatattcattcattaatttattcactttatatcccgattgcagcatcctttctcctcccagtctcccctcacatacttcctcccccataccccttcctccttctctgagaaggggaaggtccccctgggtacgaactcaccctagcacatcaagttactgcagtactaggtacatcctttcccactgaggccagataaggctgcccagttaggggaatgggatccacaggcagacagcagattcagggattgcccctgctccagttgttttgggacacacatgcaagctacacatctgctacatatgtggaaatccagcccatattttctggttggtggttcagtctctgggagcctccaggggtacaggttagctgactctgttggtctttttttggagtccctatcccagaaggaccataattttaaaatcctagcatattgctaatgccacccagtatccaaaacccgtaagaagtgccactcactgctcaaattcagtcaacagtagttgtttgttttttgttgcatggctttgcagtggtctcacacattgagattctcctagcaccgttttctcgataatgaaatcaaggatccaaggacacaggagtagagttgaggtgccccatcatctaccatcaccccatcactacctttggaggattctggaagtagccggtggtctctcactgttcctgcctgctgtactcagcagagtgatcacgaatagcctctctctcttgcctccctccagaaggctgtaggctcctggctgccctgccttgccctcctctgtcccatctttcccaggactcagccacagctgttagagatgccaacctagatatttattgctaaaataagtccatttccttatcagagtccagctgcccttttagacatgctctcatttctaggcttggcaaaaagggagaggctgctccttacctaagagacaagtcagggcaataccccttgcctgcaaattaagaaaggtcccacagacactcctgtgctgctctcggaggcattttggatgcagtgacccatagagaactgctgttatatactctttagatggttaaatatactcaccccatttgaggggaagtcttgaaatcccaggcagtgggttgacagggctttctagagaagttacagctcttgaaccaaaatccactgagaacctctagaagcaagtggctacccaaccagatagactcagttccactaaaaaaacaggaggcatgtgtgtgtggcagggctgggggatggcttccccaacagcctgccctggggttgcttgccgacaaggtatgagttacattagtgtttcatgaggacctccatttgagcaactctaaccagagcgtacgtgggaaatgactcttgtgaaagtgtgagctgaagcaggtggcagctgtgtcttggccccgcagagtttttaaagggactcttctctccttcagagagcgattcttggggtttgtaccagaagctgatgactcggtttactttgtgcctctgcttgaacgaggacacaagcggttttttgaggagggccttacatttgagcccagattttcattcacttagtggtctcacatttttgttaaacatatacttcactgaaactcagtgacagagtgtttacctagcatgcatgaagtcctggcttcaacctccgtcactggggaaacaaacaagtaaaccaaaacctaaaagcaaacaaccacaagaagaacaaaaaccaaaatcaaaccaaacaaaaccaaaaagcccatcctagctccaaactggccagtaaggatttggggagccaggaccgatagtgagaaatggaaaagatgtttctgctacctgccttctgcagcctcgtgggatatcctgagggattccatctaatcaaggattagatctcactcacttttatggtcccagatcccagtgcagatccacaatgacgaccagaaatgttggactgaaaagagtgtctgaaatagagaaataagaattttcatgtataaaggcaggctagctgacacactaagtgtgcaaatatgcttgtgtatgacagcacgctgagagtgttgacattctccacagtgtgtggagaaggtttggctggccaactgcttatacaggggcttctatgtcctcttcccaagcagagaggttgtctctctgtgcttttggtggctgctggctacggggtgggtctaaggagagggttagtggatggctgggaatgggttgatgacaccaaactcacacttaaacctcaaaatgaatcactgtccagcagcagtttgctctgagagctgctggtctgacactaggagtccttgaatcagagactcacagaccctctgaatcacacttggttctggcaggtggaatcagcagggagtgatgcaggaacacttcccagaacactcttatatcttctatggctcactatcaaaatgacactactgtatcccactagtgcctaatctgcaggaagcctggcagctaacagggcacccagtggcttcctctgcaatgagcttgcccagcacgaagttgctcaagcctggagtaggtcctgcattccttagaatcgcttgtctaccagtgctcagagactgccaaacacaggatttggggatactgttatgggggctagactcacagagccagaactccatgaggttggggtgccccagctgcctgggtgtgcccgcctggtgcaagtgtccctcctttgtgcaagtgtgggcagacagactcacagtgggtggggagggcttgagtcaccaaggatatgatttgcaaaactcaggtcccaagaaccttcctcaagtcttcagcttttgaaagtaaaggttaattgcaaaacgccagggtggaaggaaaaggtcatatgagcagtgattctgagcatctgtaccttcagcaatggctggaagttaaggcactttgagagctcttacaccgtttgtatttgctttttagtaccgaactgtaggtttctgagctaccattaccaatgttaataatcataacaaacagaacagaccctctccttgttttctataaactaacttgtccaaactatgcaccaatcttataaaaacagtgcttttaataccctctttccacatatgagggaaccaaggcacagaatttaaggaaatgggccagggccacatagttgcaaaatgaggggactgagatttaaaaccaggtcctcatgtgagtgcaggtcctgaaagggtccagaagtacgtgttggataccctggatctggggttacaggcaactgtgagccacctcgtatggtgctgggaactgaactctgagcctctgcaagaacagcaagcactcttagccactaagctatctatctctctagctccttgcctttcattttaaaacctggcatcagaggagagtacagaacttgcaaataaaaagggcaaagatcatgtcctcgaagctgctcttttatcacatgatcaggagtctagctcctactttgtggtgaggtttgggagttaagttaatggggggtgatatgtgtttttgttcatggttgcttcattttttatttctctccttggtaaaggtggactttaatgactgatgtttttctgtcatctaagactgtgacttgtaattaaagaaagcagaaggaggcatgggacaaataaacagtaaccaagtacttccgatttgttgacaaacccctgaatccagggtcttcatgctataaacaggaattgatgggaagaaagggaaactgagacaggagttggcttttacatccagggcaaagaggacttggtccggggtagctcttcttctcagctctatggcaaaccaggtgacctggaattggcttggtgtacagcagacaaatgtcacttgggcaataagatccttttctttgggcatccctggctgagaaacaagttattcaggaagagaggaggtgaagcacttgggcacatgtgactcagtctgtaaaagggctgcagacctttagtctggaggcaggaactcattcaggatttcccatctgattcaatgtcatgcatatctttactattaagtgagtctgcagtgccttccaaaagtatcacgcaccaaccatgaatgaggcagcactgtttcttatttcatttttttaaaggatactagtgaaacctctttgcaaggattcaccaccattggaactaagacgcgagggagaaaagagtgggtgcacacacctggcccttgcctttgcccttgacagtcatttcactataatcctgaccccgtctctgcaggttccagaagcaccaaataagtatgtcaggcacaaacgctgccagtgatgactgtaccctgcctaaaaagccgagtctaacagagatgagttccaacttgaagcctcaagagaactacttgcttcttttctgtagctaccagagagctgtaggggctccacactggcaaagggaggacatggactgagggaagcccaaagagcagaggccatgcatgcatgggtgaggtttggagaggaaatcctctggcagcttgtcttgtgttggatcctctgtttttcatgataccttagaggttatgttcacttagagattacgttcacttatttattcctaaatccaattcctctcctctactgttcactagttagttgttcatgctattgttgcattgcctgaccattcgtgagaacttcacttagggtgatgcctcagttggtaaagtgcttgccttgaaacacgaggctctaaatttgctcctcagcacccatgtaaaaacccaggaatgacagtgtgcacttgtaagtcccaactccagggaggtggagataggaagactgtgcagccagccaagctatttgacaagttctaggccaatgaaagatcctgcctcccccagtggaaaacccatgcattatgaacatttttgcatacaccatagctccagctactggcacatttccctaactatagtaagctctcattaaatatttagatggttaaccgaattaaatttctggacttaatcttagaagaaatcaccatcagtaactattcgagatattttgggtaagttctggttgtcttgtctttctttttggtctctagaaaacattttcttccctcgtgctccttgaagcaaatctcaaactccttgaagtttctttttctgggcaccctcttcagcttaagtggatctttgttaaggtttgacaggtcaggcaaggcaaggaggtgaaaaagcccattagattttgtccaatagagtaggcctcttgatttcctttaggtctggctatgtgtatgactcagttatcttaaaagctgaccttgaatatagtgacacccccccccccgccatcatcaaaatcctgttctcagcaacattctgagacacagtgttggctttttggtccctatgtttaaaaatgtgtgatgaggtggagagagggagtgtcatttcgtcccatcagtggtttgcagatctaggagctgctccatgtaaaaagacagttggtgcaggggggagggggagcttaggggagggtggtgctgaagactccatggttgtaaaacatgaaagattctagtttactctctctgtcacccatgagcagggtgagctcagacatttatgctagaccaagattcagctcaagctttctaaagttccgcagcatacagaagtgctctcagtatagaaatgatcctctgttttgtttctctctgtcactaattcactatacagttcctccccacaccactgtcctctattttctccctgtgtaaaaggagagagcaagaccctaggtgatctctatggtcctgtccaggcctcctgttctataaattcaccactctgagttcactaataaccatgcttcataaaacttagtggagaaaataacactactataatatcgtaatagaacagtaccaaaaatgtgatgttcagtgtggatttaatgtcatcagtgagctattaatgccagaaacaagcacaaagacccagttatactccataaacagcagcaggcaaaagtgatttctagggacaaggactttccctcctcgtacactatcaaattctccctccttcttggaaggggataggtgtaccccagtcctgacagagaagctaacaatgtgtctcagccacacagcttccactgcagggagctaggcctggaatcatgggctgaatccaaatgaaacactgcttgtttcaatgataattcaaacagtattgtcccaggaggtctgaaaatacagcttttgtgagaagaaactatgtctttcattcttaaagtttcatgagcatactggatttctcaacctccttcaaggagcctttacagcgtgttactacaaaatgatccatgtattcaaccaaaccacccactataatatatgtacaccttggctgcagcaacggctcactggttaagagcactggctgctcttccagaggactcaggttctatgcccagcacttgtatgctagcttacaagtgtctgtagtttcacttctgaaggacctgacactcttttctggcctctgagcataccaaactcaggcatgggccatggacattcaggcaaagcactcatgcacataaaaaatgataataatacatatgcacatatgatatatattatgcatgaatataaaacatgttatatacatataaaactttagtagggtactgtactaaaggccagtgagatgagtttactccttctaccaagagacttctagatccttgttaaattttctcctataaatccagagaaattctttctcagtgggagaaaaaaagaaatcataaatgctgtgatactcaggaggttttgaaagggggggtcaggggctgaataccctgtctacttccagccctcagtcagtgactgaaggtcttcggtcaggttgtaatcctttctgcttgtccccacgtcatagtcacctggaatccaccaacctttgatggaaataaaattccagatagtttcacctattgtgtcgtaattgtgcccttagttgttgagtatggttctgctgtctgtatttccaaccagttatacagacatcgtgttactctgagaaaagtgagagcccccacagtgccagcaaacagccctttgtcttggtcacagattggctgtggacatggtccctcttttatcattgctcctgtttcctcagatataaattggtgacaagctgaccagtttattatactgaattgtgtgattgacaggtggaaggaagtgagggatgcctgtgagctattctcgggtatgtgataggttggtagctagaagctactaacttagtagaagtcaccaagcttctaagtagaagctatcaagctaccacgtagaagacagggtgtaactgagtggagatgagaaaaagcagaacatgctcctgagctgctggtatgtaggaagatctctaacttctaatctagttagacgattatactgacctgagctgctggtatgtaggaagatctctaacttctaatctagttagacgattatactgagtgaggggaaaaaaaagaacacaggagaaggggaacaaagagggtacgtcatgagcaaaatgtttaaaggagtggataaaagtatgacatcattgaacttaaaggttatctacataagacagttcatgttgaagagatggttgcaacagattccaggtgacagaataaaaatgacattgtctatagggtccaattctccctcagaggctcagaggaagcccccaatcctgtcaggtagtgctaacagaatctggaacaatgtgagcgccaatgcggcggtgagaactttaaaacttttaccttgtttggagagtgacaattcaggtgactcccaaacaagtcctgtgacatcctgctcctgtggcatttattgctgatcaacagaggctttttggggtgctgtgttaaaaagcttaatcttatgcaaagactgctgtgatccattcgtgatgtctgccatggacaaaatatttttgagcatttggctccctcctgtcacaccaatgacaccataccggagcaccaaacttctctatgttatgtttctgaaagtcatctgtagaatcctctggaagtttagccatccttgcatctagataaggagccatcctctccaccccacccggcatccagcacagtataaaaatagtcttttacccagaggacaggttcagtcacgcgtgcctcctcttctgattcatgcttgttctgttttcccatcaccccatgtcaagttagtttcttggagccaggaatctcctgtttgaaccaaggccagacatactggtaaagggacccttcttctcatcgcttcatctgcaaactgagaagacaaaaaaaaaagaaaagaaaagaaaaagaaaaagaagaagaagaagaagaagaagaagaagaagaagaagaagaagaagaagaagaagaagaagaagaagaagaagggaagcctcacccacgagggtgataggagaaagaactagctaatgggaagaaagcctttgaagatgaaagggttgtacttgcatgttaattacaagttttatcagcccctagagcctttgcattctcagctgccactgggctctcttctaggcttctcaaatgtaaaacagcaacaacattccacagactggctcggctcagagcatccaagtccagaaagctgaattctaagctcaagctagccaggcactctgaaccactcaaatttccctacttgtccccaagggaaaaagtaggctcactacctaggaaggcaagataagatagagctgaagtataaacaaaaggctccatggagagtctactagaaatagcccctgggtaagattaggacattctgctctaattcccaaccagtgaaagcctaattgtgtgaccttgggctattggctttatctatctaatgcttcgatatactgtgtgaaccacctaggataataatccctctgcctcctcttgacctctgcaccttggcttgctggtgtgaaagtgagtttgttttgtcaccccccaccccttccctggtcaggctgaagcacatgaataaaactacaaggtgctattattacctgagctaactttcacctttatctgtgtctcctattgctggttgaccccaatcattgaaaccatattctttggaatgctcaccaatcttctcagagcttccaaaccccttcttatctaggagggcttcatattggcccaggcttctttttggttgtgccatttcctgaagcgtgtgaatatgttcgggctgacaggggactgaggtgttctgcacaggtgggtctcgatacttttggtgggatagctcaaccacaacactggagacaggtaggaaggctatctagtgctgaaagcttgaaacatgcaagctgaactggatacccacagcagcaccataatatggctcataaaatggagaaatgaagaaagaaaagaaagagcctaagagagaagttacaatggccttggcactacaatccaaagaggctaccaagtcagaaagaagacttggaaagtatatagcacacttgtccttattggacatcctattgaaacttcaaggcttcaagtgactgcccaaggtcacacaacttactggctatatacccaggttttctgactcctagacaagcctttttccattttccttctttgaaatagtagaggataaatcactaagcactgaattaccactctaagaaggccttgaatataaaaagggatggaactaaaggagcagtgcattagtggcacaatgcagaatgtataggtaattacattctttaagggccattgctgcactagagctgttcattttcttgcatgtcttatttggtgttctttggatcatttttgccttatggggcaaccggaacaaaaggtccagagcaacctagactggcctttgggattctgagtggcgtcaatggtcatgtgcttcatggattgagtcaacaagatgtgtacatgataaatcgtgtctgctagacactgatgatgtaacttgcgatgtgaagcacagtctcattggtgcttcctggcatcaacagcgtgtctgggagatagacactaaacaaaaagcgatcccttatttgaatacacatgtcctgtgttatgaaagagacacccacaatcttatgaaggcacagagtaaggggattcccatctgttctaagcctcttgagccccataaggtgaccagcatcacctgtatgtgtagcatcccctgttctttgaggtcctttttttgttggatttctcagaaccccatcagctctatgtgaaaaatacagtctagtggctatggccccatacccatagaaatattaagcaaatctaggccccctttgactacctcactcttgggttctataaaagaggaagtaatgtaagttctccaaatattgaagttagttgacagtcatatctgcttcgtagttgatagtggtagatgagactcatgggaatctatgaagttactagagctttgtggaacattgttggagtggcaaaagaaggcaaattctggagaaacagaagatgccacacggagcagcactggggaaaatttatagtgtattctcaggttgtgatattaagcctctgtgtaggattaaaactttcagcttggacctagggtttgatagcatctatgtttgaagtagcttgtggactgacttcctgtggtcatgcaggtacatcctttgggctcagacaagatgagcagctatgcactctgggatatgaatgtcaatctatttggcttcagggacttcactgctttatctttaagataattgctgactctgaagatgatgaaagtagattctttcagactagtgctacggatgtggtgagaaaacaaacattcaaagtcaaatgcaggagatgatagaaaaaaatgtttaccaaatggtataggcagagactgccccacatgatctattgtcggcaaccgtgtctgatacaagagagaaaagtgaagggtgtctgctccatcatggtgatagcatccttctcatcttcttgtacttccttgggtaggtgagatagggatggagatacaaatattacatcccaccagaagatacaaccctttgaggcagcaaaccacaagcttgctatccatcacctgcatctgggctcacacttgtcatgtcatccagctgagtatctctaagcaatagagcaatcaactccgtcgaaataactcctcccacagtaagaaatgtgagggtagcgtagttttagtatctcagtgatattgccaagacacatggctctctttttctaactttgcaccctgctattctcattatctcccaacaagtcttcctcatgttggccatctggcatccacagctccatgcatgaaaactctgtcagtaccaatcagcagaagggatgctttattcataagcacctcttttaaaatggagaggaggctttcttggggtctttgattgatttctcttttctttcatgggaccaataggaccacatgactggcaaggagaactcagaccacagtttggatttaagccaagcatgatctacccattggagatggaagtgtggtcctctcctctccagaacaggttctagatttctgtgcaaatttaagttcagttagatctatattgccatggtcacaacgtctgctatgatgtataaggtcacagaaagtatcaatcgatatggtagaactacagtttaagactcagtatgtggcaaagccaaaacttccaatttctctgagccacaccctccagctttttctgagaagctgcccttcatggccaggctttttgagactcattacaatttgaacctccttggtctatctatgtcttttctcagttccaatagctataaacatatcttttcatttcttccagaaaagggaataaaacattgagacacaaccttaaacttgtattaatttatacgagatagctcctggactcctctttcgcttgcttgagcactttattactggaaactcatgacttgcagcccatctccacacagctggagctgccccatacatgaggaccacttctctgcagtgatccattaaaaaagaattaccctgaccttggatgagcatctcttcctgtaagttctgagatgatgacccccaagggggatggccagcttcccctttctattacatttttccactggagtgttttaatgtgtatgaagtgttttcagctccattatctaatccagtattcacattaacttcgtggttagcattattatactctttttttccctaaccgtagtgaagttttaatgattttttttctcccaagttcacttcaagtcaaggtcagagctaattagtgtactctgaggatttgactcctagatgatagcttcagaacccatgtgtgtaccttcataccatattagctccttgggggctgatttagctttagggagtctggaattgactactgaatcgtatactaatattgtctgtcacaggtgggaagagcccttccttctagttcctttgagttcaaagttcaagtgttcaatatattaaccttttgataaatctgaggacaagatgggggttttgttttgttttgtggtctaatcccctgccccagtgcatttagctcagcagtctaacatcctgagagagggagaggccttcaggatttacaaaaaatcattggccatttcatacatgcatattaagattttgagtcactcctccccaccccctagtctcttctttaatttggtctttagccaaagcctttcttcttccccatgggtccgcttcttgccctcaagtnnnnnnnnnnnnnnnnnnnncccatgggtccgcttcttgccctcaagtctgtttttgtgtgtgagtgactggctttagttatagttgctcccatgagcatggtggggaagctatttcctgggacaccagccccttatcagtggctacaccactgaagaaagtgactccctgtctcccagcaaccactgactgctgctagtttcttagggagcggtgaggcctcattatcgtctcctctattcacgatgaaacgttggcaggtccaatcttgtgcaggttaccacagccacggagagttaatgagtgttgcagtcacgtcatgtccaggatgtctttttggagcacagatccccatcccccagctcttacattctttccttcttgtggtgattttccattcctctttggttgcctaaatacagtttaaggatttttgacactatccaaggatgtttaaagacgggtctcacagatgtgattatttagtagagaagaaggaagccaggtttttctctacctaatgatgaaggagctagaggaaacagattctcttgagccaacatcactgtattttgagataaatttcatggcggtgcaccttgctggacttcagcttgttgaatcagttcctaactcatccttcagttcccagctgggaccttgcagagcaaaagcttgctgctagaacgagctcttgggtcccaccacaccttgtgctcctaccatgactcactgttctgtatagttgacttgtctaatgtctggcttctccactgggccataacttttattggaatagtgaccccgtgagccttatttaatgtcctgaccccagaagcatagtaccctgcacatagaatcattggaagaatcctcattgaataaatgaggttggaactggaattcttttctctgaaggcttgtgatctactttaggattagaaaggtttaggtgagattatggttagacatggtgagtttagactaagtttgaaattgaattttttgaaaaaaacaaaacaaaacaatgtctctctattgtctatctggcaatgaatctaacactctatctatctatctatctgtctgtctgtctgtctgtctgtctgtctggtatcatctatctatctgccatatatgtacttgcattatttacatttagcttctaagcctatcatttatcaatttatactatctctttaaactattttcatattctctcttgcacacacacacacacacacacacacacacacacacacacaagcacacatgaaagatctctcatcaagcaggcttcatctccttccatccttcctttgtctggtacctatcattgcgctgtcctcagtctctccacaagtgacatcatccacgagattctcttctgtgtttttcttaaatgctgccacacagaagctgaacgtgtgcagcatctgaccactcagatacatgtgaaggacagaagaagtgttcttctaaacccagcactgtgggggtcaggttcgtggaagcaagctgtggatactccaggccctttttgatggagcacaaagtgaagttcccaaagttcttcagagatgtgtttgaaagaattctctcttattttaaacaagcaccattaggtaaactccaggcttcctttagctgctgcctcttcatagggggaaaaatgcccctttattaagtgtgtgagcttcctgtttctgtttttggagtgttacagtcatcagccacttctggattccgcattgtttgcattgttaaaaaccttggaaaactcatctggtttcttctccaaacaagtttcccagacacccccaacccccaacccccgggaaggcattcagaaacaggccccagtttcaaacaggcgaccaagaaacaatgtctcctagagccaggcagtttatctttttctaaagtctggaataaaaaatgtttactccagaccacatagttaagtcctgactgtcagagtcgtctgtgtcctgtatgctcaagatgtaatgtgggtcctggcatcacagctggattctagtcctgccacttgccagttacactgccttaagtgatgcacttagcctctccatgtctcatttgtctcttctctgaaacggaggcttaattcccacggcttaagcactgctgggatgctgtacatgaagcccttgatagaaagtctggcatggaacaagcattcaagagtaataattatgatcattgttacaatcctaaggctccaaggcctctctcttccccattcagtcctaactatgctcctggtacatttgaggaacgcttccaactgccttgggaaagtcttcatttcatttctgagcatagttagctgatgaattctcatttcatttggcggggtcagcatcctaaaattgtgactcccgcacaggcttactggaacgctttcggagcagatgaagcaggctgtgaagttccgggaaccttggctgtagctggtgaaagcaaactgggaagcacgctttggggcctgtctttacttgcacaattacagtcaatctctcaggctgcctgtgtcagcaggatcagcctttcctgcctcccgttcttccagttactgggggcaaggggaggagtggcttttgcctgtgtgtgtgtgtgtgtgtgtgtgtgtgtgtgtgtgtgtacatgaggtgtaagcatggactgtgagcatgactgcatacaggtgtgcatgataaggccagatgatgcctggatgtttttatctttctctacctcattgtttggagacaagggttcttcctaaacctggatcttacctgttcagtgagattagctggccagtgatttccagagactcccccatttctccttccccaacattggggttataggcacagcccccctgacattatagatagaggctagaagtctgatctcagtttctcatgtttgtgtggcaaccatattgcctactgagccacacctccccatccccccaccccaggctgtagcaacacttctttacagtgttgttctgtggcctcggagcacagaggagcctttagggggttagttcaatgcaatagcttctctctgctggagtttctcagggcccacacccttcccacaagtcccagcttgggggccagtttctgagtgcataaagtaaatgcctccctgcctgtcattgggatgttcaattctttcacctccaaaaatacctgtaattgcctttaactgcttagttctgctgtcctccaaaagccactcccagccacacccccacaatgagcaaggctttttacaccttttaaaaggagtatttgcatctgagtcagctttccatcttccttctatttcatgagagtttggcttaatgttgtttggaacgaaactgcagattatcaaagcaaggatgacttttcattgcataaagacataatagattcaaaactcaaaggattccttggtatcagggggagtcaaggccagttgcctatggagaagagcatttactgagcatgtactatggtctacttccttgatggcaatttgcatgcatttactgtcttacattcgtctattcttccgagtaaatatgtattgaataaacaagcgacacttcttcagcgtcacgggagtctgagaaatggaggctcatgaattggaatcatttaagatgcctcagatcctatgtgctgggatagcatttaactcagagtcacctcccctccctcccatgatcccaccagttcacctttgtctggttaattctagtcttctgctctctggactcagacctagaaaagtcaaggtctctttcgtgtctttgtggaatttagattaaataaatcttttttttttttttctggatcgttgagtaaaaagactcagttgtaataactcagaaaggctgataagcaggaaaggggagggtgagagtttttctcttttctcagggacaatgggcccttaaagaccaccagtggccagggatccagctagggggcagttctccactgtccccactgagcagcttctcaggcaaggaccatcccaggactgtagaatggtttgaattggtcccaaataccgaaattcactgcagggcacactggggatgtttgtggtaatttaggaagattctctctaaggaaattagcaactctgttgtgttttacttaattgaaaccattctttgcctagagctccattgatgggtggactcactgcaatttgagaacaggatgctatccacactttttgttttgtctgctctttcactctgctggccagtccactctgcttgaaatattcattacatcctagctgtccagataacagagcaaaatgccactagccagtccctggatcactgggaaagttaatcagctttctcacagacctcttctagctgcagagggctgggttgggaactagagattctcaaattccacttctttgatgagaatgctgggatccagagagctgaagtgattctttaagtactcataacttactagtaaggagatgagcacagagatccatgtcaaataagtgctttcattactacatcagagatattttgtgtcacactctctgacaccatggataaaaagacgaataaggttgggtctaatgggacccttactggttggatggggcagatttctaatatatatagtgttctttataaaaaaaaaatggatctgtctaatgtgccagatcaatttagtcctatcatctatctatctatctatctatccatctacctatctatcatctatctctaccctctatctatgtatttttctattcatcacccataatctcttactcacaatatgagttgtaagaagccacataactgggtagccagggctgatccctaaacatcttgagggctggaggtctttggcattaattaaggatataataactgatcattaattaagttatcacagaggtgctttacctataggcttctttgaagacacctactggccaatagctaccaagtactaagcactttgctaagactcaggcactttgcccagtgccttatctgcagtccttcatttcatccttaaaagcactccatgaagaaagcatgacctttgcttcaccagtgaagaacctgaggctcaaaagttaaaaatgacaagccccacatagcctcactgagagtagggccccacgtgtggacaatgatccagatgatcttgtgaggttaaagccctaacatttccaagtaatggaattaaagtaatactagcacggatgatcagagtcacagttaggctactctggaaccctggattgccttgagttcatggctaagatctggaagggatagatacagctctactatccccaatcctgaaaccagcttgtgatccgaatggagcccttgtcctcaaagccaggacattcagtagccatgcgcttaccttccagttctctcttgcctatcttaccgagtccaaatgctagaggcatctagaggacatcaaaaggagatattttgatccctggaagatgaatatgaatcctaaatttattttaatctggagatgggtagaggagaaattccattttgtccagtgtattgcttatatttttcatgcctgtgagcaaatacctggcagaaagggggtgaaggaaagagggtttctttggacttatggttaaagagagtacagtcactgtggtgggaaaagcatgacagagttcatggtagctggagcatatcacaccaggaggcaggggacagggattctggcattcccttcaccccatttatatttagtccagaaccccagcccaagggatggtgccagctagacctagggctggccttccttcctctggaaagcttctctgaaaaaaaaaatcactcctaggcataccaaggagtgtgtcccccaggccattccaaatccagtcaagttgacaacgggcagtgagtcaccacaccaagagtcagatcctacccaagcccagtaaacaaacaaacaaataaaagaagggcaccctttcttaggagagtgagcttaagagcacactggtcccctgccagtgcagctccagctatggtgacagacaatgccttgttttgttttctgtctagcattgttggtctcagacactgcctcattcataggttagtggcttccctgtgtgctctttgtttcttcatacactctttgatggcagggatttgtccttatcacttgtacccagggtcacagctggcatacacttccatattttatggatgaccctgtgagtcaagacctttcaccgtgtccttattctaggctggtgattgtttggcatgaacacgtgtgtgtgtgtgtgtgtgtgtgtgtgtgtgtgtgtgtgtgtgtgtgtgtgtgtcagattttatcccacctggccattgttctcacccaaaattttctagaggtctctgtagcaaaagaagagccctttggcaggtctgctcccttgtcattttgaatggccatttattttaagggaaattaacatcttattttcttttggcatcttgatagaggggtcatttgtatcttcctgtatttccagacttctgggttttcaaataagctgtcttccctaataacgggaagttatgtttggcccactccatgtgagaatgtaacacatgctaagactcttgtccaaaccctgtggctttacttagatgtaagagcttgttaaaaatgagttctgggagcttggcatttgagaccggcatcactgttacagatgtagttgcacaggttgaaagcacaaagagggatggatcacaatcactaggtgatttgaaaagtcctaaccctggacatcctttggcccagatttttaaaatccccacccacacagcccagcctctgatggatctgttttaccctgttcgtatgttcaaagtgtctgcagaacgaacaagagtcaggctcacggaggagacaggcaccttcgtggcatccctacctactcactttagcacacaacatgaaaagagaaaatgagaaacaagagatggcaatgttgcaatgaggcctgatggttttggtgcctccgatttgggaagtggtgggaacctagaactcggtctagttgcaatgctttgtcattgcaaatacagctatgtcacctcactatgttctgataaactggaagatggtgaggaagtaatctaaaggcatgactctagtttggcttttttgtttttttgagacaagggtatttttttatgtagcccaagatgacccagagctcatgataattcctatctatgctggatagtttcatgtcaatttgacacaagctagagttatttgagaggagtgaactccaatcaagaaaaagcctccataataccagaatgtagaaatgactgtagagcactttcttaattagtgattgatgggggaagacccaacccagtgtgggtggtgccacccgtggactggtggtcctgtgttctataagaaagtaggctgagtaagccatacagagcaaacaaaacagtgagcagcagacctctagggcctttaaatctacttatgcctccaggtacccataggatttgggttcctgccttggtacccatcagtggatcctggctcagtatatataagccaaataaacccttttctccacaagttgctttgggtcatgatgttttatcacaacaatagtaaccctgattaagacaccaacttagcctctggagttgttccatcctaatccaccttaagtcagtattgtctacaaggtgagctacagataagtgttaagtcttatgggcaacttaatttattactaaactcatagctatccagataaggctttttgagtaatgccaggaagaggccactgggggtagaaaactatctagtgctactagactatgagtgtcaccattcgacccaggaactgaagtgataacatggagggaggggctacaaagatcaatctaaatagtatttgaactagattttgtttgtcatggcagagcagaggtcttgtcctgcctactactctagccaagcagaaatccaatctgttcgttaggatttttcttttcatctaggtccccaaacggtccaccctgttagacacagagctcttaagtcccagtgcagtgcagatttctgtataaaattctccaccctaaagagagaaagaaataatcatctcccatcgatattctaattccaactcaatttgcatggaattagaatattgagtcccttgccttgaaactgtctaggaagaggcctgacttcccttctcttgtggaatttctggaagccaaggtaagaggctgccacttgtgcttccatgagaaaacaggaaggcctttgcttgacatctaatccttgggtaggttgttaaacttctcagtctcagtgttgccatctgctctctgcataaaggcttgtgatggttaccacacttatctcagatgactgttgttagatgaggaaatcgctgtgcagggactagcagatgcaaaccatgtgcccctttgtgttaacccagctcagaagcccagacaagggctcagaggctgaaataatcagagccagtgtttcccagcctgctatgccccacaattggcttacatgttaagtatcccaagcaggcagccatggctttcatgagctgagtctctgcttactacctctgcctctatcttttgccactttcatgataagagctgggctcaatgggcttcctctcagatgaggaaggtcacttattcaacctctggatgctgtgcagagagtcccaggatgcagaatcttcaggacacttgggctgccatcccacacagagtagcagctctggacacactgcaatcttttcacttccactcaaaaagaggctaaaagagacagatagaaggaaaggaaaaacaataggtcctaccttggactttaggtggtagatgagctttgtaggaactggaagtggcctttcgcattcctcctctgagtgaccccatcttgaagggcaataagccgtacttcagtgactgagtcttgatatttcatcaggtccactgtttatccagcagtcacagtaatgtatcagtcacagaaatgtacccagccatggcagaatgtacaaaaagtccgaacttttctattttcctctctgcaaggtcagataatagtgatcttcaaggaggtctcttttgcaaggtacttttatgtttgaaacaaggagagaaatactaaggttatactaggcaaatgagttctaaagcatttttgcatgatgtatcttatatgtgacactcttagagcttcagggccctgtgctaattgctccttgtctgtttccatagacatcagtggggtgacccattttcctggcactttcaagttaagactgaccaaatgatgagtatcatgtaatgactggcctctacctcagagttttccagactggtttagatattcccataggggagtttgagagggccagggtcactgaaggggtaggctaggtactgaggtgagactaaacaaggtggattcaggctctaggtctatctcaaagccctcattctggctccacctcagataacgatacttactggtcttagccatcctgaatctttccagtgcatcatggtagcaaaagaaagatagagcactactctgctctataaatgctgctgttgcccctccttatcctggcatcaacccaagaagatctaggtagactcagaagatctgaggcaacatctatgttcatcaaactctccctgcatctcttgttccttaaattctccatctgtaaagtgggtgcatagtaccgacccttaaggcttcaaaggactgttttggtatgcttgtgttgcgtatctcatgagataaagtcctattaacaaggtgatccaggtctaaagtacacgatgcattctgttctacagagagtgacaccaacacatgtctttattcctgtgggaattttatggccctttctgatatttgaatgtgcctcaggtatgcaaacccatactctgagcccttttatctcacaagtcctgaagatgtcctagctttgatgctatcaattagttttatttagatttgagattacccgtgactagtgattatactatttagttagtattatgatttctattctcttaaaaatgattttccaggtgacatgtgtgtgattgcataaggctatttccataaaaaaaaaaaaaccatacaaagccttttgagcatattctcattttactgaaggagagagaaaggctagatgtgtcacagatcctactgcaagtagttcaaggtcacgtagcttatagtgaataggatttgggtgtgacccgtgcatcctccttctagatggagactggctcaccagcatgccaggactcactgatcgcttctcaagtgcagataataacaagtaaccgcttcttattctgctttgtctctcacgaggtccctctcttgatctgccagtctttcaaagtgctgcctctagacttgtgcagaaggtgtactctaattagatgatgtcaaagtaattacagctgcccagaaaaaaaaataactgcaagacaaagtggagctgtcgttcttgcctctccgaactgcagcgggaaaaaccgtatgtggccttctgctgctttgtcagtccacttaaccacatcctgagtttgtgctagtcaatctgctaaatcaataagatccaaaagtggaaaaaaaacaaaacaaaacaaaaaaccaaaggtgttaaggccagtggatttcctggttgccatggcaacacacaagggtacacactgtggtttcttgtttcatctgtcttcctggaggcttgttccccatggaggacttggacttacagaactcctatttagtgagataaaactaggggcaagcaagcaccttgatagatccagaagaaggggggaaatcttcagcagggtcttactgcccatgtacccaacacagaagcaaaaggcaggaagaaggcttcttctcacgttctaaaaacaactcaaggcatctctagactatgcaatgggttggctatttggaggacttggcagaatggcccgggtgacagcttctaagggggttgctctttcatagagtcctgttggctcatgatggactccttgttccttaaactagagactgagaggtcagggtgtccagccaggcccccagacattggggtgcctttcccctttgagtgccaagagatgaatagctcaactaaaagcaccccatgacaaattctgaaggaaattccctccatatgattgtgcatgactgtcttctctgctcattaaaacttcacccgccttgggggtgattccgggagagactgagtcactagttactcatggtctgcagtgggcagccaaaggctatctagcaccaagaatgattttggcctcattcaaaagtagatgctgaacaatatactctttcattaggcacccgtcacatgggagtcagacgatggcacaagtggtgtaggggcaatgggaaagctgccagccttcttctgtactggcaggtttggtggaagcaggggctatacagcttgaatggttcccagatggaaacttctgagctgcaaagacatcgcacaagtggaaaaagagtgacttgcccatgatgtacttcggaatgatgctccctggccatgagttgtagatttattgggaacagcatgctcaaacatcttataaaatatactttgttagaagcattgtaccaggagtcaggatgctgcaattaaagtcccctgagattgtgctttcttcataatggtctaggggaccaagctctcaattttattttcttgtttctcacagctaatttgtttaaggccctttattgtcctacctttaatcatggatgatctaattaccaatatgtttttgttttttgttgtttttttttttaaagaaaaatggcacgttccctacttgcttctaatcagaatcagcagagctaggctcatgaattgtgtcatcttctgtgtaagatgtaagctctgcaagtcagagggcagtaaaagagccttggatttaaatgccaaacactgtgaaagtaaaacccacatgtgcactggttgccactcactgcccacgcaattagtgtggcagtctcatagggggctagattctgttaaggaccatcaagcaagggtgtcaggttccagctccatcagcctagcacatctacttggtaagtctagacctttgggattgccaatagacatttcggaaagtcacaagtggacccagctgtggatcaaagcagaatgccagctcttctcattagctctgcctgagcatggctggagcacttgggatataaaggacagaaggctgaaactgcagccaggactgaaccattccaattctcaaaaatgtcttgagaagagaacaggataagatcagagagaatctcggttggataaagccagtgaacaagttgcagttcaggaactcttccctgagagaggataacagatccaatagtatggtgatttttccactgtagcaactcagacctgttgggtgaagaccttcccccttcaggcagagtaaaggaaattgggtaacaaatgggattctgatagtgttcagatctgttccatgtctaactaccacttaaccctgtgactcaaacagcctgactgttcagtctgtacctggctctaccacttccttaagacttctcaatgaattaatcaatgcatgtgaggtgtggttaataaaagaacatgctccataggattgtcgtgagaataaaatgaattattaggtgcaaaactattgaaaactgtaacatcacccagaaaaggcgctgtctttgcttgctggtgttcctacaacccatgataagtaaactgtggtaattaggcaagtcacggaacacaggaaactggtctggcttctatgtctactatctctaagacggcgacttttctccaccacagtctactgtgagccaaatcaacagaaaaatacttaattctgcctcataactcttggggagagagcagaaaagaccaagcatatggctagttcatgctagcaagcatcaattcttttggggtcatctaaagaagggagagttggagagctatccacctctcttgggcacagtgtgttcataagtgtctcctggtggtctgcatgtgtgatatattgctgtctattttcaggaggtctaacttcataaatgatcgccaaacttgtgcaaatgtgttgtatccattacagagatgatgtcttcaaaagccagttacaaaaacacaagcggtcttcaggaacattttcttttatggaaaatagcaagtgttcagaaacagcttcaggctcagacatttttagtggccaatagagaatccttaaagaagcctgattggtgactcttggtagatatcaggagagcacaggaaagccgatctatttgtggccagaagtctatcttccttcttctagagcaggctctactctcactcacctctcgagcaactttgggaaaatgcagataatggaaacctgagtggaaattacatagtggctccttctttgatgatgttatgattttcttccagttgggaaatgactgggtgtatgaagaatccatttctctctgacttcacaatgtaagcaaagtgttgaagtgggtgatttccctagtgaaatcatatttttcttgatcagagataaggtggatggtgccataaaatagttatgccttttctgagagtgagttttaaccatagcccacaacaggttagaaatctgacccttccatttggatgagtttggtcatgacttagtgcctcagattcttcgtctctaaaatgggctttccatactcttccccaagaatgattgctttaattggttatctaacattaagtgggcagacctgaagtcatatacctaaaagtaacattacaggaattgaacattgaaactctctctctctctctctctctctctccctctctctctctctctctctctctcaagtggtcttgagagggagcaaggatggtatgggagagtttggagagaggaaggggaaaattaggcaattatactttaatttcaaaactaatatttttagaaaaatgactttgccaatgtgctgacctcataagactcagatgagaattaagttagatgaagttcataaggcagttggcaaatctccaatactcacagcctcaattactataagctccatttttaccagtttcatttagtgagtcccacagactctagcaggttggtagcgtggtccctttagcaaggctgagcaccagagatgttaagcagctccctggctgtgccatctcttgggagtggcagagtctgggaggatctgaactcagttaagctatttccttctcaggtattatggacacactcaggtgtctccttccccttgatcttggggaatcttggatgatgaacctagagatgaccctgccctgctcatagcctgtcataatacgcactctaagggagcggcatgtccctggaggcttctctctcaatcagaaagtagctccagtctacatctttcattgagcccattctgtctctctaagggaggggcttcgaacagttcaattcattgtaagataaaggagatttattggagaccagagggttccgaagaaaacattcttgaagtatcttcatatggaaaggcttgtttaagagatacaattgccatttaatataagcctacttgtgtgtgtgtgtgtgtgtgtgtgtgtgtgtgtgtgtgtggtatacccacacatgtacatgcctgtatatgggtgcacatgtgtgggtgtttaggtgtttgcacacatacagaggtcagaggacagcatatctctcactccttagaagctgtttatttttttcttcaatacagtgtctctcactgtcctggagatcaccatgaaaactaaggctagtagccgtcctgtaagtcctggatatcagtctgcctgtttccccagcactggattctaagagtgtaccaccaaaccagctttcttataggacctagtgctttttcagcaagctttttatgggctgagttatctttcctagccttagtatttgtcacccaagtcataggactcctagatggcagaggcgttgtttctgaggaaacaactgtagacagacagaagctcatcctccatactcgaagcttggtccatcgctgccatggatacttgtgccctgctggagatgatctttggttcatgctgctcccctctcacccttcccttcatgatgggaacaatgttggctatgcacgggtgggataaggaagcaggagcgttacctatcctggggttaggagaagaaagtagtggtgaagcttgcgggttccaggaggccagtccaggtgggtttgaatgtctgcttcaccatcacagctcagtgatctcgggcatgtttctatagtctctcctctctgtgcctcactttctctatctggaaagtggtaattaatattacctgcctcttaaaggtgttttaaggagcagattagttagcacttgtaaaatgcttgtaagagtgcctgacatctacacaagcactcacttctgctatcgttcttggagagtctgaatgccttcataaattgccaggacttaaatgacacacagagttcaaggtttggcccattttaatgcaagagtgacccagagaggatggatggcttatcagcatgatagttgatcttgatgtctggggcaccatcattgcaattcctaagtgtccaaatgccatgagggttaggatctggattctgtctcacgagattaaaataagcacaagcgtgtacttaatattttctgagaatttcttattgacccagcagccattttcagatgctggcagtgtgtcaggcccctggctaaggtagcaaggtgaagactgagtttgtctgtcttcttctgcccttgatggttcacgcacacacagagtcaattacagggacacttagcaaataaccaccacatgtccacacactatcctaaaagtcacattggttgttgcacatggaacatgaggggctttactcaaaagtcacagcttgcattgggttctcttgcatttgcatatccaatctgccaggtggccagctagaattgattttcataagaaagaaactgcctctcatctcccaaccattgtccaagcctctgcctttatttttaaaccaggagttgacagcaaccacctgggtcaggaaccggcaggtggcatctgactgaagtcaccttagcagctctacctacaagaagctgattcaaacatttctctttttttctctttctttctctctttttctctttctctctctctttctttctttctctttctctctctctttcttcctttctttcttccctccctccctctctctctttctttctttcttcctttctttccttcttccttccttcctttcttcctttctttctttctttctttctttctctctctcttttttctttcctccctccctctctctctttctttcttccttcctttctttctttctttctttctttctttctttctttctttttctttctttctttctttctttctttctttctttctttcttccttctttccttccttccttcctttctttctttctttctttctttctttctttctttctttctttctttctcttatctatgctggagcagggagaggccctggaagggctgtctctctgagtgacagcttccctttgtgaaactggtcaactgaaacctaagctgcaaatgtcagtaaaaataaatagtatttcaaagggactttgtgcatttccttcctctgtgtgctgttgcttcacccgccaagaactgcacgagtgcctgcagagagcacactgggccccagagataaggaattaactgcacaaaacctcctttcttcatttgtctgcttccagtgtttcatgatttttttgttgttggtggtggtggtttttggtttgttttgttttgtttgtttgtttttatggtacctgcttgctgaaaacagaaaccaaagaaaagaagccaactgatattggcttacatgccttcttaagggtgccttctttcttggttttgcatctgtctgacgctgttcggaatctgcttcctgctttagaagcgagcagctgtcacctgcacagtttcagaataatgggcccacttttgtcatcatgaaacagttgtttgggtgtggctctcccctgttctaagcgtgaaggatcttctcagcacatgggaagctggttcaaaacactgtggggtgattgaacacactgagaggagttcccacctcagccatctaaaagctggggaattgtgcacgttgctttattttcccccagcttctgtttcttgacatttaaatatatatacaaagctttttttttttttagagtacagatgacagaatcccaagagttcaggacatcaaggaacaatttagggaaaaaaccctcctctcccactatgatccactctgaaatgaaatgtagaacaaagcagggtccaggtggagcatgtggctctagatagaaatggtcacttccttcagcaactcctttctttaccttgtattctcttgttggtaaatgctgagctttggagggtccagagtctgggttaaagccacttctttctgtctcaagacccagagtcaggcacattctccgtcactgctgagagaaaatgtcgtgaggtgacaattcagaatataattgaaccatccctgccactatgaggacagagcatttcatgtagaagagaattcagggctgtgttctcaggcctgaggtgttcagaatggctgatggcattgagggaaaattgtagttggaagagagccagcaactcccgggctagagagggagagagactatagccagatcacattgttcttgaccagaaggaagtttattctgggtgcagctgaatgtatagtgctagaagtgataaggcaaggggtaacaccagttgattgtggaaatgtgtattatgagcacatttccagttgattgtggaaatgtgctcataatacaagaataggtgggaaacagagtgtgggtatgcatgtgtgtgtatctctgtgtgtctgtgtctgtgtgtgtgtctctgtgtgtagctttcttagaagttggcttgtgtttctttattactcttttggatattattttgtctgtttcctatgactttatattaatttgaagaatgggcctaaaaaagtcattattaacgaagatactttaaggatggggtccattatgatatcatacgtcagatctgagggtcccttataatgtcacatctcagatttaagcttgatgtatctttggaaagccaaagtgaattttgaaggccatgtcagtagtgttgtttatttggatttttgttgttctgagacaaggtcttacactgtagttgaccccgattcaccatgtagcccaggctggtcttgaactcaggtgatcctcctgcctcagcctcccaagtgtgggatttcaactgtgagatactatgtgctgttacttggttttcatgtgtgtgcatgtgtgtgtaggttctcatttgtgtgcctgttcatacaagcatgttcaggcaagagaaaaacattggctttcattcctcaggtgtcatctaccttgtttttagacacaaggccacttattgggctggaacgcaccaagaaggctaagctggttgggctgcgagcccatgggatctacctgttaatccaaccctaatattgcaagtgctggccaccatacccaggttttttgtttttttgtttttaatttttatttatttatttttttaattaggtattttcctcatttacatttccaatgttatcccaaaagtcccccataccccccctcccctacccacccactcctactttttggccctggcgttcccctgtactggagcatataaagtttgcaagtccaatgggcctctctttccagtggtggccgactaggccatcttttgatacatatgcagctagagtcaagagctccgggcatacccaggtttttataggtggattttgagggattaaactcaggttcccatgctcacaaggcaagcacttcactggctgagccatcaccccagctgcatgtttggcttctcccaatgccccatctggcgtggtttttttttttttttaagtcttcacttacaagcacttcttaccattgatctagtttcatgcaaattattaatgcaaaagcctctaacatctccgtttcctcccacagatttgaatgtaacctgccgctacgcaggtgtattccatgtggagaaaaatggccgctacagtatctcccggactgaggcagctgacctctgccaggctttcaacagtaccttacccaccatggaccaaatgaagttggccctgagcaagggttttgaaacatgcaggtaagagagcagcaccttcactgggaaaagcccactggttggggcggcgcttatggctggaaggctcctccctgacagttgaataagttcttgcctaaagaggcagccctacctattaatttggccaagtcaaactgaaaccggtatgacaactggaatttaaagtcggctaaagacacctttgtgaatcatagggagggaggccagaggaagccattagggtcatatcagttgcaaccctctggcctaatgtgctcctgtagcactctcctggctttgaagaggcattcagtatcactgtaggaaccacaagaaaatgcaagccaaataacagtgtttaagataaataggtagctggcagagtcttgactgtgcagacttgacacaaagcacgttcttcaaacctctctctctctctcccccacctctctctgagcttttatgttgagcttctatgctgctatggtttgacaaattaagtaaaatgatgtggaagttttaaagctgtattacattaaagttattatcagaagccttgagaagtcttttacaaggtacacaggttcccagaggaccttcctcaaatcattttgttccaggataattgatagaggcagagaacattttatatatatgtatatatgtatatatatatatatataatttatattatttattattataatgaatagtatatataatactatatattatgccaatatattatatagactatatataatataaatacatataatatataaagtaatacatattatatgttatacatatacatattttgtttcctgtcactactgtgttagtgtgtatgtgtgtgtgtgtgtgtgtgtgtacttttttgtggtcagtggtatgcatgaagaggggcttagtgacaacttcaattgagtaattagtgtggtttgagttccccagaagaattagatagttttcataagggctctgaatgcccaccccagcccatagcttaggcactgtagctcccttcctgcggctaagcccacatgtgttcccacacacatgcgaacaatgcttttagaaagtctagtgcagacctctttgtgcaagctattaaacgcaagttaattgcatctgtccccagcccttagttacagactcaggcacccaccacttgaatggcaactgagactcttgctctgcctaatatagtaaccatgagccacacatggtgcattatatttaagttaattaaaagtaggttatatgaaaatgagttctttgatggcactagctgagtttcaattgcctggtagctgccgtatcaaacggcatggcttagggtagagactatttccattgtttaagagtgttctcttgagtagcgctagctaggcatctgtctgtaactgtccagagctaagtctgagggatgttaatgaaggtgtgatggctctgcagctataggttgtgactcattagcttcatgaaggatggccagttaacaaaacctactcctaaggctatgctttacaatgtggtctgactaggtcgctgtgttaagaaagtgtttttaggaagctggtctatggttgtgaaatgcagttaagacatacttttgaaatagagggtttttttgttttgttttgttttgttttgtttttggtttgtttgtttgttttacctgttgagagctagagggaaaaaatacagaatattaagctgccaggataatgccaaaggcatcctttaccttaatccttaaactgccctgtttatttctaagacattttgtagaggaagcagccgagccccacagcttgtcatggatacactgcttatacttagacgagtcacagtctgctgtgatcagtctgaacataatgactaagtcctcccaagggacagaggataaagggagaggatgcaaggacttgtctttcctcctgttgacagtcactcactaaggccatatatacttataggaattttaatgtccccaactcatgtatagaacatgcacatataagtgacaggtagaatgatatagtgaaaaaaatcacaataatacacacacacacacacacacacatatatatatgtgtatatatatatgcatatatatatatatatatatatatatatatatatatatatatatcaattttccaacatgatgtggaggggcaaggtaaagagtaatttcactgttgagtattatttagaaaataagcagaaaaaaacctctgctgcagaaatctgtcatcgcacccataactggtattaagtgtttcaaaactcactttcataatttccctgaggtagctaaggaatctgatatctgccaaaaaccagaagggatcgtctcacaggttcagccaaagcctcagcaacgacttctgtcttgtctgccccaccctgtttagtggcaactctcaggtccatgagaacttattaacgtttaattgtgtgccctcccaccactgagctaaagagactctgggaaatcagtctgtccgtttggacggggaattagtcattcagcttccattgcaacacccacataatgagagactttatgcttaggagcttccaagtcatgctcattgtcacgggtcttgcagggtgctggggtctgttctgttgtccctgcagaagagggtaaaagaaggaaaagatgctgcgtttgagcttgcacaacatgtctcaaaccctgctaatttagcatctccctttttgctctcttgatgtcatacacccttttccattcaagtaacattttctcagtccatatccatgtcttgagacattttatatttctgttatatggccactagggtgcttctgagggtggtggtaatatgcattgtatctgaaaaggcccccagacctaaatggctctcagaatcacctagatgggtgtgggagtggatagtgtgttactctcttgagagctttgttaagtgagccactgccatccacttctgtaattgctgttgctctcagctcaaggatagcaaatttatctccatgggtcttggatggtgacaaagccagatacgccatgtgctcagcacaggagcaaggcttcatgctggcgatagtggggtaaaaaaatgagtctcgagggagaaggcaagaacaggaaagaagaggagaatgggcaataagacaggtctggagtcttagactgaacggaaggccaattcacttgttatcttgagagattgggtcattttatgtcatttttgaaaaatataaagctaatttggtgtcaagtcttacagtgtaacttttttcttctgtaacttaggcttcttgatgcctttaagaacattgctgaccttacattttatatgggactattgttttgtatgtgtggacctttaaaaaaattatctaaaaacaacaaaaatctccagcctttaaagaaactagttttgcctctgtccatcttcatctctctcatcctccaatgctgttgttattggatgttacataattcagttgttggaacccctaacatttccagagaagtgttatgccatattaaatgtcatttgatggggttttatgaagtggcatcccagacgttcatgtctattgcttcttgtttttccttggcaggtatgggttcatagaaggaaatgtggtaattccgaggattcatcccaacgctatctgtgcagccaaccacacaggagtatatatcctcgtcacgtccaacacctcccactatgacacatattgcttcaatgcctcaggttggttccaagtgcatggttttggggttgcctgtgggagcattggctgacaacagttctgttgaagcttgggtggagctttctgaagctcctactcaaaatgagtcctgaaggtttctacaatagaaggaacagccatgaacagcctgtgttcatggtaccaatgtgccaggcatatagagcagatgata

SEQ ID NO: 86 - DNA, 705 bp, Mus musculus
aaaccacagccaacttccgaagcggtctcattgcccagcagcccccagccagtgacaggttccattcaccctcgttgcccttctccccacgacccttttccagaggcgactagatccctccgtttcatcccgcacgccatggacaagttttggtggcacacagcttggggactttgcctcttgcagttgagcctggcacatcagcagatcgatttgaatgtaacctgccgctacgcaggtgtattccatgtggagaaaaatggccgctacagtatctcccggactgaggcagctgacctctgccaggctttcaacagtaccttacccaccatggaccaaatgaagttggccctgagcaagggttttgaaacatgcaggtatgggttcatagaaggaaatgtggtaattccgaggattcatcccaacgctatctgtgcagccaaccacacaggagtatatatcctcgtcacgtccaacacctcccactatgacacatattgcttcaatgcctcaggttggttccaagtgcatggttttggggttgcctgtgggagcattggctgacaacagttctgttgaagcttgggtggagctttctgaagctcctactcaaaatgagtcctgaaggtttctacaatagaaggaacagccatgaacagcctgtgttcatggtaccaatgtgccaggcatatagagcagatgata

SEQ ID NO: 87 - protein, 187 aa, Mus musculus
KPQPTSEAVSLPSSPQPVTGSIHPRCPSPHDPFPEATRSLRFIPHAMDKFWWHTAWGLCLLQLSLAHQQIDLNVTCRYAGVFHVEKNGRYSISRTEAADLCQAFNSTLPTMDQMKLALSKGFETCRYGFIEGNVVIPRIHPNAICAANHTGVYILVTSNTSHYDTYCFNASGWFQVHGFGVACGSIG

SEQ ID NO: 88 - DNA, 93550 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgctaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccgggctgtgtctaggcagggcagagctgggcggggcagagactggggctggaacagggcgagtggctgttatcaaggtggtcacagaagggatcacaattccaagtgtgagactagctggcaatgggttttccagaaaggggtcctgggttctcccagctccccactgagccttgttccaaagcttacagtccgcagtgtcactgccaccttagcgctgtggaagcttgaaccagctctgcggtgaggtcttgggtctccatgagattccagcctgggatagggagcatgaatatgagaggcaaccactggaccagctgcttggtcctcaccacctcctgcttctgccaatcagtgtggggaaatctcaacagtaaggtggctcatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcagtaaattctactcagcaaatatttattaacccagttccacgggagtactgagaaattgaaacacacagtctcacccaggtagtttagattgagtacccagtataaagtatcttgaattactttctgctttctctatcttcctactttctgcagtaggaagaaagtgaccctaggtggaggctaggcaggatgagttctctgtgcatatgcatctccctttctgtgtgagtgagaggtctttgctaggtggggatttggggatctaggatttatactactgaagctgaaataataataataatgatagcaacaacacagcctgtcatggtggcccatgcctgtaatcctaggactttgggaggctgaggcagcaaattacccaaggtcaggagtttgagaccagccttggccaacatggtgaaaccccatctttacaaaaaatacaaaaattagcagggtgtggtggtgcacacctgtagtcccagctgcttgggacgctgaggcaggagaattgcttgaacctaggaggtgaaggttgcagtgaaccaagattatgccattgcactccagcctgggtgacaaagcgtgactctgttaaaaaaaaaaaaatgaatacagtgctagctaccatttactgtatattttcactgtgccaggcattatgttaaatattttccatgtgttatctcattctaccctcacaatggcctagtaagaagcttcctgttatcaggcctgtttgacaggaggaaaactgatgcttagagacgttaagtgacttgctggcattcacatagccaggagcagtgctggatggaaacccagctccactgagctccaaagcctaggcttagaatatgttagactgtataagatggacgaacttggaaggatttcagggagggaaggattttggtggactctaggccttagggaaagttccaaaagggactggagctcaaataagcccttgaaaagtggaaacattcaggatgggagagaagagtcaagctggagatcagggagagccctgggcctggcctgaaagaagagggccctggtggtttccctatagtctctagggaagtttatttgtatgttacctaccagtgccatcttctgctttgtctttgggcattctgactcctgactccttccaacctgtctccccgttccttctaaaaggccccacttccaaatatttggcactgtcctaacccttgaggttctcccagagacccgcagtctccctcctgccccgtgtttccacggcccctttgcgcagcatcatttagaggaagtacaatgaagtgccagtagcaataactgccccggccctcgctttcatgtgcttgtaaagttgtttggcaggaactgggacttggaaaggagacatgactttgtcagagggcttggggctgggcatggtgtgggtggcgaaggggagaaggaggaaaggggaaggaaaggagctcttgttgccccattctggggagtggtggactctggacaaccacgaggaaactttggaaaggagcaaggctttgaggaggagtccagtctttgtatgggaaagcaaaaagtggagaaatggccaaatgtagttaagtgacattggacccagaaactctgagttggggaacagatatcttgaattcggggtcttgtgcaggaggaagaaagtggcccttggtggaggccaggggggatgagtccttcatgcacatgcatctccttgtctctgtgggtgaggggatctttttttttaattattattatactttaagttttagggttcaaccattgtggaagtcagtgtggcgattcctcagggatctagaactagaaataccatttgacccagccatcccattactgggtatatacccaaaggactacaaatcatgctgctataaagacacatgcacatgtatgtttattgtggcattattcacaatagcaaagacttggaaccaacccaaatgtccaacaatgatagactgggtgaggggatctttgcttgggaattgcatgcctggtgttgagaaagaggagagcgtctgagagccctgggtcttagggctggcacacacctttctgctcccttctctctaattgagcattagagactccgccccctgctgggagttagaactttagctgtgttttcccatgtgaaggagcaaagaggcaaagcttcatctctgttggggctagcatcaactaattcaggtattccccatttacacattggacatctacttgctgcaaaggcatggtgacaagtccttgtgtgggaggctggcagccagtaggaaaatgttccatttgttttttcccaaatttccccacaaaggaggggatgctggacagcatgaaattcttagttcatgacagattcccttccattcattcaggaactatttcctgactcattgtcatagactcagagatgggaactctaaggatcatttagaaaatctgaaagagagggactagtgacttcccctctctgcgacttgttaagatattagggcagggcatttctctcatgtatctctatcatgaggactgtgggagcctcaaccccaccccctgcagtgggtggggagggtgtggtctactggggtaacaacatttgtttcacaccttaaatactaccttacagactcattacagttttatatattactctacaatatacccaatttgagtttaatacaataataatgatatatatttttgaccatatagcaatgttggtgttcgacaatgattctctgtattgtcctggggcttctagcacctcctggaacatcgctagatggtcaggagcaccaaagttttaaaaacctgatgctctgctgtggtaccatatggtcctgtgtaaagcagggtcctaagtcctgagtctctaggaaatactgctcagtgagcactgactctatactagatgtgaagccgggggtagcacaggatatcttatctaagcctcccaacagcccaatacacctagcactctctttaactccattttctagataaagagatcgagacttgtggagatggcatgacttgccccaggatccagtggtggagttgggatttccgcattatctaacatcctcccatgttagactccaatgcttatgctccttcaattcattatgtgtctggaggactttggaagctatacgtggctctcccacactacctgtcccctgtggccagcataagtgaactcttgcatgggtggcttctctctccatccccggcaggctgtggactcttggctgccctgccctggcctgtctctccccaggtttggccaggtttggccacagatatcagagatgccaaccaagttatttgtaactaaaataaatcacatcccttatcagagtccagctgccctcccagatatgctctgatttacaggcttggaataaagagagaggtggttgcttgtctacaggacaagttagggcaatgccctctgcctgaatattaggaaagcagcattacaggagctctcactctgaccaggcaagcatttcacatgcacagacccagagacccactcctcacatgctcattagtaggttgtgcgaccctgggtaggaggctgacatgggtcttgaactgaaacccagtgtgtggctctaggtgacatgtggccacccaagtgaggtttcggatccacctgcagtgtcagatgcttcaaggctggggtcccctgatggagaggaggtggttggagatcacctgggcctcctcagcactgcctcctggctggggctggggctggggataagagagtaactgcaattgtgcttccccggcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttttaagtgtaccccccacagctgcccaactgggtttgcgaggcaagcccaacttgccagagtaaaccggaaggggtgctttctaaagtttgtggttctggagtctggccaggcatggatacagtcattgtgcgttccagattttctgggagagtcaggatctcaaatatgcaaacactctaccaattgatgtctagtgcatattttgactaaatgtttatatatttttccacaaataaatacatgacttaatgtaattgaaagtcaaacactttttaaaaatgctttttgcataaagaaattcacatctttacaactccttaactaggatggtgtcaattaaattaatgtttgattcaggacatgtgtactttggaggtaagtatttcatattcctcccctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaacaaaacaaattccaatgtatcttctcctgtcttctgcagcactgggggagtcccctgataacagggatcatgtcacattcatttttgtgggcccagatcccagtaatattgacccataactgttgaactgcaatgaatgtctagaatataaaagtcatgatatctatatatatggaagcatgctgtcagtatgggctaaggtgcaaatacatttatgtgtaagtgagaaccatggtgatggctgtgttgctcaggacagggctgacttggctggctgactgcccaccacaggcctcatgtttggtctaccccaaacagtgagctcacccatctgtttgtttgcggctttggtggctgcctgctgtgaccgctggggacatctggctaaagacagggttactagatagttgggctgagaagggagtgggagccagtgagatgaggacaccaaccccaaatttaagcctcaaaacaaaaacactccccagcagcagccaccttggggttctagttattttggagatactgatacgaggttgagatccttgggtgagaggcccacactcctccaacccccatgtctgcttctggaaggtggtggcagaggagagaagtagaagtactatatgggagatgcgggagattcttgccttctctgtcggtctctttgggcaattatcaagctgtcatctgaccagatactaccatagcttcttcgggggcaaatccgtagggaatcctgacatccgacggggagccactttggcaatggcaaacggtgtctcctctccacagagcttgtgatgtcagaaattacccataactggggcaggttttgtcttcccaaagattgtctgcccagctagacctgagagacagggagacaaacacagaatgagggggtgggtcttgtgggggtggggaacgatggaaactcacagagccagatctccccgagtttgagttgcactggctgcctgggtgtgtcctcctgaggtaagtgtccctgcgaagtgcaagtgtgggcagacagatctcaggtgggtggggagggactgagtcaccaaggaggtgatttgcaaaactcaggtcccagaaactttcaggtcttcagcttttaaaagtaaaggttaattgcaaaactccggggttgagggaagagattattcacatagaccagtcattttgagcatctgctgttgtggcattgcaagtctccttcgcagtgcctgaaagttcatttgtttttgagagctcttacgctttttctgtttgcatctttgcacaagttctatgtttctgagaaccctcaccactattagtaataatagcaaacacttacagagtgttgaccatgtaccagcgccattctaattgtttcctatatactgccttgtttaatccaaacactgacttcatgaaggtggtgctgttattatctgtcttttacatatgaggaaactgaggcacagagaatttaagtagcttgcccaaggccatgcagctgataagtgatggcgctgggattcaaactcacatctggctacagagttcatgctctttgtcactatgttagagtgcttctcttggtatattaagatatcgaggcaccctagaaatccagacgattgtacctggaagtactgtagttgttttcaaaaacttcatttgggaatctagttgtgggtgaggtcataacatccactgagcttttaaacatgatgtcagaggaaggggttagaattgcaaaaatgaaggaggaggaagttgtaatggaaacttctgccaatgcatattctgagttgactcattcattctgatctctgaatagaagctctactctcttctatgtgatggaaagttgaggatagggtagggctgagagggatgtgaattgagttgtttgttcattaggataggatagggctgaaagggatgtgaattgagttgtttgttcattatcacttcattatttgtcacctggatgaaaggtaaaggtggctgattagtgtttctccatcagctagaactttgactgggaaatgagccaatcaaatagcagcaaaatatttgccctcaccttacaggcccttggttccagggtcttctctccaccggctagaatggatgagggagggagagaaactctgagaaaagaggctgtcaggagtagggctgtacatatccagggcacaaggaatttggcaaaagctggaagtatactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcctttccaagatagtagcacgataacagtaaagcccctttgcaagtgttcactattatgcacattaagatgccagggagagggctgggaaaggtggctcacacctgtaatcccagcactttgggaggccgaggcaggcggatgacctgaggtcgggagttcgagaccagcctgaccaacatggagaaaccccgtctctactaaaaatacaaaaaaattagccgggcatggtggtgcatgcctgtaatctcagctacttgggaggctgaggcaggagaatcacttgaacccgggaggcagaggttgcagtgagccaagatcacgccattgcactccagcctgggcaacaagagcgaaactcggtctcaaaaaaaaaaaaggtgccagggagaaatgaacaattccatgcagccaacacctggtctcctgcgtttggcttagaagggcatttctgcccaagcccccagctctagtctttgcacactttaaatgagtagctactacatgccaatcacagatgttgcctctgctgagtatccagtcaaaaaaccagaatctaacagagctaactaagcaccatcttgcaggaaaccagctgacgtcagctccgcagccaccagtgagttactgggcccacatctgcctgcaagagggggaggggaattcaggtaacccacaagaggggataaaagttcggggaagaaatctcctgtcaaggagtttgtttttgcagtggatcctctgcagtgagactagttgtctttacaatatcattagaggtcaggtacattcctgtagactcccttaagtgacttgctttctcctattgttccccctgaaaattcataaaaacctcacaaacacatctccatttaaaaagagaaagtttaaaggatgccatgtaatggttatctcttttcttttgccagtgagcataaaagctccttagggaaaagcccaaaccctctatacattttcatattcatgatagccctgagcggtcagcacagttccccaattatagtgggtgctcaataaacacttggatggcttactgaattaataatgtttctagacttggctagcaaagccatctccgttacttatcttttgtgatttttataggttctgtctaattctttttcttcattttttttctttctggtctatacaaatcttctttcatttttctctattgctacttgtagcgatcctcaacccgcctcctcccttgaaatttctgttctctgcactctcttcagtctaaagagatctttcttgaggtttgaaatgttacacaaggcaggggaagtttagagctaattgtattttgtccagtagaacggggatctggatttcctataggtctggctgcctctttgtctacacctttacttccaaatctggcctcatgtataaaaagaccccaaaccttaaaatcatgttctcaacaatactcagagaaaaattgttggctttttggtcaccatgctagaggaataaaagggcagttgtttctttcggtcaatggtttgaaaacctcccagactaaaaatcacctccatataatcagatgcttggtgtggtgtaatgaagatgaggaggtctggctttgataagagtcatttagaaggtataaaggcagtggaacaagacgggaggacccatacaccagttgattcccctcttgccacttaacagcagcgtgagcttgggcagttgcacttgttaaatgtctggaacaatacttagcacgtaatttctaaagcttaatgtttagttcacagaaggtatcccaagaatagaaatgattattatattttagcttctctctattactgattcactatgtgctgctaggcaaagtatttcacccccatttacttctatttttccatgtgtaaaatgcgagggttggattctagttgatctgtcaagtcctttccaggcctcatgttctataaattcaccactctgtgggcttactaacacctgagcctcataaaacctaatggaaagaataacacaaaaccaccataaggcagtgtcaaaaaaaattgatgcctgatttgtattaaatgtcaaaagtgaattattaatccatgccagaaataaacatatggacccaattacactctaactccaatgggcaagagtgttgtagggacaaagtgctttgcccgtagtacttcatagaatcctctagaccatgtggaaggtgagcagatgaagcagctctggccagagaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatggtgaatttctgcttctactgagagtcctccagacccccagtaaaaatttcttttcatcataaaaccagagaaactcttgctcaggaaaaagaaagaaaaatggaaatcataaagattgcacgacttaggattttgtcaaaatgtgtcagaggctataatataaggctagtttttggcattctgtcagtcactgaatgtccttcgtcagatcacagctccttttggttgtgctgactttatacccatctggaatccactgaccattagctgaaataaaatcccagatgtgctcagatctcacatcctgtgcaatgccctcagttattgctgatacggttcagtcatctgtctctccagctaatcatacagacacagtattctaggagaagtgagaacccactcatagccaggagagcttctccctctcagtcacagggtgactgtgggcaaggtccttcccctgttggttgcctctgtctccccagttataagatggtgacaaactgaccaacttaaaatttccttaaaatgtattggcactgtggacagaaatgaggaaagtggaagacctagtttctgtcctcagggagcttaccatttggtggaaataaagttaaacaggtgaaagaattatgcaagagagcataaccaagtgtcagaagacaggaaaaacagacatctcgattgcatgtgaaggcttcaaggaatttgaggatgagttgaatgtggaaaagaagatagacagagagaggggagaggagagaaacccagggaaaggcaaaacatgagccaggtgtttaaagtgggggaataagaatggcttgattggggccaggggaggggtctgtctgcttggataagagaattcatgaaaagaacagtgagagatgaggtcggacagattccaggcaatcaagtaacagtggcactgtccactggcagaagatccaatttttctgccccagaaactcagaagttctcatgaatcaccctctcagacagtgctagacagagttcagaagcaggccagctccaacagtgagaaagaactttggcaactttgcctgggttagagagtggcaatttaagtgaatcccaaacaagacctactgtggcaatagcaaatagattttagctcaaggaacatttcccattgactcctagaggcttcccaaaatgctgtactaagaagtcaaaccttggctcaggtatggagagtgctgtgatccattagtgatgtctgctatgggcacaatatgaaggatttgacccccatgcatcacatggacatcaccgtagtggagcagcaggctttctttgttaatgtttctgagagttgtgtgtatagtcctctgggagtttagccattctagaatctgtccagctagccatactatagactctatctccttctagaacagtaaaaaagcagtctcttgcccagagggcagaggttagtcacttgagccttttgttaggattcactcccattctgtcttcccatttacccacatgaagttagatgctgggagccagatatttcctgtgtttgaacaagggccagacttcctggcaaagggtcccttcttcccatcagtttcttcaactgcaaactgagaagacaaaagtgatgcctcacccgtggtggcgacaggaggaataactagctaatgcgaggaaagcttttgaagatgaaagggtggtatgtgcatgttaattacaacttttatcagccctggagcctctgcattctcagctgccactggaagctcttctgtgcctcccaaatgcaaacagcagccacattccatgagctggcctcactaagtcctgcttagagcatccaagtcaagaaggttggattttgagctcaggctggccagctggctcactctgggccactcaagtttcccactactcatccccaagggaaaaagtaggctagctacctgggcaggtaagataagatagaaccaaggtataaacaaaaggctccatcaaaagtctaccagaaatagcccctgggtaagattaggacactctgctctaattcccaccctgtgaaagcctaattgtttgaccttgggctattggctttatctgtctaatggttcaatatactgtgtgaaccatttggggataataatccctctgcctcccctagacctctccacctttgcctgctggtgtgaaagtgttttgtgctagtaggcagaaacacgtgatataaaactacaaggtcctattattacctaggataactttcgcctctatctatgtctcctgttgctggttgaccccaatcattgaaactgtattctttggaatgctcagcagtctcctccaagctgccattccctccttatctaggtgggcccagtattggctcaggcttcttggttgtgccacttcctaaggcttgcaaatgcattcagcctgcccttgctctcagtgccagctctcagtgcccttgctgggataactcaataaagggctagaggtgggaatgggataatcatcagatgctttgctagtgctgacgggacagcttagaaggtataaactgagctgggcccatgcagcaacaccaaaatatgtgttcaaagagggagaagaggagaaaaagagaaaggaagttatcgtggtctgataacagggcatgtcagaatgggaaagggtgttaggaattatgtagccaacttgtttgattggaaagataaggaagcctcaagggctgcaagtgactttcccaaggtcacaaaactaattggtggcaaaaccgtggtcttctgacttgtccggtttcctttcattttatcctttgagacgataaaggagaggacactaactaaacaagaagacaatgatctgatcaggacaagaagacttggagtacaaaatgagaagaagataatagggtaatggattttttagtggcacagtgggaaatggcgtaggtgtttacactgcactggagccctcactgtgcttggaactggttccctgtgcacagtcttgcacacccatatttggtatttttttatcctttttgacttaatgagcatttggaaaccataaggcccacagcaacctgacctttgacttgcccagactctctgagcaattttgtgagttgagtcaacaatcaatggttttcaaattattcaattgttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaaggagaagcactggatcttgtgagagcataatagggagatctcatctgatttaaagcaccagggaaagcctcccaggacctgttggatgaatagcagtaaccatgtctccaggatccccacaattccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctctaagctgactcaggattttagaagcacacatttggggagaagggaaacaaaaattctggagaagcaaaaagtgtcatatggtatagaagttattttaagctactggggaaaattcataatttacttagggatcttgagtgtcaagcattggtttagagacaaatcttatccatttcgttgaaagttccttgatcttgtggctgaagcttgggcctagggttttattagtgtacatttaggggatggtttacagggtgtctttcaaggtcatacaggtgcctcttttggggtcaggcaggaggaataggacaaactctgggatacgaatgtacaaccatttggctcctagggcctcagtcctttagctccttgcttctggtgacttcttggagacaagagtagactttttcagaacagcgagatagttgtgctgacaaaacaaaaacaaaaacatcatttaagatgccttcagatgcaagtacatgtcataatagaaatatttaaaaattagtagagtataggcactagctaattcaaatgcttggttgtaaacaactatgtcttgtaaatgagaataaagtttattctctcaatgacgatgataacatctttctcactcacttttactcaaattggctttattgggcaggagagacagagatggagttataggtatcatgattgaacttaagctacaacccatctatgcatcaaaccatcatgtgtctcgtgtgattgttatctgttgtgtatattttggtatatccctatctgtacataccagctgaatatttctgtaagtaacagaacaatcagctctcataaaatattacctcccagggcaagaagtctgggatgattccaggaagtcaatgatattatcaagactcaggtttatttttccaactttcaattctgccactcccagtgtcttcctgcaatttagcacccctcatgttcctaaactaaatcccacagttccaggcatcctaggaaaaaaaaaatcaatatttagcagcagaagaaagagtgtatattcacaaacatctcttctaaaattggaggagcggctttttgggaagtccttaattgacctctccttatttctcattggatgaatggggtcacatgcccacacctaaccaatcactggcaagaagagcttggaccacagtgcttgacttagaccaatcatgatccacccactggagctgggatttgaggtctcacctgtcctgaagcacaaattcagggtttctgaataaaattgcacttcaggtagaatagaataactttttttgcattggtaacaatgtgggctacaatgagtaagggagtccatttacctgctagagttgtggtttgagactatttgggctaaggaaagaaggcaaagctaagtttttgtgcctctgtgccacaccctcaacctttttctgaaaagacatgcctcatgggtagagctcacatgggggacacactgcagtttgaggtttagatggtctgtggcttatactcaatgataatacctaaaactttatcctttcctgtcttctacaaaagagaattatatcagggaataatcttaaatctgttataatttacaagaaatagccagtcttctgcacacttgagtactttattattagaaactcattacttgcaacccatctcagcactgttggagctacaccatgcatgaggaccgctgctctagagtcatccattaaaaaagaattcctacgaacctgaatgagcatttctttctctaaattatgagatgatgaccctcaagggaaatggccgtcttcccttttctactgcactcttagagtgcattaatgtgtgtgaagtgttttcggttccattatctaaagcagccctcatattaacatcgtggttggcattactggcctcctgtatgggatgaaagtttaatgacttctgcaaggttatgaaaggtcaagatcacagctaattagtgcaaattcaggatttgaattctagtttctaccccagagctgatgtccatgtcaccatggacatcatttgctcccaatatacctgatttactttcaaggggtctggaattgactattggattttatattaaaaattgctctttcataggcaggaaaaagtccttcctaatagtttgagtccaaagcttaagggtctagcatctcaactttttaatgaacccaaaaatgaacaggagggttttctgagccagtcccctgcctccacacagttagctcatgaatccaacatcatgggaggaagtcttcaggattttgtttcccattccttttttatcacctaaatatagttaaaggatttgtgatgactgcatccagagatgtttaaaaatggacctgaaggatgtgattgtgtcttaggcaggaagggtgccggttcttttcagtatctaatgatgaacgatctaaaggaaatggattctaaaccatttgattctaaaccaaaatggtgtatgtttcttttgagggtgaatttcctgatcatgagccttgttgagcattagactggccggctggttcctaatccatccttcagttctcagctgcagtgacatttccttagagagacagatctcctttggggacagcacaggacttgagaaaaaaggcttccctttccactgagcttggctccaactacacctcatgtgtctgttacatttatcatgctgtgttgtcaacttgtttaatgtctgtcagtggctcatgcctgtaattcagcactttgggagcctgaggcaaaagacttactttgacagcagaggtttgcagaggttgctgggcaacatagtgagaccctgtctctacaaaaatatatttttaattggctgtgcatggtggcatgcacctgtagtcccagctgctcaggaggctgaggtgggaggagtgcttgggcccaggagtttgaggttacactgagctaagattgtgctactgcactccagcctgggtgatggagccagaccctgtctctattaaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattggggtgattttgatgggattgtgacttaccatggtggatgcatcctgtgagttccaaactcaacttcttaaaaaaccttgtctatcatctatccatctatctgtctgtctgtctatctatctatctatctatctatctatctatctatctatctatcatctgtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgcccactcaggataagtgtgagggataaggaggaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccacttttgtattctgcattgtttgcgttgttaaaaactctggaaaactcatctggtttcttctccaaaagtagcttcccagagccctgggagacactcagaaataagatccttttcaaataggccagcagggaccagggtctctcagaaccagctttcctatcttcttccaaaggccggaattgagaaggtttactccagcccacataattgagtctctgggctgtcaaggacgcattggggagtttgcttctggtgtgctgggtgcttagaaagccgtatgaattgcagagatagagttgggttccagttctgccagtcaccaattatgtggccttaagcagtttacttaacttttctgagcctcaattttctcttctctaaaatagagttgtaatatacctatggcttagagttgtgtaaggactgacgcgatcacagacttgaaacccttgatagaacgactggcatggagtaagcattcaacagtcataattaaggtcattgtgatgattacacttggggcctctccattcaccatttgccccaactgtgttcctgctgcacttgaaaatgattccagctgcctctggaagattttcatcccatttctgggaaaaacattagccaataaactctcattgaatttggcagggcgggcacaccagcaagctgacactatgtgcatacaggcttcctggaacaactgttgctgagcaaatgaagcagcatggaatgttccgggaagcaggattattgctgtagctggtgaaagtgaactgggaaacgcactccaggtcctgtctttacttgcacaattacagtcaatccccaaggctgcttgtctcagcaggatcagcctcttcctgccttctgtcctggcagtgggtggtggggctggaggaagaaatggtgttttcctccctctcccattgcaattgtttccttacagtgctgttctctgaggccagagaacagaagggctctttccagaggcagtttaacagagtagcttccttttcattctgagaagtttggagtttcccagagtccacttcctccctagaagcgcaagcttggaatttcttggttgccaatgaggtgccagcttctgagtgcataaagtgtgtccatcgtttttaatcaattctctcatctccaaaaatacctttaattgcctttagctgcttagttctgctgtcctctaaagaaaacaagatctggccactcccagccacacctcagaagtgagtaaggcttttgcaccttttaataggagtatttacatgtgtgtcggtttctcatctgcttttaatttcattagagtgtgattttggactgttgtttgagatgaaagagcagattatcaaagtgcagatgattttttcatggtgcaaacacatcataaattagaaactatgagacccctttgcagcggggaagactggggccagtcatccaaggtttcatcttcctgtaggagaagggaaaaaaaacggacatttattaactatctgttatgatccagactctctactggtgctttttgtatatttattctctaactcccatcaacttctctttgagagaggcagcaaatgacaactgaataaatgaatggctgaatttcatcagagccagtttacaggcagagaaactgaggctcataaagcggacgtaacctgcctgagatgtctcagcttttatatggtggggctggaattcaattcagagctccttctcccttttaacactacactgcaagttcccattcagcttcatgggattaatcctgttcttctgtccctagaatggagccttgaaagttcaaggtgtctccttttcctaagaaactggatttttctggctccttgagaattgaggagctcaaaacaattgagaactcttgggaggcatcttcaggaaaggaggtggtggaaactttcctctcctcactctccccaggggcaatggggcctccaaggccaccaaagatcaaggtgccaggtgggggatgcctcccagcttcccattcatttttcagttgggggccactcagcagctcctcaggtgaggattgtctcagaactgaagaatggttcaaattggcccaagatgctgaaatttattgcagggatcactgggacagtgtgtagcaatttaggaggcttctctctaagggaatcagtagctgctgcatttctcttaattgaaaccactctttccctccagcttcgatggggcaggttctcatatctgcgtgctgaaaggcgtttatttggtgtattctgagagcaggatgctggtaacactttcttttgtgttttgccaattgtttctttttactggctagtccaccctgtctgacgcattcattataccataaccaccttgacaccagagtgaaatgccatttctctgcaggtaggagagagtcacacggattccttgagtgtttgtagcgtaagtgagaaagatatgtagccttcttctagaggcagagggatgggttggctgggacttagagatattcaaatccaactctgttcttgtctgataaagtaaacgaggcctctgaaggtaaagtgacttctgtaagtactcacagcttatcagtaagaagcctgatattaaaactccaggtcactagaccttcaacctaatgttcttcccactaaaccaagttaacatttattgtacaccatactaaatggcagacactggggacacaaagatgaataaggcatggtcccagtggaacccactttggttatatgggttaggacacttgaggcaggatcctccttagaatggtgttttataaagtctctctttctctttctctctctctcatctctctccaatctatcctctctatcaagagagaacacatgtaatgtagagtgagagcccatgtattggataattaggcttctggctcctaattatcaggaagcctggaggtcttgagtggttgtaaccaaggatactgaaagtggttgaccagttaataaagaattaagttagagtaagaggcactttacttttaagctgcctttaatacactttaatctttgagatgattggctaatatctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgcaatctcacaatacaatgagggtaaatccttgcaatcaccagttaccagcaattgtgaagcaatggatggcatagatgtcagggggtcaggagagccttgcaagcgttcagagggcttgggagtggacacatcacagttgcactctgctgggcagcgctgtaagtctctgattggattttgccttgaattttttctggtcaagactcagaaaggatggatgtagcttcacttacaccaattctacccagcttgtgacccaaatggaactcttatcccttaagccaggtcattcagttgttgtagcctttgccttccaagtttcccttgtctaccctactgagtctgaattctaaggacatcttcttatggactgtgggaggcaaagatgaattccaaatcttatttaatctgtgtgctgggggggaagaggagtgtatttccttttgccaggtatctgagcctacaaaaagccccataaataagtaaaatgtgtccatgagttcataaaagagtgagccttagacatacagaccacctgtcaaaagagccctgtcattctctattatattatcctcttttattttctgtgtaacactatgagtatctgaaattaccgtattcatgtattaatcatttacctgtatactatatcctcactctagaggtaagctctttgagggcacagatcgtgtctgactccccagcccccaagattgtatctggcttgtatcaaccatatcatagggaaggtgctgtgaattgacaccttgcaccatgctttatggaaactaatggtgctttaagaggcacagatttcatagaaagagacccagttgttcccaccctgatggttctaggtctaggtctaggtcaccaatgtctatggtgaaagaatgggcttttgcgaggtatggtctcctgtcatgtatgagggtcatttatttaagggaaaaccaagaccttattttctttgacaactgcacacaagggtcatttgtaatgtccttcatttccaagcctctggatctttgcatggatcatgctccttaaaagaaggaagttatgtttggcctgcttcagctaagcatggaatggtaaagattttggtccaaaccctgtgacttgagttggatttaaaagcttgtcagaaatgagttctctggagcttggcatttgagactggcatccgttgttccagatgagatttcacggattgaaagctcaggaagaggtgtgaattacaagcaattagttcacagggcagttggaactgtagtaatcctggaaaccttttggcccacattttaaaaatatccccacaatccagcttctccctctgtagggcttctgcttgggaaagtttgtgtaactccccaaaacatctgaagagtgaatagcagtagtgttcttggactgcgaaggagaccctgcttcttatgtgcatgctcttgtgcacacagacagaaacacacacatacatgcacacacacacagacatgtacacccatgttcgctttagcatctgatagaaaaagaggaacatgaggaaagacagagattgagtcaccaacatgtgacctggtgatttctgagtcctctgactttgaaatcagtggaaatttagagctctactttgtcacttgtaatgctttgttgttgcaaataaatatttttgcagctgcatcacttcattgctaatatatttgaagaaggcaagataacctaaaggcatgaatcttgttctgttttaatccacctgtaagtcagtggtggttgtaaggtaaattgtaagtaagagctattggccaccaagtgccaagggttatgaatgatttacctttttttttttttctaaactgaaggaaactcatggttgttcctagaaaaacatgcacactcacttgcttgcattcggataagcttctttgagtaacagggaagaggccactaggattacaaggcagttagtgcccattggagtgtgactggcattgtgcaccctgtgaatcatagtggtggtatggggaaaggggtaaaaaagcatcaatctatggagtatgcgaaccagatggcatctgtcctgggaagaacaaatatccttcataggagaattagaggactatactagtcaggcagaaatccagtccattcatcaagcttttcctcttgctgtggtccctacagggtcagccctgtttaggctcaagcctcttaaatcccagtgcaagaccaatttctctatgaaattctccctgtcttctttggtctcatggctacttcctgggaggaaaaagtagtaatcagctccctccccccagctaaatgtgcatggtgttagcaaattctaacccaagatgttaaaactatctgagaagaggcatgattctgcttcttgtctgtaccctcctaaagtcaaggtgcagcaaggagagagacatttgcatgtggcccctgagaaagaagagatttgtctgcctcaccccctgctggtgcaaacttgcacctctctcagcctcagttttcttatgtgtatcaagtttcaatgatcgcaatagtacttatctcatgtgactactgtgggattgaaacgagatagttcatgtgaagtaccgagcacagagcctggcacacagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaatgggggtgattttttgacttctcaaggtatagcatctattaaggcacatagactacaatctgacacaaattagcagctccatacattgcagaatcttttctttttcacttaaggagatgctaaaagaggcaagaggaaagaaaatcaaatttggagatgccgtgggctgtgtgttgaagttgggctctggtggaattggtggtgaccttttgcttctctccatctggatggctgtatcttcaaagacaacaagtcttaactgcagtttttgattgtataaatctggccaagtccactatttacccagcccagtctccttagagtaggattggaaactcaaactttgctatctcctctgcagagtgagcaagggacaatctttatgaaaaactttaagttgcaagatatttgtgttcttaataatgaagggaagaatacaaaaatgataatactaagcctggctcatggatagcatttttgcacaatatatttcatttgggctgcagcctttgagctgtactaattgctctgagcatctgtttgtatgtccgttgcatgggatgatttaccctcctaggtttccaaatgctttggagcccctggtttattgcaggacttactaagtggtggccatcgtcactttgattggcccctaccacagtattttccagacttttccaccaaggctcttagggctttgtggtgggtgccagaacaattgatggggtagggtgggtgctggaagagaatgagcatctggtagattgagtctctgggtctgcccttccaccctcactccagcccccattagctcagcttgattttcaaccacttgaaatactgtggttgtgcctaagacatcatgtcagggagagaaagaaacatctgaaaaccatcaatcttctctctgaatgcttccactggtcccatttgcctgttgacaacccaagttgaaaaggcagcaccagaggggaatggggaaaattagcagaactggaaaatctgagttgagatctgggtttaccaaactctccgtaagactttgagtctgtgaaacttatgtccattagtttcttcaccttttaaatgggtctgtagtacctaccctctgggcctcacaggctgcttttgggtgtgaaagtgctttataattggtgaaggaaactgctacgtggcaagaatagcaaagcctgatgtactttaatccattcggttctgctgagggtggagccccaatgtgtcttaattcatatgaggtttctgagaagctttttgagattttaatactgtcccaggtatgcacatcaaccttctcacttttatcccccaagctccaaaatttcataactttttatttcatcttgggtggcaggaaggcaaggtgtgcctgggggagctacagggagttattcaaggtcacataattagcttataattaacagagtttaggctagaaccagtgcatcccactcccagatgggggcccccggcttatctcagcatgtcagcaacccatgaatcagccctgaaatatagatattacctatgagtaacagtttctcatcctacctcaactgttacgaaagtcttccctcaaactaaagctaagcagttccacaaaatgccagctatagacattagcagaaactgtatattgattaggtgatgtatcagtcattgtaactacccagaaaaaaaaatacaatgacaaaaccaagtggcccaaccttattttctacttgcaagaggaaaaaccctatttgggccccaagatgcttttttcatttcatttaccacatcctgggtttgtgctagtcaatctgctaaatcaataagatccgaaaaagcagaaaacaaagatcgtgaggccagaggatttcctgatcaccatggcaacacacaggggtgggtactgtggtttctctgcctgaagacgcactcgtcaaagactacttggtgttacagaattctggtgcagtgaagcaacagttctgggacatatactttcttttgccagaaagactctgttggatccaggaccaggagtggggggttaaacagttctccataccctcacctccaagtccccatcatcccattaggagacagggacagtactgttctccaaactctcaaaacaacccaagagctttctaggctgtgcattgggttgatcatttggtggccttggctgaagggccagggtaacagctaggagaacccttgggattcttctccaatgtgacaggcccctccatgttggttcagcgttgactgccatgacaggctccaggctccacggaaaaaaggcagagaaatcagggggtccagccaggcgccaagacgttggggtgccttgcatttctaagtgccaagtgatgaatagctcagttgaaagcaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccaggagcccatcacatgggcatcaggagatgggggcgagtgatgtgccagccttctagactggcaggcctggggggcagcagagggcacaatagctagaaagactcccagatgaaaacttctgggctttgaagccttcgaacaaatgaagaagaaaatgacttcttcgtgtcctattaagacagtgagttgtggcttttttgagagcagcttgctcagacctcttatgaaagatagatcagtagcaagagcactggtgtaggagtcagaaatctgcaattatgaaccactgagttttgtgtgtgtgtgtgtgtgtttttgtttttgttttttgtttgttttgttttgttttttaacttgctggaggaccatactcggctatccttgattttattttctcctgtgtcacaagagaaattggttagaagcttcccattgtgcctcctggctttaaaaatagataatccaattaacaataatgctttaaaacaacaaaaccttgtccttttcccttcctacttctgatcagaaccagctcagtaagatttattagttgtgcaatctgttttggacatgagctcagcaaatcagaggacagaaatagaatcctggctttttaatgataaacactgtaaaaataaaaaatttggagagcttaccagtgcttctggctgcccaagtggtttgtgtgtggttgactcccaggagctcaatcactttgggtgcagtccacccagagagctatgttccagctacatcaacctggagccttagcttggtcagtctagatttttgggtttggctgcagacatctcgtaatgtcacaaggacagcctgtgtccttggtgacccaaccctgggccaaccccaagtcctggagtcctctcctaagagccctgcctaattgtagagagagcattcaggctgtaaagggcaggaggcctgggggctacgactaggtttgggctttctaaattcccaagagtatgatgggaagaccaacaggcagaatcagagagaagcagtcagcccactgctggggaaagccagtcaaggtcaagacttcagaatctcctctctggagagagagtgaaaattccattagtgaagtttgttccactgaagccttaccaggccttggtaaaggcccctatcttgtggtccagaatcaagggacttctgatcttaaaataatattcaataagctcaaattcttctctctagggctctcttttcatgatcacctctccacactttattaaaaaatcacatgaagggtaagtgggcttcctgtcatttcagtgtctgacctgtgcataagttggaatttaacactggaaaatgatcagccagattgcccagtctgaaacccaggtcccccagtgactagcacaagttacttacatcttctcaatgaatcagttacctcttgtgtaaaatggggataataaaaatgcctgccacacaggattgttaggaaaattaagtgaaatattaggtgtaaagtgctgaataccttgaacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtctggagaactgacagtgccctctctttgggcatagtatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaattctcagcaaacaccagctggtgattcctcagatatgatgtgggaaaggaacctgataggtgatctttttgcaccctataagactgcagcctgtcgggggttgggggcagaaagagagcatttattaattcattatttcattcaacatttgcctaccatgggaggctgtactaggtactgggaatataattgtgaagaagggagacaccatttctgttgtcaacgaagcccacagagaagttccaaaatttcagaatgctggaatttctggttactagagaccttgaagataataatttcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatactagtaccaggccactcacctctcaggaaagtttgggaagacgtagataatggcaacttgggtgaaaattacacagtgctctcttcccagcacatgttgtgattttctacaacttcagaaataactggggtggaccaagaagctattattcctcgcaggccctacaatctaggcaaagctttgaaatgtgctcggacaattttatcagagatctattttccttgatctgaggcttagggggcagtatagatgagattaatggcatttgggatcagtgatggtttatccaggagagaatgcatagtacctgtaaccaggagcctgaataggaggcaacatagcatagaggttagaatcctgactttcccacttggatgacattgggcaaaggacttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagtaattaacaacctgtgtcacctaaagtgagtggcagggtcaggaattgaaccaggtttgaggaggtcctaactaggttgaactactgaccttcataaaagtttggcactacagaccagctttataggacaaaaaaaccttctttcagagctcctttttctcgccttcctgacagctccctagcagacctcttcccatgtgggtagggagataaggttcctagacactgggacactggtctccatgacccctctgtgctgcccacagccctatagtaatgagcgtgctaaaggcctggtggcatttctaccacgggaagtctcctctccaaatccaaaagtggcctcaaacagtcagtgttttcagttgagctcatttatcgctcagagggaggcacttgggacattttattcattacatgatgcaggagatttattggagaccagagggctcaacggaaaacattcttggtttatttccagccagaaaggcttgtttgagagatgcaatcagccatttagtattagcttcttgaatcaaagtggatcctgaatcacagagttctctgtttctcaggagagacacacagacatctgaggagtcttgcctctctatagtggtttgcagcatggctagcaccattgccagagacactggcactctgtcaagcaatgttctgtggtccatggctattcacatcttaaccttgccttaattctacttcattgtgagtttgggcatgtttctttatttcttcccctctctgtgtgttagtttctccatctggaaaatgaggatactaatattacccacctcataggaatgttttaaggataaaatgagtaaataattctaaagtgcctaaaatagagcctggcatatacacaatgaatgcacaataaatattagccactgctcttgctgttggcattattaatatcctcccgggtaataatttgggtttgcgttagtatcaaggaaacctgatgaaatgtcttcataaattatcagggtttgaatgacacacagccttgaaaatgttggctccttttaagtcaagagggacctagagtagaaggattgtgaacattcacaggatagttgaccagaaatgaagtatttgacaccattcttgcaactcctaagtagctaaatagcgtcagggttaggagttggactttctcatgagatcaagataaatgtaagctgtggaatttttactttgcataggatttcttcatccaatcagcagccctttgcagatacctacaatgtgtcagaacctgcttaagccttcacatctaggaaggctaaaggttgagtttgtctgtttcatcctgtcttggctgatcacatgcacatacaaccacacactcacttgcatacaaacatataagtatgaggagaattcaaaatgttcatggaaaaatgagattaaaagataaaagtttaaagatgtaaactttacttctcaacataagcaccatcacattcaagatactgttataagctatgatagcggccatttagtccatccctaaagaactgagggtcctgggaatttaatcacatcaatgcaatctttcttacattgttaactaaagaaaaatgggtgccctttgaagatttttaaagattaagtaacaaaaaaaaaaaagtcagaaggagtcaaatttggactataaggtggatgcctaatggcttctccatagaaattctcaaaaaaattgcctttgtttgatgagaataatgagcaggagcattgtcatgtcatgatggaggaagactctctggtgaagcttttcgatacattttttcttcaaaagcttgggctacctttctgaaaacactctcataattagcagatgttatcgttctttgaccttccagaaagttaacaaacaaaatgccttgagcatctcagacaacggctgccatgaccttggctctacactggtccacctgctttgacttgtccacttttgctttgactggaccacttccacctcttggtagctattcctttgattgtgctttgtcttcaggatcacacacataaggccatgtttcatctcctgttataattctcaaagaaatgcttcaggatcttgatcccacttgtttaaaatttccattgaaagctcagctcttggttgcagctgatctgggcacaatggttttggcaaccactgagtggaaagtttgctcaactttaatttttcagtcagatttgtgtaagctgaaccagttgagatgtctatgatgctggccattgtttctgctgttaatcattggtcctcttcatttaagtcacaaataagattaatttttttctcccaaattgatgtggatggcatatcgctgcaggcttcatcttcaacatcatcttgtcccttcttcaaacaagttatctgtttgtaagctgctgatttctttgggacattgtcctgatgaacttttcataaagcatcaatgattttttcattcttccacctaagcttcaccaaaaattttggtgtgtgttcttgcttcaattttagcagaattcatgttgctctgagagaggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgtcagtgaagttatgttggcttctgaaactcaagggattttgctgaaactcatgaaactcaagggattttactgaaaagtctcagcctcaattggttcctcttacatttgcatattctgtctgccaggtggcaaggtagaattgactgtaataagaaagaaactaccattgagctccaattattgtccatgcctcagagttgatttttaacctgagagtgacagcagccacctgggccaggggcagacaggtagtttgcctcacctggaatcagaggctcccctatcagccttatcttcaagaagctgataggaatgctttgtttttcttttgtgtgctggacaaggagaggccccggaaggtctgtcatgtagattgacagtttccttttgtaagactggccaactgaggccaaagttgaaaatgtcagtaaaaacaaatagtattgcaaaagggccttatgcatttccttctctatcctctcattgccccatcagccgagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttatgtcttttcaagttccatttcttgtttcttcttttactattttcagaatcaaggaagataatacagaattttaacagttttcttacctcattttgcatttgttagacattgtttcctcgtggttgagacctgcttcctgctcaggaaagagaaagcagtggttgcccatacaattcaataataatgactctttgtcattatttaacagttgtttaggtgtgcctctctcctttcttcagttgcactaatgatagaaaaggatccttgggcacatagtaaagtggttcaaatcatgggtttgggtggtaaacaggtctgagatagatttcctgctctgccacttaagagctgggtgacgttggggagtcatttaatttttctgagcttcacccataaataatacatacatacataaaactcacctttcaggtttctgaagatgatgcaacacagaatctcaaaggtactgggtacccagggacactgcagtaataggtcccctctcctattgctgtcagctcagaaatacagaacagagcaactgggattcagaaaggagactataggctctagatagaggtactcactcacttccttgggcaactcacttccctgagcctcaactttcttgttggtaaataagtggaatcttcctacccaccactagaactgtgcaaggaagagatggagctggttaatgccagttctgtctgattccagacctggttcttaactaacaacaaggagtggtgcctggccaggcacttggggcattgtcccaagaggatgtcaacatgtcttcttagagaaggacagtcattgaggcctgaggaagtgttcaggaggaataagcttcaccaggatagtttcaatgacttaaccctttgcatgcagtttcctcaagtgtaaaccgggggtcatatagtcccaggagttttcaattacagcctttgaagtcttttgagattgttacacaggatcaagtagaagaggatgatttctagctctctattggaatttcagattaatgtctacaaaactcactaaagtccttgtattgaataattctttacccaactgatagcagttaggcttcattttcaatgccattaactctgagagcaaacgacaggcttttggtctgccaatatattaaaagtgtgtttctgaggaaatttcaatgagtcattcgtttatataacaaatacttgttgagcatctactttctattgggtactgttatagggattagagataacagctgcaagcaagtaaaaggcccttgctttctcagagctttcattccaggaaggagagaaagagagtaaccacacacatcaatagatgaccaggctgttgtgaagacacaaaagccaaatgagttgagggagagactgggggttagacaagggtgtttagggaagcactctaaagtgaggtgacgtggagttaaaattctgaatgataaaaaaaatgaaccacctatgtgaccatttgaggatggaacattccagacagagaggaaggcagatacaaatattctaggatgggaaggagctcagaatgtctgagagaattgaagacaagctttgtgcttagagcagagcaagctactttgaggttagagagggagccaggagccagattatgttggttttagccataataagaacatttatactgggtatgaacataaactcttggaggttgtaagccagggagagatcacttgattgtgaaaaaatgctcataacataagattaagtggaaaaatgactcttaaatctagaactgtatattcagtaccatttcaattatgcaagcatatgtgtgagtatgtatatttgtgtgtatgtgtgtatgtgtatatagatacatactttatgtatatatgcataaagtacgtgtgtgcatgtgtgcacgtgtgaatgtgtgtattcagtaaacaaactggaagaagatatagaaaagtgtttgctgtagtttttgtagtggtggacttattttccttcattgctttcctgtgttttgtaagttttctgtaagtttgtatgacatcaataatcaaaattaaatcatttgctttttaaaaactttgttgcagagcaatcaatggagagaatgtaagagtgatattattttaccatgtcttttctcagatttgagcttaatatcatggtgctttggaatgctggagtgaattttgaaggctctggctagcagagaagtttatttggctttttgtttgtttgttctttttttttttttttttttgagatagagtctcgctctgtcacccaggctggagtgtagtggcatgatctcggctcactgtaacctctgcctcctggttcaagtgattcttctgcctcagcctcccaagtagctgggactacaggcatgtgccaccacacctgactaatttttgtatttttttttttttttttttttgaaacggagtcttgctctgtcgcccaggctggagtgcagtggcgcgatctcagctcactgtaagctccgcctcccaggttcatgccattctcctgcctcagcctccggagcagctgggactacaggcgcccgccaccacgcccagctaattttttatatttttagtagagacggggtttcaccgtgttagccaggatggtctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgactttttaaggagtctgtcctaaactgaacttattactgtctccaaattatttatgcaaaagaatctaacatttctatttcttcccatagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaacctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctgagagggctcctaccagttattctagagctgcatagagccttcctcaaactatggctccaagcaagataatcacaacaagcaaggactttattttttgaatttccaatggccttgcggtaagcggtgcacaagaagagcaagccacggtggcaatcacagtgaattgttgtggttcgatttgttttcactagaagaggactgagtaacctctgcaactgctctgaagtttctaccccagcctgtagctgtgcttttgcagtgtctttaggtaatatgattcccctttctctgcaacacacactcacatgcacacagactgcttttgaaaagtcaagctgcagaactctacggaaaccatgaagtgtaagttaagtgcttctatcctccaacactggttacagtcatgcacccacattatgagtgatggctgagactcttgctgaaagggaaaaggaaagtcttttgcctaaaattgccctgtctgatatggtagccactaaccacatgtggtgacttacacttaaactaattaaaatactaaaattaaaactttagttcttcactagcactaactacattttaagtgctcggttagtcaccgatggccagtggctactgtactggatgacccaggttagagaacatttccatcattgcagaaagttctattgaggagcactgctctaaaataaagagcagatgtacatagacatctgtatgtgttcagagctaggtctgggggaatatgaaaggagcagagagagggagaaagctctggtggctactgaacttgcactgtaggatgcaatgaaaaaaggccatttagcaaatccattattctattcccaaggctaattgtttaattatggccctgactaggccactggcctaagaaagtgaatttagtaagctgaactttgattgtgaaatacaaacaaggcatacttgcaaaatatagatatgctgccatgtgctgaggaccaggggagttcttacaactgccactggccaatcatcaagcacttagatgctgggagccctactgcccacctggccaaacccctcacttaatcctcaaactgcagtattggtcaatattatcacctcattttatggatgaagcagccgaggcttagcgaatttgcacacacagcctgcctatggaggagttaggattctggttctgcttagcctcagcccaggacaggattttaatgaccaagtcctcctcaggggcttaaaaggggaggaaagtatgcttcctggatttgctgaatattctttcctccttgtgaacagtaacttactcatgccacatacacacatataaactttaatatccccaatttacagttagcatgacccataaaaccggtaggcaacatgaggtggcaaaaactcagtaatagcttacaaagagaatgcaatagattctagaatgttggtgttatccatacttgatgacatgatgtgatgggggtgagttggcgggtaggttcaccaagaagtattatttagaaaaactgtgccaaagaaatctatcatttcacccataactggtattaagtattgcaaaactcatttccataatttctctcaggtagctatgaatcagctttctgccacaggacagatggcagagtctcatgggttaggataaaaccttagcagctactctcttttgtctgccccaccctgattggtagcaactcttagatatatgaaaacttattaccatttaattgtgcccacaccccctgccaagctaaggaggctttggggaaaccagtttgtctgttcagatgagaaattagtcatgcgagctacaattgccacataggtaggagttctgtgtgcttggaaacttcagactcacagacatttccatgggtcgtgcagggtgatgcactccatgctgttgcccctggcaggaaagatgaaaagcatcaatgtgcattttagccagaattgcattttgaaaaacctgctggatttagcttcctcctctctgccctcctgctgcaccacagcttcccttgcacatggcattttctcagcccacatctcattttttgaggcattttatattcaaaaaaaattgtgtttttagcacaattaaaaaataagcaagtttttagccaccaggatgctgctagaagaggctgggctgtgtatgttgtatctgtatgtcgtatccagctgtaacacactcccagagataccttggtggggagagaggggctatgcatttctctggctgtgctacttctggaaagttcctgagctacatgagccgttgctatctgcttacttaattgctatgactcccattgtaatgatggttaatttattcccactggcaatagaattatgcctgcaatgctcaggaggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttttctcttacaggtatgggttcatagaagggcacgtggtgattccccggatccaccccaactccatctgtgcagcaaacaacacaggggtgtacatcctcacatccaacacctcccagtatgacacatattgcttcaatgcttcaggttggttctcaggggggtgtctgttggcgtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaacaaataaatattaaataccattcaggactgtccaatcttttggcttccctaggtcacattgggagaagaattgtcttgggccccacataaattacactaaaactaagagtagctgataagctaaaacacaaacaaaaatcacacaaaaaaaatctcataatgttttaagaaagtttacgggtttgtgttggaccacattcaaagtcatcctggaccacacaaggcctgtgagccgcaggttggacaagcttgccctatatgaagtctgaaagtgataaaagtgctataaaaaagaaagcaaaatacgaggctaatgagtgctagggatgcttttattttctgagaaggtggtcagggaaagtgcctcctggactgttctgagaatatcagtgctcagaagggagaatgccaaggaataaagtcagagagctaagcaagggccagctaacggggtgattcattctcagtgtgatgggaagtcattacaggttttgaataagggagtgacatgaatctaatgatagctttggggtgtaagtcaaatgtcttagctgagaggtatttattatatgagagggctggaaaaaagccttggagagtatatggtatgcctttgaccttcttaaatatcccttacccaacagttgaaagaaccagagaagaagaaacctaagttaagatgtagatgctaggacacaggccagcctttctctatgtctttgtgactttctcccaaccattaacctagaaaatcaggcttatgagccttattcaagtcctagcaaaattaaagaattctatgcatcatgaattttcagaattttttgagaaggatcaaaatataaatgtcaaatatctcgatgccaactatcaaaagtcttacctcttaaactgggccttctgttcccatggaaggtttgaagttgggtgaagggaaagatgaagccttgaggtaaacttggtacatcttgctggagtgtcagttttccctaaagatgtgaaggggatgttaaattagctggaaagggacttaagacattatcagcctgagacaaacacagatatatacatatacatatatatatatttatatatatatttatttatatatatttataaatatttatttatatttatatatttatattcatttatataaatttatatttatatatttatatttatttatataaatttatatataaattatatttatatatttaaatatatattataaatatataaaaattatatttatatataaatttatatatatatattatatataattctatatataatataatatataatatatattatatattatattatatataaattatatataatatatataaattttatatatataaatattatatattatatataaatttatatttatatatatgtatatatgtatatataaatatatacacatttatatatataaaatcaagatatcacagatatatataccatatacatcaaatataaatatacatataccatatatatggtagtaaaatataaaaagctgcatggatttttaaactataaaaaggacatcaacttaattatgagatctttcttctactcactactaaaaaaaacccaaaaattaaaattaattgtgagattacatcagtggctttagtctacaccacctaccctttgttgtgtgaacagtagggatcagagtggaaattcagagaagaaatctagagtttaggacaaagtatcagggctggctagttgaaatggagtgcgtgaagccagtagattttgacaaaaatttacaggtcactgaatctatcgagagacatacgaaacaggaacagaaaactgtagaatgtttactcctccctgttatatgagtgaagaacacaaatggagtttgactaaagggaagggagtccaattaacactaagtagtacacgactcatacatactcagttcccatacccatgtctagcatgtcgttctaatgatattataatgagaaaaccacatataaaaaagtaagaaatagacatagagcaacatgtggtctagctagctccatctcagtgcaacaggtcagagggagacattgggaaaagcttgtgctttagatgaagaggttgactcattgggaaagggctggcatgaggctatacactcctgagtctctgggcactgcttattgcatctcccattgagtcttgctgagtgaatgtatgcaataaattatgtagttgcatacccacattgtcttacctgttttgcaagttggtttcacttgctaaaaggaacctcaactcagatagaagctcacactgttttattgcctggcatcgaagccatctaggcaggctgcgactgagacttgtttctatccttaattttgttcatgaggttgggcccatacctggagttgggagcaagagcattgattaattttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaaaaaagaaagaaactggagaagaggataaatgtgtttaaggataaataaattctgaatgtcttggattagagtcagatgataggggtattaagtgagctaaagattttgataaactgccctatgcaaagatttcattgcaaggatccctgaatctaatttagcctgaaagctgctagcaggtggtcatgtcccagtgctgtgatcccccccataaaacggctacagggataaaagtcagcttgatcttagtagatagcttccataagcttaagttttagcagtatttttagaaaacatggcctgtggctaacaaatgaaaataaggcagaacttgaaaaggcctttgtgattttttttccctcattttcagtggttgaggcccaacgtgagcctggtgacttctgtgtgaacacagaactgacttgaattgattcatttattaagcttgctttcagtcaagtgcctcattttcttttgagggtagaattaaagggaagattctacatgtacttgtttatccatttcctcctttattcaacaactatttgagaatatttatgagatacctaaaatgtatcaagcattgaagagggtgcctttctatctggcaaccagagattagtggttagactgaataattaatgtttctcttggttattttggtgtgttgaagccaaggtttatgagaaagcccacctcagagaatttctaacaagtcctcagattcaggaacacctcaccaggtctagctttccaagcagtacagagctcattaaatggaaagaaaggctatctaataaggccctggaatccgacatgagagcatgagtctgttaattgcacatttgggtcaatccactaagcatatttgccagatttgatgttctttataaaagttaaggtgaattggagcatgaagggggtccatgtgaacaaatgctctaataatttacaaaactgtcttagggtttgtgacatcatgctccattctattacaacttgctgcctggaaattcccagtgtactgttacttgcagttatatttgaagttaggggagattgtttcatccctggcatcaagaagccataatccaaagcctggttccaggtatgcacaacatacaaatatcagaagcatctcataggttgcgtcagtttctgctgatatttccaagagaaacaagatagatactcccctaaatctcccaggttggctatatgcccttattttcaagtgtaataattttggaaaatatttttgaaaactgtaaaaagctaaattaatattaattattacagtcccccatgaccttgtgagtttatcagaagcagggacagaaacatgctcatcttcttttctccttttatatggtctggcatataagtgttgagtagatgcttaaaaataataaatgaagagttatatctgtaacttcctttaattatttcttatggcattaccatttaaggataatctaaatgcgtgacctgtacatatttggagatgcatttagggggctaacatcttaggtgtgtttactggaagaatagacccttgggaaattatatcggtacttttttcttttttcatccattcaacacatttttattgcatgtttctctgtccccatcacacataaatgttctggccaagacagataaagttattactcatctgtggagcttatacatttctagggagggaggcaggtagcagaaggcagagattgagagaagtgccatgaacagccatcaagtaagatgaacaagataagtttatatggtggtaaacatgaagaagaaatgagagcaagatgctatgtgatggtgacaggtgtgggggagtgatgaagcagtttagattggatggtaaggaatggcctcgccaaggaggtgatacttctctttaaagaaatctgagaaatcttttaggacaggctttgcaagaatggtgtttcctaaaactttctgtttttttccaattgaatgtataaaactgccagttagttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcaggacacttaaaatacttgtgataacagcctttcttgtgatagcagtctgtctgtctgcctgcctgtcttcctccctccctctctccatccatctatccatccatctccatccatccatctccttcttcctctttgccaggagcaattctgggagaaactaacctaacaaataaatttccattttaatttaagtatgcacacacacacagaataaaagctgtaatgcacaaatggacttaacctttctataaaggcaaaaccagtttaaagctctctgaggttttagagctcaatacaaggtatagtcacagaataaagcactttggcatgaatagaaggttgcttcagctacactgcagtctgcttttaagacacaaggaatggaatgcagggtggaagtttcagggcctgttatcagaccgcttgagacagtgctgctcagagggctaccagtaacatctgtggatgatcagtcaggcccaagattcaggcagaaatctttattcctaaagcaagggatgaaagagtagaggataaaacgagaacaagagaaaaaaaaaaccagaaatgcccatgatgagatatgccaaaacagtaaccttgaaaaatattctgggcacctaggccaaaggtggtcaacctcagaagcaacatgctgagaagcagtctatacagagtaagcacctaaaagatcagctaaattaataaatacattattacattaatgaaagactagagattcatttggtttttaatatttcaactgagtaaattctttgttgtgattatgttattttaaccttcagattgtcatgctgttcatgttgataaacatttgattgtgtgtctgccatgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggagtttcggaaaaagaaagttatttggaataagttatagtaaaactccattctaactgactaataaaaatgagggtagattttcctcatgtttttaaagggttctcatcctttttttcctacctcatagctccacctgaagaagattgtacatcagtcacagacctgcccaatgcctttgatggaccaattaccataagtatgtctctcttctaatcttaattaaattttcctattttggggaaagggctcaggtgtgttctctgtggtatatttgaatagaatattaggccaggtgtggtggctcactcctgtaatcccagcactttgggaggctgaggtgggtggatcacttgaggtcagaagtttgagaccagcctgaacaatatggcgaaaccttatctctactaaaaatacaaaaaattagctgggcatagtggcaggtgcctgtaatcccagctgctcaggaggctgaggcaggagaattgcttgaacccaggaggcagaggttgtaatgagctgagatcgtgccactgcactccagcctgggcaacagagtgagactccatttccaaaaaaaaagaaaaaaaaatattagtcatttccctaagactaagtaaggacagttggctttaattcagtgtcccttcctttttttctgcaatgacttgaaactgctctctggtttacactcatgcatcgttcctcaaacttcagtcatttgaaaaccactttcacattttttttggcatctctatatgtacaatgctctcatttacttgatatttttatttaaatgatccactgttttctaattaaaatacacttatttttaaaaagaaattgcacatggaaaaccaacatcacatcgtaaatagaaggcaaccttaataataaacttaaatgtaagaaaaattaaataatgttcttaatttgcagctgctgaaagctctgggtctgagtcatgttctctcttataaagagggattaataagtgtcaggtgtaggggcattttggccctaattagcaattttctgtttgatataactgaagtattgaaagataatcatgaaggatataaacttcctgatacgtgttttgacattgtttataccacatccatcttaaatcatcctgatatatgattatccacagatgtatatattcgggcactttttaaaaatagacatgggggtctcactatgttgtccaggctggtcttgaactcctgggctcaagcaatcctccttcctcagcctcccaaagtgccaggattacaggcatgagccaccatgcctggcctattccagcactttagaaatcagaaaatctcaaccagaactttcaaataggctaactgctaaccctgatcttacggcctctgagcttcatttaatgggaaacagtacagtgttgagaggtctgatttctgcttcctcacagctggatactgacagtgtgcacaggcatgatgttggcagtggcagagggatgagaatcttcgtagaccatacaaacccagccccacattgttatgtaaggaattgtccctgacctgtgccttgcaataggaaggggaggcttcacaccatgatggctacgacatgagatgtgctgtctcagcaggcctggtatgaaatcctagttccctcaccatgtgtgagattttagaggagtgactgatcctcagttttctcattcatataatggaacaacctatgagaatattcaggaaatttgtaaaagacactatgtctaatgtatgtccagcccatagtagaggtttaataaatgccctgtttctttgatgcccacagttctcttttgaagtccagacatgtaagagtgtggtcaacaatatttccttgtcaaatcctcacctgcagagattaccagggtgactgagaccttgattttttttttcatttatgtattattaatagttccacttgaggcttgccacagtggctcactcctgtaatctcagcactttgggaggctgaggcaggcagatcacctgaggtcaggagttcaagaccagcctggccaacacggtaaaaccccgtgtcaactaaaaatacaaaaattagctgggtgtggtggcatgcacctgtagtcccagctgcttgggaggctgaggcaggagagttgcttgaacccaggaggcggaggctgctgcacactgagattgcaccactgcaccccagcctgggcaacagagtgagactccatctcgaaaaaaaaaaaaagtttcatttgagcaagctaaatatgtggccaaaaagaacctttagtcccatcaatgcaatacagcagaaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctggtttcctagccagaagtgggtgtttgcacaagtggacaaaacttgccccttaaaaaagaaaatcaaaatcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgaggaaactgaagctcagagttgccttgtccagagctctatgaagctaggattcaaacacagggatgggactctccagtacttccttgtttcctgcctcatccccagggtgtgtgggggatgggagggtgcactttcttagtgcatctgccactctctcccaccactggatagataggtgtttctcattacaaaggaaaatagctttgaagtcactatgttaaacgctaatccacatactcaaaatatgagctgtgaagttctgtaagtaccttttctctctcccagctattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttagtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagctttttaaaaagcagagttttcaagctgcccatactttcttgggttattggccctcttgagtttgcatcggcttattgttggtagtcccgtgggcaacccttcttgagagaggcttctgcaaaccaagcgggccgtgctgctagctactcactgcttcttgggttccctgtctttttaaagtaaccatgtcgaaggtgcttatcattatggtaggcaattttgtcggatgttagcgaacacaataattagtggtctcagcaggaaggagaataggtctaccctaaagtaccacttcccaccaaagaagaaaatcctgataaaacataacttgggactatatgtagttaacattcaaaccactaatagcctatataaaatagtatttcatgtgtgttttaaaaacacacatttcattaacccctatagaatatctcttaagaactgtatcttcccttcctaagttagtcagcaaacgtattttgagaacctactacgtaccaggcctattagaatgcttgggatcgaaggataaacatagttaggaagtaatattgaagagaggcaaggattactgagatatttattcattcaatcaatatctgaggtcttctgtatgccagacactgctctaggatgctaggaattcagagttggacttaccttcatggagactacatattattggtttagaaatcagggaaaaggagtgtttatgagatttaactaaaacatagttcaggatttgagctgagaaatgaattgtgcctttctcctcccagataaattagttaagtttccttcagcagctaaaaaagaaagagactaatgagtctaccaaatgagtccagggctaacctgagagtcactgaagtactataggacccaatgggaccagtagcagctccaagtggatcacttcatgcaaagaaacataccaaggcaaacaacctggtggaaacttgaacgtagcataatggcatgccaggaaaagtcagcactgttaggttcctgagtagaatcgtatttctaaagtccagtgaggagatttgcaaaaccttatcactgttggactgagagctgggacagagtgacagggagtgattgcaaagcctccctcatgcattgcaggagggcaggggtcaagaggagtgctggctgagagcacagaagaagcggtctttggctcggctggctcattccttcctgaagggcctgtagtgggtggcaatagggacagctagtaagaataaccatctgggtagctttaggcttccagcaggctgtttatcttgagtgtcatcagcctcttcctattggtgacctggaactctctgggatcaagaaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaagacaaaaataacgcctatttctatcttgttcttgtaggtttgtttcctctggtactattttttcctgttgtactattgggtgagggtggtgggaattatgcatctttaataaagtttctgaggtgagaatgtggtgtctgtggattttcccggggatgctcaggtttgtctggaggcttcatgggtaaaattggctcctatttctctactctctgttctgaactaatgtgtcctttgcagcaggggtgtccagtcttttggcttccctgggccacattggaagaagaattgtcctgggccacacataaaatacactaacactagccatagctgatgggataacaacaacaaaaaaagcttataatgttttaagaaagtttatgaatttttgttgggccacattcaaagccatcctgcatcacaggtggcccacaggctacgggttggacaagcttgatttagaggacagaacatactgtgccagctgttggcattttatatagatagagtcaaagtttttaacctagggttcatggaccttcagtaggttcaatggtagaccataaggcattctagaactatctgaaataatatgcaaaattttgagtgtgtatatgtagcatcacttttttgaggaaggaggacataacgtagattttcaaagggatatataatttaaagtggctttttaaaatctcagctggcttaaattagatatttatcctgatggtttttgccattccatttcaataagaaaacatgctggactcaagtcaaacttgagagtcgaatgagagattttaaattgcaaaatgttactgatgatattttctctaatttgagaaaagtctggaatttctctaactttggcaactctagtttttggtagaaacacatattgaattagaataaaaagtgacagaaatgatagatggatacctgaggaagttttatctgatttcgacactttgaacacattttctttgcaaagttcctgctcaagtatgaagtttgacctgaggctgatgcgtgtgggcggagctttgaaatgccagttgtcatcacaaactacctgggtacaatgctagacagatgtgaaaaatacacactagcaacccaaagataatccaaagataaatgcatgaaagcagtcgtttgaaatgctgcttcgaaaacctccagctcatggctcagtcgcccaatcaagtaaatagaaaatctctttccttcacaggttattaaattgctgcttgattttgctttgatcatgaattcaggggattcagtttgaagaatgagtagcatgaaatttatacccatgaggaatttgcatttctgatgttgtcctaagattgtgggagacattaggagtctggaaagataaaaccaggcctagattttcttttctaattatcattcaataatagatacagacatcatatataggcagaactgaaagtaaagatttgtagagggaatatcactaagtgatactttcataattgatccagttacttcaactgtgcactcaaacagccacgcaacagctcaggagcaaaataactagatatggtcctggtttggtaattcacagcctaagactcaggatctcacaacaacagcaacgacaggtaaactgctttgtcttttgcttatcagctctcctggatgtcagaccttttagtgttaggggagaggacgtccattatcacgtcaaatctccttcatcattcttagtgagaatagggtcttgtaccacttcatatatcagaaaggcctgtggatctggggatatgattgatattcttaaatgtcctgtatgttttccttttggcaatgtgtatatagaatcagaatgatttttccatcagaggaaggaaaaactatgaatcaatagttttgaatgaatgaatgaaattatgaaaaactacaaatgaatgaattgactgtgtgattcaatgagaaaatgtcctttagaaagaagtctgccggaaagtgcaggcttctcctttctgctgatctgattctcacagccagtaataagagaaggaaatgcagatttctctcatcaaagtgtaggccctgaacccttctttggacacttaaaatctcaactgtaaagtgtaggaaatgacctgttgctccatatcagaatctaggcctctaaccagctccctgggtgtgtggctcttagctctatatccctgcaaagtgtattgttacaggagctttggggaaaaacgattcaaggcctgtaaatatgggagattacaaggacaccctcatttattaactttcattgatggagttaatggccatatttcaaaataactaggcattctttctgcagaggggggtaataaacatggaaaaattattctttacatttgtttgccttatatgacattggataaattatattctttacttctataaataatcgtgaggaaaatagtgctcatgttatgttatggttgccatatcacaatgtctaagatcatgcaggggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaaatctaactcaccttactattttgtttggggatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcaaagaatgagactcaaaatgtcctgttctgctttgcaaaatatagtttcacataagaaattaccttgggcaaggttgtgagaggatttggaatctaaatggagaaaagtgtagaggcatatttttcaatcttctacttctatgtcattttccctgtgtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaactttcttgccaagtgatcttcctgactatgggaaacataatactttatgaagaagttcattgttggatagttcagattattggttttttaaatccaacatttggaagaacattcctcttcctgaaattttcaccacagatcctaatttggcctcatggatccagaggcaaaaaagtttaatccctcttttacattatatagactttcaaaattcaaagacggctgtcatgcgttcctggagccctcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccagtaagaataatcaattacagtacagccatttatgcaaggcttattgattaatctgagtgataccaaattgtatctctcttgagaagtagttaatgtgaaaaatgggtgaacctatgatcataccttagttatatcttgatgagattatggaagaagaaatagaatgttttgagaagtggggaaaatatctcacaaaatttctcttgtctcatgttcttcctgttttatttatctatgggatctactgctacagattgtctttgaatgatcaggctttatcagagaatgacattaaaacagtacaaaaaatgtacattgtgtacttactgtgctaggtgctggaaacacgaagatgaaaagagccagagcctttgcttttcagaagctcatggtctgttggagcaatagacttgaagaatgtgatgaggagggtattaattaaaagttgtaggccaggcgtggtggctcacacctgtaatcccagcaccctgggaggccgaggcgggcagatgacgaggtcaggagatcgagaccatcctggctaacacagtgaaaccccatctctactaaaaaatacaaaaaattaaccaggcgtagtggcgggtgcctgtagtcctagctattcgggaggctgaggcaggagaatggtgtgaacccaggaggagatcgcgccactgcactccagcactctaacctgggtgacagagccagactccatctcaaaaaaaaaaaaaaaaagttgtggaagttcctaaattgaaggccctaaaggcttaaatgatgggagctagaactcaagaattatcttagttaatcaaagcccagctgaggtcaaaggaacaaatccagagttttaacaaatgagctggacaccaatatagcagaaagaccttgaagggaagggcaaatgtcaggttagctttagcaagacattgccacttattaaaagcaaataatgaaaccactattggtacataatagtatccaaatttttgacaattataaaactttttgagaacaaagagatggaaattgagctttaaagatatccttaaaaagttaaaaacatgcaaaggttggtctaatattctgccagattactgagttttccacacatacctgtaatgacttaagattttgctgaacagagctgagaatcctgaacctgactccatcacagttctgcttttccttagaaaaaaggcttttggggtgctgtgtgagctctcccaattcactgaagttctatccattccattaaaatctgagaatttcatcctcaaatggacagagaagaaagggtccagaaaaaaaaatagcttaggccttgaaggcatctgagtatataacattgatatgacaaatactcaaaaggaactagaattttctatctaaacttttaagtgattttttttttagacccgacacccctccagagcttaatctatggaataagaaaattccttttggtaacttcagaacaaaaaccaaataatcaaaaacactggagttttacattatactgtctcctgtgttcagcatgtggcccagctttgcagatgggcccatcagtaaatacgtggtcttgatactgaagaaattaaattcccttgggtggtaacccaaacagatctacctgtaaatgaattgtatggtcaggcttcagggaaaaatttcccatggtgttggttttttttttttttttttttttttttaattttttaaatctctatggcatatttttccaatttctgcttttctttttttttcttttctgcttagcacctatggacataattcaacatgatgccctctttcttctggaggggtgtgataactgcttgataataagcactttttcaggcctattgagaatgtggttaatgattctaaacttgatttttcataacttgtaaaatagagctgacagtattatagttctgaaaacagttttgcgttatttgggtatcaaaataaagtttgaaacaattaggatggatttgcaaataacctttcacaaaacatgttgactcagattttgtcatgatccttctgttaggtgcatctcttattccagccctaacagattgggtgacaatatcagggtgctggtggatgtacgcctctttctttccagtgtgctgctatgatggtggctggttacctgtggtgtcttattttctttcactggctatgaatggcttgctcatgacatattttgtatttgatgagaataccatagtgtttgataaatattcagaaatgtatcgctaaaacatatggctattctaggtattctttttcagaatcatctataggaaagctctagctgctcaggcattcctttccccactgaaattactaacaacataaagtgattatcatggtataactttcagttatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaattgcttcaatcatcgttatcacagtttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaatagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaagtaagcaagatggcggtcggcagttctgggttagatgaattagtaaagacattccagcaatagggaagattttgtttagaaattggccgcatcttctatttccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtcttttttgcattctgtccctgactgttctatagaaagacatcccttgtactctttagagcaaagttggtagctcttatggtcttcatttgaattctaccactgcttctttttctgtttttaagcccatggtaacttggggaaggctttgatgctcttactgttatttctactattatgaaaactcaggttttctaaaacaatctcaagttgcggcagtggactgtgagaatagggggccccctcactccccaaacataagaagtatgtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctaacagtataccttagaaattattttagacagtttgtacttaaagaccagaaagctactttagagacttggaaataatgagcctattgtcaaaaggtggtgcttgcggggcattaggactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccctcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaaaaaaaaagaaattgctacaagctgctatagacaaaaatgttggtgtctttctgacttttcctgaagacaccttgatggaattatattctcttgattttgtcctttttaaaatgatggttgaaattttaagcctgtcacacactattatttatataatgcctcaaactggcttggatagttttcgtcaactgaattaattttgttaaaaagtgattttagcaattttaggtgccatgtggacatcaccaaatactgtgttagtggaatagcatccaagccatcccaccatctttcctgctgggcaaatccactgctggtgcatttccagtgtgtgcgattatgggttacatgaccaccatttgagaaggtctcctaatgtgctgatcttgttattagctgttatacagtgttttcctttcgtcaaaatgactggagcaaagaggttattctttgaatggttttctcagacagggtatgtgaagccattcactacagtaaaataaaaataataataactcatagaactatgagaattcatcagctatggtctgcttagtcctatgattttgaacaaatcaaaacttctttggaccacaattttcctagctgaaaaattaaacatttggatcatttgatttctcatatcccttttagaatatcagtggcctgtttccttggtgcctttcttttctaccttccctccccatgtgtatctgcccttaaagtagaaagatatgttgacagctattggtgaggaaaatagacaattatgtctcccaactgatattcttctcacagtccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatgggtaatagcctctgagatttttatatattatgttttttgaaatccactgagtgactgctgactatttttctagaaatatgcccttggttttagaccaaactactttcctgaaggacctgaggttcttcaaaaattagttttcttggtaggagtgatactcatattcacctgaatatgaagttctgagctgaaagtaaggaatttagcaggagggttggcaaaagaaaaaacttattgtcaaaatatatctgtgtgaggcagtaagtaatagatatgaaatgaatgttgccaacaataaacgctaaagaaattctgagaacccctccctgcccaccacagcatcacagaaaggtgaattggacttggtttatgaaaaataaaaaaaccctggatagtcagagaaaggaagtgggtggtgggggttggtggggggggcagttttcctaagaaggagactcctgtaaggagaaacgtgaaggaagaaaagccaaggaatgaatatgtcagtgagtggatccatttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtataacgcttcagcctactgcaaatccaaacacaggtttggtggaagatttggacaggacaggacctctttcaatgacaacgcgtaagaataacgatgctcagccactttattgacttgtattcctgcttcatctcttactcgctattggccaagatgcagagctttggtggtggaatggtgctatgtggcttacttcagcccagagtgtgaaactgtcttcattgtctgtatttcttgtggaggtctctcaacctgattttcccttcatttctttgtgccttccagatttaatgactttgtgttttaagaaaaagtaggactctattcaactccattttcattctctaagtagttatgtcagtgaaacacatgcccacttccaggatagtgatttctctatgttttaactgaccatttcctttcaatgtccatctttcctccagccagtgcagaagaggggtaggattgcttgcatggttgtaaaaagacatttttggggccagataatcctagagatcacatcagttctcagaggagaggcaaggcatgttattgacaatcaacaaaggtggcgggatccctggaacaacaacaacaacaaaacattgctagtatctctttctatcactaagaaatgttcaaattctagtagccttaatttctactctatgtgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatgaatggtccttgccaaagaaggacttatatttccattttatgtcactgttggcttttgttctgacattgggtttgggatttagtgactgtctttctcctggttgtaatatttattcggtggtgggcatggcttatgggtgtgctttatgaagtttttgcacctgcaactcaggtcagtacctttcttaaaagaacacaaaagaaataaacttgaaacagtccaagtgattttagatatgggcaatgggtcaacctccagttgatatatgtcactgagggccctgtgtttgcccaggcaagcgtttccttggtgcagtgatgaaaatcccaatgcacaggtgaaattaagaaataacttaataatggagtaaaatggtaactttaatttaatgacctttacaaggtagctaagtatttccttgtataaatttgatctgtgttacttgagtaggctattctagataggcttctttttcttttgtggttacaactagactacaggctatcatagtgttcattttccctgccgtcacatttcttgacacacagttaggtgcttttggttactgataggagcattgggattcaaatattcttttttccatgtctctgtgttctctggttttctggagtgactgggagcaatgctgcaattgagcctggacaatccaggataggcaaagttttggctcagtcttcaccttgccactttacctttgatgattatactgagaaataaagggtcttcagaaccaaataggggcaaaatagaattcttctgtatatttctatcaatcagaggagaattgtgtgcacaaaccttggtcttcctatgcacctatccatctgactctactctagctagattttccttgctagcagataacaggatttgtaccgtagcttcaaattaacactggattcattcctcattgaaacagagcagagtaattctcagagcttctctacatcacatgaaggcttggaagaagataaagaccatccaacaacttctactctgacatcaagcagtaaggattataaaacctagttggcttcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgggttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagagtcttgccctgtcacccacactgtagtacagtggcgcgatctcggctcactgcaacctctgcctcccgggttcaagcgattctcttgcctcagcctcctgagtagctgggattacagatgtgtgccaccacgcccggctaatttttttatttttagtagaaatggggtttcaccatgttggccaggctggtctcgaactcctgacctcaagtgatccaccagcctcagcctcccaaagtgctaggattacagacgtgagccaccacgcccagccatgaatttaaagtttaaatggcaattttaatagtcacagtaccctagaatgcttatagcctaatgttagtaaatcaaatgctttttacaagactgatattcacagacactgattctttctgatttccacagtggtacggacagattttccataattctccatggattagacaattaagtcacccaattctcatccttggttttcttcaaaaacactcacccacataaatctcatttatgtctatacatttttctcagtctttacgcttaatgttaagaactaaagcatttgttgaagcaagcggatcacttgaggtcaggagtctgagaccagcctggccaacatggcgaaacctcgtctctactaaaaatacaaaatattagccaggcatggtggcaggtgcctgtagtctcacctactcaggagactaaggcatgaaaatcacttgaacccaggaattggaggttgcagtgagccgagatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagtttctacaaaacttcctgtggtcatccttcttagcctttgctgccccagtttccttaattcttattaaagttctagctcatttatcagtggattaagcaatgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggtgagttcaaaactgctttagtcatttactgttataatcattgagcctaatgatgactaccaacgaagtatgagtcagtgtctccagagaagtggttctcaaaccttcttagcatacatcacaattgcagggagggcttattaaaccacaatgctggaccccacccttaaggttcctgattcagtaggtctggggtggagcccaagcatttgcatttctaatcagttccctggtaatactgacactgctgggacagggattgcactttgagagctactgctctggaggaaagccttgcatctgaaagcctcaggaagaattcaagcagtgtcccaatttaacattgcactacaccagagtgattaagagcttgagctttgtagcaaaaatggcctgagttcgattccagccctccgcatattaactgagcaagatgctttaaagggtctgagacaacatttctcaactaataaacttggaataataacaattgtcacaggacattgtttcaaagactaaatgatagaatacatgtaaagcatttagcataatcctggcacatgatatcatcactggtatttgttgggaatttactgtgtgccagcagcatctttctaaacactttacatgtattaggttgggccaaatggaactgccattattgtaggtcaagaacaggtcaatatcggccaggcacggtggctcacacctgtaatcccagcactttaggaggccgaggcaggtggatcacgaggtcaggagttcgagaccagcctggccaaccctgtctctactaaaaatacaaaaattagccgggcgtggtcctgcgcacctgtaatcccagctactcaggaggctgaggcaggagaattgctcggacctggcaggcagagtttgcagtgagccaagattgcaccactgcactccagcctgggtgacagagcaagactctgtctcaaaaaaaaccaaaaaacaaaaaacaaaaaaacaggttaatatcagcaaattcatagagtttatctagtatgaactcattcagtcatcctataaactctgtgacataggtaagtactattattatccccatgttacagatgaggaaactaaggctcagagaaggtaagtaacttggcagagttgacaggaccagagagtgatggagccacctttcaagcctggagggccttgtattacttctcatagcacagtctggagaaggcattccataatgaccataattactcccaggcatgaattcttaaatagactcctgtttgttgtgattcagatcacacccctacaaaccttaccccagactgcaaaagtctgacatgaggtaggtttactaattacttctactgctgggctactgggaggttctgccagtgctgccttactgtggtctccctgaacatcataaatccaggtgaccccatgtaaatgatttaagccatatcaattattgtctcccctttttatgcccaagtttgagtgaggctcaccatcagatttaaatgtttacacattgaaaacaaatatgaagatggatatttacatggtggcttccacaataactctctatggaggagcactaggaggtagggattcattagaaatgcttctgaaatagagacagaagtcacaggttcactggggactttaggcagggcacttaacctttcccagactcagtttccttgttagtaaaaaggagatcaaatcatctgcctcagttgcttcctagagttattgtgaggaagacagggtaccagaagtgtgaaagtactctgaaaaagtagggagttattattaaggggcatgatctctaaaaccaagagaccccagccactctctaagtatgattctttaaccatcagagtggacatcacctaggaacttgttggaaatgcagaatccttggccaacccagacctactgaatcaggatctgcattttaactacactctcccacccaggtggtttatatgcacattaaagtttggaagcttagactgtgctagactgcttttctcaccattgaagccaattgaacaatctctgtgcatatgtctcagattacatgtcatctcccaacaggaatatcaagtgctcctctttgtggaacttgctactgtggccagtcctaccctggctggatttgtagacatctagggcacaaggcaagacctgctatctcacatccatcttctgtggcttttgcttgaagtgagaatcaagcagacaggagccagtctcttttgtttggcttctgagcaggtgtctattgttcaaacaggaggtttcatcttgctgcacgcacacccagatcttttcttgctgggagcacttcttctttttttttttttttaaatcaaaataaagtgattatgatccgttaatggcctctttttaaatatcaaaggcttctatgagtcagaaaagaaaaaaaaaaaaaagaacagtgagagtgactgtacctcctggggagttttcacggccaaagatcttcagtttaggtggccagtgtcccatgagttgggcaggtgaaaacctgccaaccaccaaggacactggaaggcatgtagggaaagggccttggactgttttggagatttgtaaagtcaaaggccactgtcaacataggataggggatgttgaaacacccagatgtctggtaggaactggttttgctcccttttaagttttaacaaaagcatcaaattgcataaacaagagccatcctgtccccatataaccattgtaatcaagatttcagtgtgcacagcctaaagtttggctccatgaggaaagctctcatttaagaccccaccattttcatccattgatcagccttcaggattctacagtgggcttccatttggtaggaaaaaaaaagttcattttggtggaacactttcaaattttgttttgaagcaatggaggaagaatttttaaaaattcatgaagctttcattttgatgaggctcttcacaagatgtcttagaagtttcttttttaaaaaaattgtttatttatttattatttttatttttaacagggacaggatctccctatgtttcccaggctggtctcaaagtcctggactcaagagatcctcctgtctcagcctcccaaagtgctgggattacaggtgtgagccaccatgcccggcttcttagaagtttcttttagaaccattgtgtctccctcatttcgataggcctccagttctgacttgaggattgtctgtcttgcgatacttcctcccagtttaaggcattttgttcatctccttattttgctttttagcagtagaaaatgttgattcttctaacaaggtgtgtttcagtaatatattagcagggactctaatagggtgatttttcatagtcagaaagggccactgccgctaaactccttatttatttattgtgaggtggagtctcgctctgttgccaagctgtaatgcagaggcacaatctcagctcactgcaacctctgcttcctgggttcaagcaattctcctgcctcagcctcccgagtagctgggactacaggcacatgccactatgcctggctaatttttgtatttttagtagagacggggtttcaccatgttgactaggttgatctcaatctcttgaccttgtgatccgcctgcttcagcctcccaaagtactgggattacaggcgtgagcaaactccttattttatagtgtttatgttggctcctatgatgctattggatgagattttcaggttccctttgggctttctggagcgtgtgagtcccctgggggtcttgttaaaatgaagattctgatttggtagctttgagatgaggcataagattctgcatttctagcgatctccccaggtatgcctgtcctgatggtctgagagccacactttgagtagcaaggtcctaaattaaaaatagaaaataacaaccacacacaactaccaataccgtgtatttcttcaaatctctgcaaaattatgatgaacagcattctgttatccccatcttacgagtgtgaaaagggagacttggagaaggtagattgacccagcacacatggctagttagcaagggacagcggtgagacttaaatccagggttgtccagctctagacaccaaagtcctgaacactgtgcaacactgctgctgagaattctcatgttccttgacacaaaataacattactaagccttagccttaatcaaatgaggtgggggggaaatcttttgtgtaatgctttataaacatctgcagcttgaatccataaatggcttctcagtgattcagaatgtggagagctgccctttatgcagctccacaaggaactcatggttacacatttcaaactttggttgagagatgttgtttttccccttaggacactcacatgggagtcaagaaggtggagcaaacacaacctctggtcctataaggacaccccaaattccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgagaatactacaccctcttggtaggaaaagatggaatagtcttttcttcctgggttctgcaaactagctgagctcatactcagatctgtccctggcctgtcccagagaagtgccatgttagttactaaagcttccttcctaaatgaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgaggaggctgggacacctggttctcctgagcatcaagacaaggcatttgttgcaaattctttatttgacttggaattaaaattgatttgtcatagagaattactaaagggaagggttctcctaaggttgtaaattacccttttaattctctcctcttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaagccttagctgtcatcaggcagcaagattcttcccagctccagtgacagtgcaggtgggatatctcagggctggaaaccagggccacagtgggcaggagtagaaaggaagaacagaaatcgggccctcctgtcagtctcccccacttctgactctacctccctctccaaactcatctaaaccaggaaaaggtgaggcaaaggtagtgctgagcaggaaatcagagataaaccaaaatttccaagaagaaaacagataatgagactttccatgcctcttctttctcaagccctggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaataccatggttaccattttaatatacgtcttttttttttttttttttttgagatggagttttgctttgttgcccaggctggagtgcagtggcgcgacctcggcccactgcaacctctgcttcctgagttcaagcgattctcctgcctcagcctcctgagtagctgagattacagcatgccaccatgcccagctaatttttgtagttttagagatggggtttcaccatgttggtcaggctggtctcaaactcctgacctcgtgattcacccacttcagcctcctaaagtgctgggattacaggcgtgagccaccgcacccggcctttcctgtcattttaaaatgtaaaatatataccaaaatgtgattacaccttacatggtgtttagcaaacattgcctactggttaaccatggcttccatgtcattgaatatttcctcctcatattgtagtgcgtaatgcaatagatgtaccctaatttatttaaccaatcctttattgcctccatttttgttttttaatacaatgtaaggtggataggtggatgctcttatacaggaaaaaaatgttcctttcaaaagaagcctacatttccttttatatgtttaataatattataccaaagacatctacaagattcaacaagtcatcctgtccttttttagaaacatagttctcctgaagggacttgaaaatcctgactgatgataaaagattaaagcaagaaggctgttggacaaataccttcagcaaattgctcttccagaattacctgcctattggctggacctattggccagacccccctgcagcgctgactgtggtgcttgtttcaactaggtcaattataaagtgcatttttgtttttacaaagtgtgtctctgaagctcacgcatgtcatttaatttactcataccagaatggctgatcatcttggcatccctcttggccttggctttgattcttgcagtttgcattgcagtcaacagtcgaagaaggtaaggggctgtcctgggggctttcaacttggaaagggcatcatttaaacctgggctttatatccttgctgctcagagcgtagtccctggaaccagcagcctgggtaccctgggagtttgttggaaatgcacaatctcagacccaaccccagacctcctatggcagagtctgcatcttaacaagtttccagggattcatgtgcatggtgcagcttaagacatctttctctgccccggtttttagagacaggagacacctgtgattgtttggctcatcacttttaggtagtggttgaatcctttgtgattttacatgttttttagggttaaacctcatgcagactctgtctgatgaaagttatgaagtatctcaccaggaaggcacacaaaagtatatactcattcattgatttgttaaatatttattaaatacattcacaatgcacaaatatcgtataaagattcagtgattcatcatcccctgtagcctctctgaggcccagggaacctttaagaacttttaccagaaggaagtattggccttgtgcttttgtttgtcgtttgtttttttattggccttgtgcttttgtttgttgtttggtttttgtaatgatatcattttctattttctgggaactgtagttgaagagattcaggttatagcataagaagagcactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcctattgtgtgcaatcagccctttattgccaagccctagaatgcaccacttttgctcacatacacagtccataagctttgcacatgtcaccatagaaacgctggcatggatgctgtcgacatttagggagacctcggagaagcatctcagctgtccctaagagcagctggagtccatacattggggctgggtatctcccccatcgtctgtgtcttgtcagcagcagacagcagagaaggggcctcattgctgccctctccctcctcccaagaccagcagtcaccctggcaaccggcaaacagggacacacagggtccggcacagcgagtatctcaccaggaaagtagctgcttggatgccataaattactatgtcctgatttgataattgaaaacagatttgccacgcagctaaaaggtggtgaacagctgtacgggccccttaatgggctctgtgattctaaagctgtcaacccatttctaatccccttcaaaggctgaggcttttctgctttgagtgtcacatttaagagaaagagatacagaatcctattttcatcagagaaagtttggttgaaaatggggcctccaataggtgttcatttattcagcaaacatcttttgagtggctcctgtgactaccagccctggcaaggagaaagagaaggtaaaaaacaaaaagagtaccaccccttttctaaaagaatcttgaggtttagtggcagtattggcctcttgaatttgaattggctaatatttattgagaacattccctgtgccagacactgttatataaattatggttaaaagacaaaagtggaaaatcattagtctctgaagttgacatacaaggatgggtcatgggcttgcatgatgaagtgatctgtgagtcacgttgtcttaaagatgctgggttgggggttctattacttctttaggtttttccacccctgccatcatccaaaacagctttctttgctgttcctcatgtcacctgactccttgagttacagctctccaagagaaatcatattttattcccttttcatgagagcacataattattttaggagtcagttgggttgatagatactgcgtgaggctccagagaagattttcctttaaagaatctatctgggccaggtgcagtggctcactccatgtgcagtggctcactttgggaggccgaggcagtggattagttgagcctaggagttcaagaccagcctgggcaacatggcgaaaccccatctctacaaaaaacacaaaaattagccgggcatagtggcgcatgcctgtggtctcagctgctcgggaggttgaggtagaagaatcgcttgagccccgggaggtggaggcagcagtgagccatgatagtgccactacagcctgggcaacagagtgagaccctgtctcaaacaaacaagcaaacaaacaaacaaacaaaaacctatcttatttgtctaaagaggagaaaaaaacatgagaactttactatgttgcttgtacataaaagctgttcatcagccttcactttaatgggaataatcgtcttttctataaaccccagcaggcagtcacccacactccaatcagtaggtcttctctacgcatcgccataatttagaaatattttccttctcttatgctacagtctagctcctgcaatctgagctcacccaacctcgtcctgctgtctagaacagtgctatgcaatagaactttctgtgatgatggaaatattctatacctccactgtccaatatataactactagccacaactgagcacttgaactatggctagttcaactgaggaagtgaatttttaatttcatttcattgtaattagtttaaattcaaatagccaaatgtggctggtggctaccatattggatggcacagctctaaaacagtgcaaaataaatccctaaatatcgttaaggattgtcaggtagaagagtcatgagatcagttgccaagttacccacctaaatcttttgagataaattctgccatgccataaaagtatgttacctggcttctaaaccccagccagcctgccctctctttcctggtgaggtctcagtctgcctccttccacactgtgtgattgctgtgtgctcagctaatgcctgagatttaagggaagaggagataaaggtaagacacagatccatgaggatctctgatcttcagagtcagaagatccaagctgtggctgggcgcgggggctcacacctgtaatcccagcactttgggaggctgaggcaggcagatcatttgaggtcaggagtttgagaccagcgtggccaacatggagaaaccctacctctactaaaaacacaaaaattagccaggtgtggtggcgggtgcctgtaatcccagctacttgggtggctgaggcaggagaatttcttgaacccaggaggcagaggttgcagtgagccgagatagtgccattgcaccccagcctggttgatgaagtgagactttgtaaaaaacaaaacaaaacaaacaaacaaacaaacaaacaaaaacagaaaatccaagctgtgattcttgcagtgcagtgccataacaagctgtgaaactttggacaatacttcttggacttggtgtccagtttacataatgaagaagctgggctagatgatctctgaagccccttaaggtctagtgctccttcttaaattcttataactaggaataacttaaaaattagaatttgtctcttaaaagcacttattagacgcctagagcactgaatattggaatgagttatttatgagaatcatcctaccctcctgaaactactcagacagatagaaacacataaatccaaagggaaatgcaggccaaccaaaaaccaagcacaatattcctgtgtcctataggtcaaatgttatccactgtcaagatcagcttcgtttagattaacaacattaatccccacccactcccatgcacagacatattttttatgctcataaatcactttcccacaatatttcattccatccctcaaccacccattggttagggaaatgggaattactttaactagacaactttcctccaaagaacacaggggccagggaattggaagtaacacaagcagtattctaccttgagccttttaaatcctcttcatagtaaataataacgaggtaggtggaggcagccaggagaaacaagcaaaattcatttcatatggcttttgttatattaacaattatagatagcacttgaaagcttactgtgctccagatactgttctaagtgttaacccaaaccttagtttccttaccccgcataagagcaagaataacaattatttccttacccctcataagagcaagaataataacaatagactcatttatttagtgacagtctctgtttcaagggcttttcacaatcctatgatattgctactcttagtaacctggtattattgatgcaaaactgaggctcagagaggttaagtgagttgccccaggtcacatagcagtaagttctcaaaaccaggccttccgagccccttttcttctttcttttttccttttttttttttttttttttttgagacggagtcttactgtgtcacccaggctggagtgcggtgatgcaatctcagcttactgcaacctccacctcccaggttcaagcaattctcctgcttcagtctcctgagtagttgggattcagccacgcaccaccatgcccccatgaccggctaatttttgtatttttggtagagatggggtttcaccatgttggccagctggtctcgaactcctgacctcaagtgatccttctgcctcagcctcccaagtgttgggattacaggcatgagccattgtgcctggtctctttttcttttttgaaacagggtctcactctgtcacccaggctggaatgcagtggcacaaacacagctcactgcagcctcgacttcctgggctcaagtaattctcccacctcagcccccaaagtaactaagactacaggcacatgccaccacagccggcttatctttgtattttgaatacagactgggttttaccatgttgcccaggctggtcacaatctcctgggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatatgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacgagaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttagttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 89 - DNA, 5452 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggagctttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 90 - protein, 668 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGALMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 91 - DNA, 5468 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctgcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 92 - protein, 691 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 93 - DNA, 5053 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 94 - protein, 535 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 95 - DNA, 4633 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcgagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 96 - protein, 395 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 97 - DNA, 4723 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 98 - protein, 425 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 99 - DNA, 4874 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 100 - protein, 493 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 101 - DNA, 4335 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 102 - protein, 361 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 103 - DNA, 5674 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 104 - protein, 742 aa, Homo sapiens [sequence omitted]

SEQ ID NO: 105 - DNA, 3858 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 106 - protein, 139 aa, Homo sapiens
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 107 - DNA, 5739 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 108 - protein, 742 aa, Homo sapiens [sequence omitted]

SEQ ID NO: 109 - DNA, 12718 bp, Mus musculus
  misc_feature (1)  (12718): n = A, C, G, or T/U
tatatgatggccgccggcgcgcgttgcgtgttttcacctctcgcctgctgaggcgcccgcggctgcttcacgagtgggtagagagtccctccgtgctgtgcccggtgttgccgtcctgggttgtgcgaccgtggctcgagcctgcctcagtctcgttcttctggtctctctgttcggccctcagtttcctttggtgagtggcggcgcggcaccggtggtgcaaaggtcctttcttctctggagtgggctcgggtgtggggagctggctggcgggggtgggatgcaggctgcaggaccccgctacgctgctgtcctcctcccgcctccccacgcacgccgcgcccttccgcgggccttttcggcggtcctcggcaggcgcgcgcgggaatggtcttttttccgatcatccacggagggcgcgcgcgggcaagcggccggagactgaacagaactcgtggggcggggcggggcgggacgnnnnnnnnnnnnnnnnnnnnccaggctgccctcttcccagagatgcgccgctattgttattttcttccacttcgtccccccaggatgaacttgcgtcctttctctaatccgccatggaattctgctccgtgcttttagccctccagagccaaagaaaccccagacaacagacgcccagacgcagcagcgtatagcagtaactccccagctcggtttccgtgccgtagtttacagtatttaattttatataatatatactatttattatagcattttgatacctcattccgtttacacatctcaaaagccgcttagtaattctcttattatttaaagaaccactacattagagaatggaatctactgtggcaacgattactagtaccctagctgctgttactgcttccgctccaccgaagtatgacaatctatggatgctcatcctgggcttcatcattgcatttgtcttggcattctccgtgggagccaatgatgtagcaaattcgttcggtacagctgtaggctcaggtgtagtgaccctgaagcaagcctgcatcttagctagcatcttcgaaactgtgggctccgccttgctgggggccaaagtgagcgaaaccatccggaacggcttgatagatgtggagctgtacaacgaaactcaagatctgctcatggctggctccgtcagtgctatgtttggtaagttgtagttataccttatgttcgctccagtcttgaaccttctctccgtgaggacgcactgcttatgtaacagttttgccatctacctgacaaaatctgattaattctgtttcaggttctgctgtgtggcagctcgtggcttcgtttttgaagcttccgatttctgggacccattgtattgtcggtgcaaccattggtttctcccttgtggcaaatgggcagaagggtgtcaagtggtctgaactgataaaaattggtatgttgaattttaaatggttttattttcgttgtgtgctgctgtgtgtcgtggagtgggagtgaagtggaggggcaagttgaagagtatcagaaatggagcacctaccatttcggggtcttgttaacaaaaacgtactttccagacctgacacttcattttgtattctattccagtgatgtcgtggttcgtctctccgctgctttctggtattatgtctggaattttattcttccttgttcgtgcgttcatcctccgtaaggtaacctttctacttgcgacctttcatgagtcacattcagtcttgttcaaactcactggtattctctcagatgtgactggtatgtaagtatgtggctttggaaagctaaaaagttctttgttctgtatacctcctgtatgttgtggagttctgtgaaagaagcaagtttttaatgccccagagggcattcaggaaggaaaaacttgagtagttctatggtctgccaagaaataaagagactgggagtgaaaactaagaacattgtttaaggtggctctgtctgtctaggtcactacattcaggacaagtggaattgtaaccttttagttcaacaggtcacagaatcctttttaaattcctctcccatgttgattgtcaagtacatagaagtttctagaggaggctttctacttgtagggactccactttctcagtaagaagagtagggatgagttgttggggggggggttgttttgttttctttttgctttaaaaaaacaggaagccattgagtttcctgactacttgaaaaccccttttgagagacttagtgccaatttcttttatcatggagactgagcctggctccacaaaaaaaaaaagtagacaacaagggattttgttgactctgggctgaattacagtaagaataaatgaatttttctcaggagacagagttgtcctattttctagggtgagtggctcttaacagtcctttgttaagctcttttaaaattcccctaaacagcagaaatctgagtgaggggagataggtaccttatcttaatggaaggtgtgtgtttagactccctgcttcttgatctagttctcggagtctctggggaatgacttctctcaatagaagtccttccctgactccttcctgatcctatacttaccattaggtgtctggcagaatgtgtttcacgtgtggagcattataaatatctctagcttggcacagtgtgactgagtaaatagttcattgatgtgcaacctctagatatggtattctttcatctagcaagcaggtatgctatgagttcccctgaccctccccccccccttatctgtagcatagggtaatctgattctccaggattcaggaatcatagtttttagtgttgctgttagagctgtgcatctcttgacataccagaaaaccagaataactaataggatgctatttggtttcatggtttttaaaggtttattctgacccctttgattattgggaaatcgatcattctgattctggagagcctctgcaaactgtttagtggtcattcctgcaagggggaacagagatgcaaaggggggttctcagtgcccagaacctctgattgacatatgccaagtatctttactctcactgtgttattggaatatcaagttgtgtatgtttaataattattctgtacagtctcaagtagcccaggctggccttgaacttctgatcctcctgcattcacatcccaagttcttgaattactgatgtgtgctcccactcccagcttaaagagtatgggtgggacaggcatggtcaagagtcatggatgatatttaatacagtgctgacttggaggctcttcccctctgtctctcacttgctcactaatccctcagtaacagatgagggatcctttcctgtctccatgtaactgagtgagaggttcacatcctttctaactaaagctttaacttctttgtctcattccttcctatattgagcccagaatagttcctgcaagtctgttgacttgacagaaagacctagtgcatatttggttttcatctttatcactatatataaaagataaagagtttacatgatgagaaaagcatttaataaaatccctagcctagctatgaagacctgggaggaggctggaagggagagacctttcctattttaccattttccttgactcttacgaagttatgatgtggtttgttttggttttaaaccactaagtctttatcatcgtgtattaaggctagtcattccctacctatcccaagctatgtactctgatttcaaatatatcttgtgactaagtctttgtagcctaggttgacctttgactccggtggtcttctgcttcagccaacactggtattacaggtgtataacaccatgtccacggtgtccccgaccacaggtgtataacaccgtgtccacggtgtccccgaccatgctactacttcagggaatattgaattttaggccccaagcgggggaaatgagtgtagagtgctttttacctgatggtttaattactaaatataaatagcatttgaaaattgatgaaagagtccctacctagtgcctacagaatattcttgaagccttggattagcttgtgtacctcaggctcttgtctgcctttaggtgtaacctgcatctgtttagtttttcagggtgagtcaggttgcttttgatctgatgtcttactgttagcatcctcctaaacaatgagtaaaacttaaaattaatggatttttgttttgttttgttttcaagatagggtttctctgtatagccctgctgtcctggaactcactttgtagaccaggctggccttgaattcagaaatccacctgcctctgcctcccgagtgctgggattaaaggcgtgaacgaccacacccggcccaccattggtgattcttaaacatttcacagctttgccttgggggtctttgtacttgctatgcctctgtccattcccccccccccccagtggacaggtggcttaaactttccataccctgagacatatgtcagctcaactgatttcgttcccacattttattaaaatgtccctccccatcaacatcctcttgcctgtttttgtttttccttttaaggcatttgtcagcccagtctattattgtgtagtagaaaattactcagttctatgacaacggggacttagtatggcccctgctctatttcagtgccctaaaaagttcttgacgggcactagactgagtggatcgatggcgaggttcacagttgatttaactttgcactttggtaaagccttctgtcacattgatcggatatatagataagatggttgtgtatagtctgcagatttttaaatttaaggcggcaggacatcaggaaataagcattttaccttagtctgtttttctccagtatagtagaccctggggggcctgtgctcaggtttacagatggactttgggtaactcagagaaactggttatttgtgatattagttatatccttgttactaagaatagggagaaactgttgcctatgatggtaggtggcattagcttccttaggtagcaaatgtaggacagagtccagttggctttgtagaaattatggtgggaggctgttgctagcaccatgactcctagtttgtcttgccacagggtgctctgaaagagatctacatttacaacttttaaggtactgatcttcatgtcttacaggcagatccggttcctaatggcttacgagctttaccaattttttatgcctgcacaatcggaatcaacctcttttccattatgtatactggagcaccgtgtaagtacaaatcaagatgcttaaatgtgaattttaggttatttacaaaactttcattaaatgcccaatttacccctttttgctttacagggctgaaatctcctagaaggtggctggcctgcatccatttcagaaggctgcaggctagtgtatgctgagttaacctagataggttttcaaccagagagacctgctcacattctaaatcactccagacctttcctccttagtcttcacaggatccactgataatatgaccttctccctccctttcttgtgtctatgctaacaatgctggaaatgatgctggcctcaactactgaagagtcattagttaaatctgctcttcagtaatcagccacttagagccgcttgttagatgtcatttttctctcccagttggagccatttcgttttctaaagttctcagtttgcccccctaaactgacttgaacgagaagagttgggatgtgtaactcctggtctaattaattacacttggaagaagaatgtccgcagctaggagaaagcacttgagaggaatataaaggctctggtgttgattgctttcatatggggactaagggaaggcaaggattcagttgtctactgagagatggatagattggagctcgtgaggcagagcagcacggttgtggcatctgggctcatgtgacttgctgggtcttaactacgcaggacccgaggcgtccctacactcattcctctgactgctgcccagggcacactgtgtctgtgtaaacaggactgaagtagcaaagtgattgtccttatgttatgtgtgctctcatcctcaattcttaaaggattttcatgcttgtgaccgccaagtaggtcccgcctctggttcatggattgtgacctgtgtattattaccactgaaatgatgtagtaagtcaccgaacaaaacaaaacagcagggtatttctcacattgtcgttcttgaaatgtcattaaagaaacacaggatgggaccagccttggtgtgggggagggggggccttgcttcttttttttttttttttttttttgccctataagattgtttctaagaaaacccagtcctttcgttcccccttttgacttggaatgtagacaaacttaaactgataaacactaattagacctcatggatattttactttgtggacataactgcctagtcacagttgaaagcagaacttaaaatgaaaagaccggcagatagaaagaacttcaggactgaaggatttcagcttatgtctgattgattcttaaaggctacttcttagtatattctgtctcttttacggtgctagggattgaatctaaggctttgtgcaagctaggctgagctgcggtcccgacataaatagttttgacagtacagtaatgttcccattttataagtgacttactatgcagtaagcaaaatcaagtgagacaagcacaagtgactttgctgggggaagggacattcagacagtggcctgggattcagtgctgtgaatggtctccactctaggatacgccagcagtccctgttgcctgtgtgcaagctgacacttgccagtactgctgatcctgaggtcattgagccaaggggaaagaactggaggacaggtctctctgccttgttactgaactaccactaaacttgtcctgtgtgaaaggcaacatttaagcaagtgtcttcccgtagttaataaccctattttctgttagcttgatgatgcttttgtggagagatgcagttcccccaagagctgcctggtacagtcagtgtagtaactttcctttacagtgtgtggtgtctgcgtgacactgacttgagacactccctttattaaaataagtcatatgtaaatgtaatgtggggcagttaggatgaggagctgagtgcagaaaaggatgctgtgattggttttatagttataggtccttactgtagcgattcttgaagaaagttagcacatgagtccagcaagtgtttcagtggctttggttgctgtgggtttaagatgttcattcacgttttctccatggtctgcatagccagtagcctgatgaaactctggaatggcagcagctgaaacgggtgacggtgacgggctggcttggggaagccctccttcccctcaggagggtttacacattgttgcagggggctgttgccctggggttttcaagatgcaccattttatctcgtagtgctgggctttgacaaacttcctctgtggggtaccatcctcatctcggtgggatgtgcagttttctgtgcccttatcgtctggttctttgtatgtcccaggatgaagagaaaaattgaacgtaagtaatacagtttaatagcgttcccctctccctctactcctctgttcccctctctccccctctctccctatcagactattttaggatagaggaagcatttgcctcaggtacctttgcatactcagatggctgtgtgacagtgtctatacacatacacactgtgtaatgcagacacacttttgcacactatccttgtgctagagctgtaacaacacatgaagaagtaaacactcttagaagtaaccttaagtcattgaaggctgtttttgcagtataatttaataccaagtaagttttatttggtactagtctttgtgtctgttttagtcagtcgttaagatagtttagcagagtccccttctgcctttcagtgtgtggaatgttggtttgtggatacacagcagaacaggaatgcatagactgcagtggctttagaagaatgctgcgtcattgcagttctgaggagccgcccagagctctgtgctcgtcagctgtgcggcacgcacagtgggaatgaagcttccaggactctgacctcatttttgtctcagtctggaaggagagacaaacctcactttaatgctgtgctagtgtgaggtgtctgagccagtaggtgactgctgagctggccgttaggcagaaatactgcctggctcccgggtatgcaagtgtttaagcctgccggttgcagctcagttgtctgtactcaggacctaagagttaggagattccttaggaaggctgactgtttagtcagctgccaccccagggcttgagcccccatttcatgaccaagagctgaagatggttttacacttgtaattataaaaagaaaaagccagcaatggaccagaaccctaaaatacttaatacctggcagttgacagcagtttgtcagcccccatttctgcaagcagaccgtgtgctactgcagggctgggctgtcttgctcctcctcaaggggaagatatattcctcaaataataaagagggcagcgatgttagcttgaattttaactagaatttatacctgttattttgagaagggtttcaggggtggatagagaggaatgtggagcaagatagtatcgtcaaatcacaaatcctctttatgttttaggagaagtaaagtctagtccgtctgaaagtcccttaatggaaaagaagagcaacttaaaagaagaccatgaagaaacaaagatggctcctggagacgttgagcataggaatcctgtgtctgaggtagtgtgtgccactgggccactccgggctgtggtggaggagaggacggtgtcattcaaacttggtgacctggaggaggctccggagcgagagcggcttcccatggacctgaaggaggagaccagcatagacagcaccatcaatggtgagttaactttccagggtttccagtgtctcgtggtggtggaaaggctgctactctgggctgatgcactttgcattgaatgttacctttttggtctcggctaggtgcagtgcagttgcctaatgggaaccttgttcagttcagtcaaactgtcagcaaccagatcaactccagtggccactatcagtatcacaccgtgcacaaggattctggcttgtacaaggagctgctccataagttacatctggccaaggtgggagactgcatgggagattctggggacaagcccttgagacgcaacaacagctacacttcctacactatggcaatatgtggcatgcccctggattcattccgtgccaaagaaggtgaacaaaagggagatgaaatggagacgctgacatggcctaatgcagataccaagaagcggattcgaatggacagttacaccagttactgcaatgccgtgtctgaccttcactccgagtctgagatggacatgagtgtgaaggctgagatgggcctgggtgacagaaaaggaagcagtggctctcttgaagaatggtatgaccaggataagcctgaagtgtcccttctcttccagttcctgcagatccttacagcctgctttgggtcatttgcccatggtggcaatgacgtcaggttagtccacatgactcttagtgttactatttttagacagtcttaccctcctgtgtgtactgctctacttctggggggacactgagtaatctagacgggatgaagtggtagtaataaagcaacaggaagttcacttggattgtaagagtggttttttagctttatttctagacaagataaacagatgagaatgagactttggtaaattgggacttcagtgatgaaaaacttaggatcacggacagccctgagaatagacttaaggggttattagccttgtttctctggccagaaagcttcattggagcctgagacttgctctaagctacacgtgagaggaacgagactaccagttacatgtatgtgccttctgtcatagccgctgtgtttggcttctgtaggatggtttgctaagtgcagtggtcagtcacttaacagattgggtctcgacaagaagtggttctgcctaaaaagtcatcggtgcccccttttttcttccagcaatgccatcggccctctggttgctttgtatcttgtttataaacaagaagcctctacaaaagcggcaacacccatatggcttctgctttatggtggtgttggcatttgcatgggcctgtgggtttggggaagaagagttatccagaccatggggaaggacctgaccccaatcacaccctccaggtgagtagtgaatcccgccctcggtagagctcaagcttttcaggagatggagttgtgtggagggcagcacgcgggtctccagctaaaggagtgtatggcagctgctgctgttcttctctcagttgatctgaacgtttctgctgcacttactgtctgacttgtaaatcagtcagtctgctcagctctagtgatcatgtaatttaaattttctgagaaagatatagtggagtaaataattatatacatggctttgatttgggagctaagaccttatactttattcagaataaaagttccaacatctttgtttgctttttgagacagggtctctgtcttggctggcctggaattcactatgtagagcaaactggccctgatctcagaattcatctgcctctgctttccaagtcttagcattaaaggcatgtgtcactgggcatactccagcttttaaataaatcattccagaaatacttaatcctcagatgttaggaccttggctcaatttaagtaggtttttggggttagaggagatgaccaggctttgtcactgagtagaacaaagagagattagaactgatggctttagctagtgttggtttctcagaagactctccattgttgacaaacatccctttgtatcaacagtggtttcagtattgaactggcgtctgccttaactgtggtcatcgcatcaaacattggccttcccatcagcacaacacattgcaaagtaagtggagtcgggacgtcatgggcccttgaagccgatcagtagcttggggatgtccatggttcaggtggatctggggggtggggggtgggggtggggtcctactacttgtggtagtaaatacactggttttaacaagtttgtgaggcttatttgtaagggcagtctcttggtgaaagcatatagacagggcctcttgggcctgtcgtgctgagacattgaactttaggaagttgcttggtgaacgtataacatagttattggataaagaacaaactgacttccttggaagagctgaatctggtccaggctagggcctgccaagtcactctctctgctggggtggtgttgggtcacataccagccgccctctagagtgattgttgagaaatcagaaatttagcttacacaaagcagggaaaaggagttttgtcatattttagcacatttagcaacagatctaatggctgaatatttatatcgcttttcttcaccttgccatgggtaattttagcttgttagaagttagcttctggcttgtgtcacatgcctgtaatttcacctcttgggattctgaagtaggaggatcacaagttcaatcctgtttagatgacagtgagaacaactgtgtcttttttccagacaaactgctgggttcatcgcttgtctgggttccctgtcccaagtgtctttttgctgagtaatgtctggtctgtttctctcctaggtgggctctgttgtgtctgttggctggctccgatcaaagaaggctgttgactggcgactgtttcgaaacatttttatggcctggtttgtcacggtccccatctctggggttatcagtgccgctatcatggcagtattcaagtacatcatcctgccagtgtgacgctggggttgaaagctgtgtcagtgtctgggaccattgtacacattcctgttcctaggagaacgctcacagtgttgctgaagacaggcaagggtcttaaaggagccgtgggaaggaagtgtaatttacactataattgcttttgtgctaaatatgacttatctcaaaattagctatgtaaaatagccaggtttccattgattcattccaaggtcccttttctcctgggctatgaattcctgtacatatttctctacttttgtatcaggcctcaattccagtatgttttaatgttgtctgtgagataacttaggtgggttctttttaaacagccaggcagagccatttgatggcatgtactgctttgtcggcctcaccagcttcttccccaacatgcacagggatttaacaacatgtaactgaagcttccctccctcatagtctctcatagaaatagtcacggcactctgctccctgtcactagtggcaggttctgttgatgtgtgacaacttcttagagggccgagaatctttggcacagtggaaatataagtttgtagtaacctctttgcaaacagttcacggacatgttgctaagaagcagggagacaaagccccctggcggttgtggttattcttctgagatttctggcagtgtgggatgggtgaatgaagtggaatgtgaactttgggcaaattcaatgggacagccttccatgttcatctgtctacctcttaactgaataaaaagcctacagttttta

SEQ ID NO: 110 - DNA, 3273 bp, Mus musculus
tatatgatggccgccggcgcgcgttgcgtgttttcacctctcgcctgctgaggcgcccgcggctgcttcacgagtgggtagagagtccctccgtgctgtgcccggtgttgccgtcctgggttgtgcgaccgtggctcgagcctgcctcagtctcgttcttctggtctctctgttcggccctcagtttcctttggatgaacttgcgtcctttctctaatccgccatggaattctgctccgtgcttttagccctccagagccaaagaaaccccagacaacagacgcccagacgcagcagcgtatagcagtaactccccagctcggtttccgtgccgtagtttacagtatttaattttatataatatatactatttattatagcattttgatacctcattccgtttacacatctcaaaagccgcttagtaattctcttattatttaaagaaccactacattagagaatggaatctactgtggcaacgattactagtaccctagctgctgttactgcttccgctccaccgaagtatgacaatctatggatgctcatcctgggcttcatcattgcatttgtcttggcattctccgtgggagccaatgatgtagcaaattcgttcggtacagctgtaggctcaggtgtagtgaccctgaagcaagcctgcatcttagctagcatcttcgaaactgtgggctccgccttgctgggggccaaagtgagcgaaaccatccggaacggcttgatagatgtggagctgtacaacgaaactcaagatctgctcatggctggctccgtcagtgctatgtttggttctgctgtgtggcagctcgtggcttcgtttttgaagcttccgatttctgggacccattgtattgtcggtgcaaccattggtttctcccttgtggcaaatgggcagaagggtgtcaagtggtctgaactgataaaaattgtgatgtcgtggttcgtctctccgctgctttctggtattatgtctggaattttattcttccttgttcgtgcgttcatcctccgtaaggcagatccggttcctaatggcttacgagctttaccaattttttatgcctgcacaatcggaatcaacctcttttccattatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaagtaaagtctagtccgtctgaaagtcccttaatggaaaagaagagcaacttaaaagaagaccatgaagaaacaaagatggctcctggagacgttgagcataggaatcctgtgtctgaggtagtgtgtgccactgggccactccgggctgtggtggaggagaggacggtgtcattcaaacttggtgacctggaggaggctccggagcgagagcggcttcccatggacctgaaggaggagaccagcatagacagcaccatcaatggtgcagtgcagttgcctaatgggaaccttgttcagttcagtcaaactgtcagcaaccagatcaactccagtggccactatcagtatcacaccgtgcacaaggattctggcttgtacaaggagctgctccataagttacatctggccaaggtgggagactgcatgggagattctggggacaagcccttgagacgcaacaacagctacacttcctacactatggcaatatgtggcatgcccctggattcattccgtgccaaagaaggtgaacaaaagggagatgaaatggagacgctgacatggcctaatgcagataccaagaagcggattcgaatggacagttacaccagttactgcaatgccgtgtctgaccttcactccgagtctgagatggacatgagtgtgaaggctgagatgggcctgggtgacagaaaaggaagcagtggctctcttgaagaatggtatgaccaggataagcctgaagtgtcccttctcttccagttcctgcagatccttacagcctgctttgggtcatttgcccatggtggcaatgacgtcagcaatgccatcggccctctggttgctttgtatcttgtttataaacaagaagcctctacaaaagcggcaacacccatatggcttctgctttatggtggtgttggcatttgcatgggcctgtgggtttggggaagaagagttatccagaccatggggaaggacctgaccccaatcacaccctccagtggtttcagtattgaactggcgtctgccttaactgtggtcatcgcatcaaacattggccttcccatcagcacaacacattgcaaagtgggctctgttgtgtctgttggctggctccgatcaaagaaggctgttgactggcgactgtttcgaaacatttttatggcctggtttgtcacggtccccatctctggggttatcagtgccgctatcatggcagtattcaagtacatcatcctgccagtgtgacgctggggttgaaagctgtgtcagtgtctgggaccattgtacacattcctgttcctaggagaacgctcacagtgttgctgaagacaggcaagggtcttaaaggagccgtgggaaggaagtgtaatttacactataattgcttttgtgctaaatatgacttatctcaaaattagctatgtaaaatagccaggtttccattgattcattccaaggtcccttttctcctgggctatgaattcctgtacatatttctctacttttgtatcaggcctcaattccagtatgttttaatgttgtctgtgagataacttaggtgggttctttttaaacagccaggcagagccatttgatggcatgtactgctttgtcggcctcaccagcttcttccccaacatgcacagggatttaacaacatgtaactgaagcttccctccctcatagtctctcatagaaatagtcacggcactctgctccctgtcactagtggcaggttctgttgatgtgtgacaacttcttagagggccgagaatctttggcacagtggaaatataagtttgtagtaacctctttgcaaacagttcacggacatgttgctaagaagcagggagacaaagccccctggcggttgtggttattcttctgagatttctggcagtgtgggatgggtgaatgaagtggaatgtgaactttgggcaaattcaatgggacagccttccatgttcatctgtctacctcttaactgaataaaaagcctacagttttta

SEQ ID NO: 111 - protein, 681 aa, Mus musculus
MESTVATITSTLAAVTASAPPKYDNLWMLILGFIIAFVLAFSVGANDVANSFGTAVGSGVVTLKQACILASIFETVGSALLGAKVSETIRNGLIDVELYNETQDLLMAGSVSAMFGSAVWQLVASFLKLPISGTHCIVGATIGFSLVANGQKGVKWSELIKIVMSWFVSPLLSGIMSGILFFLVRAFILRKADPVPNGLRALPIFYACTIGINLFSIMYTGAPLLGFDKLPLWGTILISVGCAVFCALIVWFFVCPRMKRKIEREVKSSPSESPLMEKKSNLKEDHEETKMAPGDVEHRNPVSEVVCATGPLRAVVEERTVSFKLGDLEEAPERERLPMDLKEETSIDSTINGAVQLPNGNLVQFSQTVSNQINSSGHYQYHTVHKDSGLYKELLHKLHLAKVGDCMGDSGDKPLRRNNSYTSYTMAICGMPLDSFRAKEGEQKGDEMETLTWPNADTKKRIRMDSYTSYCNAVSDLHSESEMDMSVKAEMGLGDRKGSSGSLEEWYDQDKPEVSLLFQFLQILTACFGSFAHGGNDVSNAIGPLVALYLVYKQEASTKAATPIWLLLYGGVGICMGLWVWGRRVIQTMGKDLTPITPSSGFSIELASALTVVIASNIGLPISTTHCKVGSVVSVGWLRSKKAVDWRLFRNIFMAWFVTVPISGVISAAIMAVFKYIILPV

SEQ ID NO: 112 - DNA, 35089 bp, Homo sapiens
atggatgagattagctacctgcagggcatggtaggaacaggatggaaataaagggaatgagggggaatgagacttctaggaatatctctttttgtttattttattttatttttagcagagatgtgggttccttatgttgcccagctggtcttgaactcctgggctccagctatcctcctgcctccatctcccaaagtgctgggattacaggtgtgagctaccgcacccgatcctctttttgttctgaactgacttttaaaatcattttaatatttcacatctcaaaaataaatacaaataaaactcacaaggacagggaaaacgctaaagttgaacacaagcagaaacaagcaaataaaatgtaccctttgacttctatcttaccactttgtagtaaaaataactaatcccagtaacatgttaaacattttctagtttaacccttgcagcatccctaaatggtaggtacgatgactagtctagttttacaaaaggggaattgccctttaggaaggaggcaaaggaagctcccaagctcccagggacttgaactcagattttgcaccagatttatattagatctcaattccgaaatcctattacatcctcagctctgagccaggcacagaaggatgatttagtgtctctgagttccaagaatctacaacacttaaaatctcagtgacaaacatttaacatcctgaggttatacataagggaatgaataattcctttatgattcataaagatttaaagaccaggccgagcatggtggctcacgcctgtaattccagcattttgggaggccgaggtggctggatcacaaggtcaggagttcgagaccagtctggccaacatggtgaaacgctgtttctactaaaaattcaaaaaatgagctgggcatgatggcgggtgcctgtaatcccagctactcgggaggctgaggcaggagaatctcttgaacccaggtggcagaagttgcagtgagccaagatcacaccactgcactccagccctggtaacagtgcgagactctgtctcaaaaacaaaacaaaacaaaaagatttaaagaccaaaaagattttaggaattctgggcactctgtgtgggctgctttcttggaggatataggattttaggtaggtatagaaaaggagacagagaattccggagagcagaagacacttggggcaaagggttaaaaggggcttggcgtgttaagagcaaaggagaccggcttctgcatgggaacgaacaacacagaaggacgtccgtcacgctgctggatgactcttaatataagagttccaagtcaaggcgaacatcatggaaggaagaagtccacaatgaggctggggtgaggttggtaaattccagtccctaactttagcccttagacagctacatttagatattggatatttgccacccctttcaattactgggctccaagagattacctaggagaaggcagactctatattctggatctgcgactaaaaaatgtttttgcacaaaacgtttgctcctttagttgtttttgcttttctcttttgtctctactttctaagccactccctgtttgctgagctgaaaagcaagttctcagccctgctgtctctttctaaagccagcttgcctgtagcccccaggggtgaggagaggtgttagaagaaaacacttctccccttctgggtcccttccgcagctggagttggtgcacagtggggataatgagaaaaaataggaaagcaaaaaggctttgtgggaaaggaaggtggccacataccaacgctgggtctagctggagggcaagcaggaaacatgaacaaaatgaaaacatggagaattcctatcagaccactgcttcacggcatcctaagttttaatcaggacgaatgttcagataaacccaaaaaatccttgaaacgaggacaaatgcaacatttggccctcaagtcgctgcctcccattgtcatccccttttgaaacaacaaaaaatatcacacatgtctgacctgcctggccaacatggtgaaaccctgcctctactaaaagtacaaaaattagccgggtatggtggcaggtgcctgtaatcccagctactcgggagaggctgaggcagcagaattgcttgaatctggaaggcggaggttgcagtgagctgagattgtgccactgtgtgtgtgtgtgtgtgtgtgtgtgtgtgtgtgtgtgtggtgtatacacacacacacacatatatatctcccacatctcccacaagataaagtcaatatctggtccgctttgatcgtttcctccctgtcatcattgcccctgtgtccctcctggcacctctgcccaagcctggtccagcagccccttgccctggattcccacaccaggctacagctgtccatccacgcccccatcccctccgagaacacgcttcctcctgcagcccgcttcaggaccagcccacacaccacctcctccaggggcactggggttcctggaaggtgctggctcctcctcccaactccaggcaccctgacgccactttgtcagtgtggttttcacatcctgtcctagcggtatgtttgtcttttcgcccccagattcacagcttcctaagtgaaggagccaagtcttgctcttttctttaccctagaacaagatacagtttctgatcatacttaatatttgatgaacagatgttttcctttaaacgtttaaagtttaacttttaaaatctcagtaagaaatacatctgacattaccacccagactcatacacacatgtcactgaatcaaaagtttcatgaaataatacttactctgttggatgcactctgatattttctttaatttcattttttaaaaagtgcttgtggggacttgtaggtggaaagccatggtcctaaagtgtacagagaagctgtcattgctaaagtgagagaagctttgcttccaagctaggatcaggttaggattaaactataaacagatgagggcttctgtttgctctgatctgcagactgagagagtctggcctcattaagaaacagaagccaaggcggggcttactgacgatgatggacttcaagctcctagggcctgctctttgcagctttcctgttcagtactttatatctttccttcactcctttaacatacccatccctaactcacaaagattccccagactccacctggtaccccagcgatattgtgtgcacagctctacgatggctcttgtcacactgtactgtaatgcaaatcttttttaggtggctagctcttcaactgagctgctggagggatcccggccagggaaatgctggccaaaaagagtgtgtgaatgggaggagaggaacttttgcatcttggggtctagaggtgcccatctcttccttgttgttgcctgggcagggggtcaccactggctctggagccacagcggggaaaggcaggccagggtacaccgcggtggagcagaagggcagggagcagtgatgtaattcaattacagaactcggttatcccttcactttgtgtagaaacgtcaccacttaataaatttttttgtttgtttgtttgagacagagtctcactctgtcacccaggctggagtgcagtggcatgatctcagctagctgcagcctctgcctcccgggttcaagcgattctcctgcctcagctggagagtcctactctcctgagtagctgggactacagaggtgcaccaccacacccagctaatttttgtatttttagtagagatggggttttaccatgttggccaggatggtctcgattttctgaccttgtgattcgcccacctcggcttcccaaagtgctgggattataggcatgagccatcgcgcctggccaccacttaagaaattaatagtcccagctacttgggaggctgacgcaggagaatcacttgaatctaggaggcggaggttgcagcgagccaagatcacaccactgcactccagcctgggtgacagagcgagactctgtctcaaaaaaaaaaaaaagtaagaaattaagaaaataggctgaaggtggtggcaagtgcctgtaatcatagctgctagggagactgaggcatgagaattacttgaacccaggaggcaggggttgcagtaagccgagatcacgccattgcagtccagcttgggtgacagagcgaggatccaactcaaaaaaataaataaataaataagccgggcatggttgcacatgcctgcagtcccagctgcttgggaggctgaggcaggagaatcacttgaacctgggaggaggaggttgtagtgagcagagatagtgccactacactccagcctgggcgacagagcaagagtgtctcaaaaaaaagaagaagaagaaacaaaaccaaaccaaagaaaatgcatgactgttcctcttaattatttacctagctctgttttgttacatattgtagttgtaacccatgagcaatagataaaatgtcactagatagaatgtttgtggccgggcacagtggctcactcctgtaatcccagcactttgggaggccgaggcaggcggatcacctgaggtcaggagttcaagaccagcctggccaacatggtgaaacccctgtctctactaaaaatacaaaaaattagccgggtgtggtggcacgcacctataatcccagctactcgggggggctgaggcaggagaatcgcttgaacctggaaggtggaggctgcagtgagctgagatcgtgccattgcactccagcctgggcaacaagagtgaaacgccatctaaaaaaaaaaaaggtaacaaaaaactctccctcaaattcgtgttgatacctaattcccaatgtgataacatttggaggtgcggcctttgggaggtgatgcagtcatgagggtggagacctcatgaatgggattagtgcccttataaaagagaccaccagagagcttcctctccccttccttcatctgaggacacagtgagaagccagctgtctatgaaccagaaagcaggccctcatcacacattgattctgctggcgttttgatcttggacttcccagcctccctgtgagaaatgaatttctgttgcttacaggccacctggtctatagtcctctgttacagcagcctgaatgaaccaagacacccatgtacacatttacaaacaaaacaagtacggcctagcccacattctcaggagcttacaattttcctttaagtaaagttacgtgggaagaccctgaactgtggagcaaaaagggcctgcgttgagactagctctcctgcttgtcgtgctgtggtcttgagaagcacctgaactctttgacccctttctcctcatctgtggaattagggtaactatgccattccccaggcttgctaccaggaggagaatgaggggacagacttgggagcagctcacattcctgaagaagttaacgttctaaggtatggtggtgacaagccggaccgggcagaatacattcttcccgtggtgaaacagaggaaaataaagctggacagacagtgaagggccctgtcatggaaagctccagccagacagagcggtctggagtttgttttgcaggcagtggtcatggggaaaggctttgtgaaactcacggttcagcggctgagtctcaccgcctgtgtagcttgggtggggtggagtgagactggaggctgggaagcacctgagaggtgtcaagggctgccgtgtggacttagcctggggcagtgggaggggtaggggtggaaggcaggccacaggagtgaaaatagggccccggtttccagggcgtcgttccccctgcatcttgctctctgcctttctcctcttgtccttctgtctccacccctatccccatctcccaaatgcttcagagcataaaggtgctgcccagccaaaatcacccgcacaaactccaggtaaacttggtctgggcagctttgagtgggtcatgagtggaggaagggcaggcccactctttccttagtatatgagtgagaaaagcgaccgctggttagatctcacaggaaaccagagccttgtggcagcacctgacttcaggtgcagcacagcccacggagtgagaagctgacacctctgtgcctgctgaggcaggctgctccttctacaccaggccagggaaatcaggtcacccactccaacagtctgccggacgctggggactgactgctgcctctggggcatccaccacaaaggattcatggactcactgacagggccaggcacctggctaaggatctcaaactggtgcggcccacgggtccattcaatctatagatgggttttgtgcggccaacaccgtccttcttgtctacctgttgtatatgcattctggccttgcccctgagtttatgaatttaccaaccccaccttagcagggcatgaagaaatgcaaaggcgctccaggagcttctgattttgctgggaaaacaaaacaagtatacaggcaaagagggaggacaatggcagacccaatgcatggggcagtcatctgcatttctgagttgaatttagagaagagatcttctcccacagatgataaaggggtgcatagaggtgaggtgcacacggcctgggggaagtcagccctgggatgagcatgggagagggaggttccccagtggggaaggacacgagggtatggactggagaaaatctgcatggctgggccccattccacaaacagagggccccgagaggtgtctgcgtaagggagtgatgatgaaggcacatggggagagtgtacaggactgggccacccaggaatcaataatctggaaaaggtggcagagtggggagctctgattcaggagaggcactgctttgggagaaatctcagaggatgtaaagactgatgccgtgtggaagttggattcaaaggacaccaggcttgaagcttcagagtatgtaagagaggtgcagctctggttattgaagcaggggaatcatgagagggaggttgctcagggtgggaggtgagaagctgagacattttggtttaaatgttatatttaacagaagagatatgcagcttacattgagagctatggggcaggacatggaggcctggtggaaaagtgcatgtggaggtgatgatttagggcagggatggattcggtgaaaccccgaaaaaaatgtggagggacagatactggggataaggaaaaaggaaattgttgtggaactggagaggtggggtgtacacaggtgtcaggggagaagacagtcctagggaagtgctctattagcattaccaattgcagaggtttcagaaagagtgctgagaagaggctggggcgtctgaagctaaggggcaacaagattttcagcaggggtgcggaaacgggcaatacctttcagggtagaggagagcaggtgcaggggaaggaaggtggactggtagagactgctatctcagggaacaggcagtggaagtgatgggtaggaagaaaaaggaaggcatagatgtttggaggcaaaagggaaggagacagtgagaaggaagtgctgaatttgctgaggacaaaggagaaaatgagacagaaagaggcagatgaggtggacggggtagacggagatgctaatcttggatttcacaacaggctgcatcccctatccctccactgtgtgccaggcctaccagcctgcacctggccccagtacccccaggccttggtctttattcttgtggttaggcagcatggaagtcaggcaactggatggaccaggcattctctgggaatggccaagggtgttcaaagcccagggctgggacccagagcaccagcaattattccttttcccgtttgctactgattcttcttttcttccttcatcatagggcccatcagagctggtggctagaaatcatccagagggctgtaaacattagtgaggcactgagtggtccctgtttcggccaaggcataagcagacagatgggaagtgaaagtgggtaaccactgaaaggtgagggcgagggctggtttcatcatcagcgccgctggcaacaagagctattaagagccagcctttggcgagacagtaaggaactacagatttaaaattcctagcagcaaagctgtgtctcttcagggtttggttacccatgctgatcccataacaaccaccatgccaatggcagggaacatcaacaagcaaggtggtgaccatgaggatgaccttgccacaaaaccaaccatacaccccacacccctggggaaggaggcacccaccagctgggccctgtggggctgttccagaaagtgcaggttgggaggaggatggagtgaggaaagaggccagggtctaaatggaaagggccagtgaaagggagagacaggcttgttaatcaatgaccactacagagttggaaagagaaggcaaagaaaatgcctcactgctgaggatcagcgtccaaagatttcattctactgagagttaaagagatgccaaagccgggattaatgttggcaaaggagatatggatgggccatgacaccaccagccatatgtaatcagaaggggatcaaaaaacatccccagccttgaaattggcattttctcttatgtgctgggtggacatttggcaatatcatataaaatgaaaatatttgcatagcccatgacccagagagtccacttgcataaggacgtgctttataatggtctattccactgcagataataaaagaaggcgtgcaagaagatctatatgcagtgacgtgcaaaggtatcaagaacaagttgcgaaaccccatggtatgatttcatctgattaaaagaaaaaaggtatacactatatattatagtgaaaatacctatgtgtgtgtgtgtgtgtgtgtgtgtgtgtgtattacaagtaatgattaaaagtagttatgtcggggggttagactagaaagttgagattctaaggaggagcatttttcacttgatattcttctctatggtatagtttttacatgagcttttttttttttttttttttttttagacagaggagtctcattttgtctcccaggctggagtgcaatgatgtgatctcagctcactgcaacttccatttcccaggttcaagagattttcatgcctcagcttcctgggtagttgggattacaggcatgctcggctaatttttttttttttttgataccgagtttcgctctcgttacccaggctagagtgcaatggtgtggtcttggctcaatgcaacctctgcctcccgagttcaagcaattctcctgcctcagactccctgagtagctgagattacaggcatgctccactatgtctggctaatttttcgtatttttagtagagacggggtttctccatgttggccagactggtcttgaactactgacctcaggtgatccactcgcctcggcctcccaaagtgctgggattacaggcatgagccactgcacccagcgagcatgtattatttttataataatttttaaaaatcttgagctcctcttgccctaaactatttcccctattagtctggttgtttcggtgcccatatattatgaaataatcagaatacaagtctgataaatatgaattctagtggggacaatggaatagggtatttgcaattgaagtcactgcatgaagtactctctcccttgtccctttctctcccttctctggcctgaatgtcccatccctatccccatacctgtaagtcactcctctggcttaaatggggagttaacacagggtggtgggaagtatagtagacttggagtctctcacgcattgcctgccagggcccaccgtgcaggactccaggccctactctaaaacttgctacttgcccgactgcaggctctcagaccctcatttccctgtgatagggtaaaaaaaatacttgctctgcctacatcacacagatgtgaagataaaatgaaacaatgcctttgaaggtatctggaaacaggagagtgagtcctatatatatctatatatatgtgtgtgtgtgtgtgtgtgtgtgtgtgtatatatatatatatatacacatatatggtttttataaatcagcgttaacatttgattttataaccatcattaaaaagggagaggtaaatgggtggagagggaggagtgaaaaaacaaaataaaaggtagaggcagtattcaaggtcacagttaaaaatttcatattccctgcaggtggtaggtgctgaatggttgaataaatgaacagtcctaaaatggatatattttggggcaacagtaagttgcccccaggaagaaaatcacttttggaaaataaaactggcaagaatctatgctaaatggatgagaccagccacagaagcacttcatcctaaaagatggtaaaggtggtgtatacaaaattaggccgggtgcagtgggttatggctgtaatctcagcactttgggaggcctaggtgggtggattgcttgagccctggagttcgagaccagcctgggcaacatggtgaaacccagtctctacaaaaaatacaaaaattagccattcgtggtgggatgcaactgtagtaccaggtactggggaggcagaggaaggaggatcacctgaacctgggaggtcaaggctccagcgagctgagattgcaccactgtactccaacctgggcaacagagtgaggccttgtgacaaaaaaacaaaacaaaacaaaacaaaaaacccaaccaacttgggttgggcagggtggctcacgcctgtaatctgaaaaccttgggaggccgaggcgggtggatcacttgaggtcaggagtttgagaccagcctggacaacatggtgaaaccctgtctctactaaaattacaaaaattagctgggcatggtggcaggagcctgtagtcccagctactcaggaggctgaggtggcagaattgcttgaacccaggaggcaagggttgcattgagctgagattgtgccattgcactccagcctggatgatggagcaatactccgtctcaaaaaattaataaacaaataaaaacaaaataacaaaactgggggatacccaaacccaattaatattcaaataaatgcttgttaaatgccagggatagtgctatgcattttacttatttaagtctcataacaaccctattatttccactttacagaggaatgggaggcacagagaagttaagcaatttgcccaacctcatagcatgtaaatggtcgacaagattctaatttctaatagtctggccccaggtcccatgtgctaaactatcccttacctagaacagtaggaatgcttgctcagaaaaacaggacttaaaatagaaaaaagtggtgttttttgaacatctgactgaaacggaatgtgttaacatattgtttctaaacttaccaggtagcaagagtcattcttgtgattgcttcccaaactgcagcatgcttatgaatcatatggggatcttgttagaatgcagattctcattcagcaggtctggggtggagtgaaggctctaggcagagggctagagggtcccatcattggagatagacttccccacggaaaatgaagaaactgggttctgctcagaacctcagtctcccatgaggcagttcccaatagcagaagcctctctttgagtgccccaaacacctgaatttctggaccaggaaagcagaggtacagccccaggccctactccctccctgaaaactcagctttttgtgcccagcaagctctgaggtggggggtcttgttgggaagctttctcttgctgaagggatcagacaagtgaggggcactgaccctggaagaggaatgctggggagcaagagcctcggcagtggtggagtggactgtgcagtgagtggcctggcacagtctcctgtgctctggtctgtagagagagcgaatgataaataaggatgtactggaagatgaggtgtgtggttcatgtccagaagtggcaggtctgttgggggaagggagagattgactttgcctctttggctgttgtattcatggccagtcctcagtgtgaaactcaatgcaagaaggggtttgtggcccataaaagcatgggctggtcaatcttgttgatccactagatccatagcaggctatttgttgactgaacagacgaatgaatgaaaggctagggaagccatacaaagccagatgctgttaccctccacctcctcctgggatgactttggggatgactcacgtcctgctgccccctcactttctcagcctaaaaccacacatcctggactgtgcgggcagcgagctgacccttccttttctgctgtaggatcttcattacacaaagttcctgagtttccagcaagttgcctttcttccctgtttaagagctgagaaaactgggccttggggaaagcgagaagtcccagtttaagtcaccagagacgtcttcctaaagaagtattcaggatgctgtgctatccagaagctggctccagagacacctggaccatttcaagctctaagaactgtgcttctgttccctctgcctggctcctatgccatatcacacccacatgtgtgaactcaaagccaaagggaagagaccaggccatgtgcagccaggacagaggcatgtaaaatctagagagggtgggccaacctcccatactcctgtgttggcggagaaatagacccaccagtttgtctggcacaaccaaaactcagctttcttgccatgggatgctggcctgagaccagtcacaaccagtctcaaccagtctccatatcagggcttggctgtctgggtgcttgaaagcacccttcccccacccggatcccaagcatcccttggactctgccaggacagagccacagatgccgggggaaatgggaaatgactggagacacagaggacagccacattcaaagctggtgggaaagtggtggtggtgacatgtggcccttgcctgaaacattattttgaatttatttcctgtaggaattgactacaggtgggttttgtcttgcaagataggtttcctttcttaagaaatctcaagagaacagagttttcagtaactctaagacacggttaggccactgcaacaactttatttctggagagaacatgtgctctggcttcctgcctcttcctactctggggaaactggggccaatctcgaagactgatctcctagaaatgtccttttttattccaacagggtttgatgcagctcaaaatacaggctgtaaaagcaacagagttaataaaaaggagggggaaagaaggaggaagtaaatgtgttaagtgcaaataagagttggcacctagggcaatcatacttgcctcagtacttgctggcatcctgggaaaaggcacttacaatcttgaaatttgttaggttcttcgcagctttaactgccgcttccttctctgtgcctccgtttctctgtctataaagtaaggggaaaatacctcatctgagatttattgagagcatcacctgagataatccatgcagagcacctgaaatagtacctggcacacagtaagcattcaactgcatcacagatattattattattattattttgagatggagttttgctcttgttgcccaggctggagtgcaatggcacgatcttggctcaccgcaatctccgcctcccgggttcaagtgattctcctgcctcagcctcccaagtagctgggattacagccatgcaccaccgtgcccaactaatttttgtatttttagtagagacagggtttctccatgttgataggctggtctcgaactcccgtcctcaggtgatccacccgccttggcctcccaaaatgctgggattacaagcttgagccaccatgtccagctacaggtattattattacctcattcatctggggatggggagggcattggtgggtggagaggagctggttctcctttactccaaggctcctaccttctcttccctggatgttctcgcccctgctcccatgcaagtcctcacagacggcctctgaagccgcctttgttcctggtctggttccacaacgttcccatgcccacttgagctccctctactccaagtagactatttccaggatgagtacttcaagtacatcgaacagtgacctcaaatgcatttccttgactgtgcctctctgaactaaaaagtgcagaaatgtcattgcttccttcttttgtctggtcttccacagggctaggttgggatccggggggagagtagctttcctagctctcagcagctcaactccaccgaattagtgaacgatggacatgtccccaagaggactctaaacccacagtccccaacatggtgttctgcagcatgccacaggtcatcttgttctgtcctctctgagggtgaggttggagagggaccctaggctcacaggctcagtgacagtgactcaccaaagatcctgtgggcagtcagggtctgggccaggccagtgagcccattcatatggcatgagccacaacactgttcctcttcctccggcagcagcccgttttgcgtgtcccctcactatgagccgtgggagaaatttgaaagggcttggatcagagggcagggagaagagggtggtcctgacatctgacacatacttcattttaaacatgggctatgtatgacaggccttcagctagttattgaacaaagagaataagagcccttttacaagggctttacatatattcattcatttggtcctcacaacagcactgtgagttagaagtctcaatctcacccctttacagatcaggaaactgaggcagataatttatttgcctatggtcacaggactagtgagtgacagagcaggtggtttggtcttacagtctatgtgtttaaccactacaccaaaccacctccctaagatgctagagggggtttgtgccaatgcctggattctaagagattagattctctttaggatctctgacctgtttcctcagcattcagagataaggccagaaacaatgccatttgtgcacgaactgacaactgacggtcctcctacctcctatttctatttaaaaggcactgtaacttctttccacaggcagatccctacctctcctcccttaggggaggacgaaggtgtcccagccaaggaagatcctggtctccaagggctgtaccctactgatccggaggcaaagcagtgagggcccaccccaattcctcacctcccattctactcttcggcagaagcatctcagtgttggaaagataaggatttcttcctaaaaaggaaggattacactatatcagagtctgaagatacagttttcatttgcaacgcaagggaattcctttgaatctctaccttatgatttccctgcaaacccactccgatggggctggagagtgctctctcactcagatgaatctctcaggggttgtccagcaggtgtttgccaacttgaagagctacctactatcacagacctataaaagtacgcctgtggacagactgaaaacaaacaaacaaaacacacacacaaacacacaaaacaaccgcacactgggagaagttctaggcaatttccttgcaaataactgctttgaaaattactgttttaaattggcagaacactaaggactttgaacagatcatcccttttactcaatgttttcataaccttgaagtgaaggtggagggagcagtacgttttaaggtgccaggattacactacggggtcagtgctcccggatatgaactttctttttcagaccgaccttgggacctacagctttgtaagttactcatacaactccatcaaatgttacaggtaggtcagaggacattcaggttgtttaagcctctataaatgactcaggcagcaacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcaggtcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggtgagtagtggcgccgcctcgtaaaggctctttcttctccccggggccgggcgcggacgccgtggcgctggaggcggacgccgtgggcggcgcggctggcttctctcttcgccgctggccgcctccactccgcccgtctgcccgcccgcgggcctttttggcggtccccgggcggcgcgcgcgggaacggcccttttccgattttcgcgcggagggcgcgcgcgggctggcagcgcaggggctgggctgggcgcgcgcgggccgcggaggacccggagccacgtgcctctccttctcgcgcgtcctactggggatgggggtctggagtagccggcagaggctattgcgggaccccgggcgcgtgggtagagcggggtgccccactggccccccaggggcacgcagctattgttatttcccccctcccccgcaggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggtaagttctttttatgttttgtcctcttcgtggtgggtgagcaaatttgtatcatgggtggttccatttttgtgcataacctttccgattaacctttctgaatgtgccacttacataatggaattttgatatttacttaataaaactttactatgtttcaggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattggtatgtttaattccaaacggcttcttaattttcgttttcgtcatatgttaccatggcattaggtatgggaggatgtgttctaacgtcgagggacagacccaagaattttgaactcttaaacatttaaagtggtttttggtttctgattttcattatttgatattttttcttaatgtgttctattccagtgatgtcttggttcgtgtccccactgctttctggaattatgtctggaattttattcttcctggttcgtgcattcatcctccataaggtaacctttctcccccgtatgaagacctttcatggagcacacccaatcgatttcaaacccagtggtacttttgcagatgtgattggtgtataggtatgcggccttggaaaattttaaaaagctctttgttctgtgcatttcttgtatgttgtggagttctctgaaagcgagtttttaatactcaagagggcagtcaggaaggaaaaattgaatactatgatgtgccaagaagtaggagaaactgggagcaaaaaaataaggaaatttattttgcgtggttttgtgtagctgtatacacattatttgtttaaaccactgttatattcaggctaatataatacgtaaacttggagttcaagacagtgtcccctgtggcttttttaactaagctgccagttaaatgggtctctgccgtgctgattatcataaccagtttataagcttctagatgaggactctgcctcccatagtgacttgactccaatttctcagaatagttgaaaagaaccagttaaaggtagtttttggcccgccccccaaaaaaacttcaggcagccatttaatttcctgtccatttgaaaatcccttttaagtgacccagtttgcatttcttttatcaagaagtcttgctggctgcaaaataaatgttgacaagggattatgttggcataggactgagttacagtgaggataaatgcatttttctcaggaaacaaagttgtcctttttctaaggtgaatggctcttaacaatccattgtaagttcttaaaagtgttcctaaactgtagaaatctgagggagatagcataaatcccagcaggtaagaatgtattcagacccacttgtctggtctagttgtaagcttctctagggaaagatttgtctcttctctgtagaaattctatgactagtaaagtgattcactaatcactgttttccatagccagaatctggcagaatatagcagtttaacactttgaaaacttgaaatatctttagcctggtataatatgagagtaaacagttcattgatatttatggactcctaagtttggtactgttttattcagcagacaggtacgataagcatctaccttcccactccctacaactgtagtgtatgatactgggatgcttaaattagaggctcaccagtagtcatggaccagatttttttgttttttttagagttttcattagaactgtatatcttgctacttagcagagagtcagaagcattagtaggatctcctgttgtgaattcctgcttggtaaaggtttatgctggccctgtgttgattattgagtagcagatcattttgtttttggagagggtttgtgtgtttcacctccacaaaacacttattccccggaaggggaatggtggtgctctgaggtgcaaagagggattctcaggtgcccagaacctctcatttgaggaatgcatacccccacggtgttattgagggctgaagttagatacggtaactgatttcttaattgtatatttcctatatgggtatgggaatgggcatgatcaaatgatgaagaatgattggcatagtgtttaaaacaatattgactttgaggatcttcccccactctgtgcacgtgcacacacacactcttgcaggccaatccctcagtaacaggagttttcagttgagtatgaatatttctgcttccttttaggagttaaatttcaagaaaatatccttagactggtaagcttttggtatcttaactgctaaaatctgaatatttgaccattaagatatattccaactcttaaatgtctatcttgaaaattaagattaacatgacctttttttttaatttcaaaaaattgcttttaaacattttctattctctgaatgtttgttccaagcatgttggggataggtgggaacagacagaatggaggtgaggtacttctatttaggactggcatcgcacagaaggaatatgcttcagtgctcctgttgagtatttttaaattctagtcaaagaaaatagggcttttggcattctcattagttagaaatatatttaggatgtcttcccttttctttagacaaaaccagaatatccaatatgtaaaagtgaactattctggtgaagatggggggttttgtgaagacctttcctgtcccacatgactagacgatgaggcattcacattatttccaggtgaagttttacttgtgtgttaggtggatctctacaatgatgagacctttcttgttttaccttcttcctagactctctggaacttttgatttttttttaaccatgaacctgtatttcacaataaactattggtatagtagtgtcattcataccctaccccatccccaacaactttgcgtagagaatacctcagatttgtttacctcagggaatacttaattgggctatgctatacaggataataaatacacaggctgctacttcagactagtcaattacaatttgatttatggataatcatattacgaaatatctttgaaaatctattgagaagtccccacataatgtctttaaaacccaggaaatttttgggggtgggagtcttgggttgggttttttggagccttttttttttttttttgagacggagtctcactctgttgcccaggctggaatgcagtggcacgatctgggcttactgcaacctccgcctctcgggctcaagcaattctcctgcctcagcctcctgagtagctgggattacaggcgccaccacacccggctagtatttttgtatttttggtagagacggggtttcaccacgttggtcaagctggtcttgaactcctgacctcaggtgctctgtccgtcttggcctcccaaagtgctgggattacaggcttgagccactgcacctggctttttttttttcttaagcgaagtctcgcctgtcacccaggctggagtacggtgacttaattgtagctcactgcagccttgacctcccaggctcaagtgatcctcctgcctcagcctccagagtagctgggactatgggtgtgtgccaccacatctggctaactttttatattttatagaggtggagtcttgctctgttgcttaagttggtcttgaacttctgggctcaagccatcccctgcctcatcctcccaaagtgctaggattacagacagacatgagccaccaccacacctgacctgcattttcttaagactagtctttagaataaaaatacacaccttagtttcctaatcttgttgactgccctcagagtttgaccaccgttgagttagttattcaaggatgcttaacagttcttgatttctgtatgctattgtttttgttttggctatttcactatctgttaacattctctattaaactatagataagagttaaattttagagtggttttcaatgagtgctcatctctgctaatttgaaatggtacctttactttacacatgggtctgagctttcccttgtttcactggtcttaagctactaactttccagtgtattgattattgttggaagctgtagggttttactttctgtttttcctccccaagattttccactggaattgtgatcaagataacattaaaccttttaggctaaggtctttataaagtttttagccttcccatatatgtattcagatctttgctcccaatttttttttttttctgagatggagtcttactctgttgcccaggctggagtgaggtggcccagtctccactgactgcaacctctgtctcccaggttcaagtgattctcctgagtcagcctccagagtagctgggactacagatgcttgccaccacatccgggctaatttttttggtatttttagtagagacagggtttcaccgtattacccaggatggtctcgatctcctgacctcatgattgtcctgcctcggcctcccaaagtgctgggattacaggtgtgagccaccgcgcccagcctcctcccattctttcggtgtttgacttgggtgttctcctatagaattaatacatactaggtatggtagaattcttatttttagtcactggccttactgttccttaaacatttcaagtttttgccttagggcctttgcatttgctgatatctctgtctggaacattcagcgcccaaataatcaggtggtttgccccttctgtacccatagttaatgtacacagcttgctagcttactacatttatgtcatgcttattccttgaccctccccacccaaatggtgcccccccttccatcactctcctcttacccttctttatttctcttcacagcatttgtcagtactttacattattccatactagaaggtgagtgtcagttctattagaacaggaacttggtcttattccctcctatatttcggtgcccagaatagcacttggcacacagtcttttgagtgagtggatgaccttgtgcacaatcagttattatcattgaacttcggtaaagcattaattgtggcatctttgtcagatgtttagataagatggttggcgtacgcatagtctgcatgttgtatttttagtctttgaagatatgaagtcaggtaagcaacatcctaacatagtctatttcttgacatctcttacaaacgtagagtatagcctatcctcaggtgtgtgctgaagtttatattagggcttttgggtaccttagaatgtgggtattgcaatctttattcaggatgttatcagtcactggtacagttagtcttgttattaaaagaaaaaagaaaaaaaaacaggtagaagttggaattagccttcgtaggaagaattccagatgcaaatgcaggaaaaactctgttgtccttggaaactactctggagagagttattggcactataattcccaaacctaccctgttaaaagattctgtggaaatgggttaacctttataccttttaagatattgatcttaatgatgttttacaggcagatccagttcctaatggtttgcgagctttgccagttttctatgcctgcacagttggaataaacctcttttccatcatgtatactggagcaccgtgtaagtacctatcaaaatatttaaatgtgaatttaaagttgtttacaaaacttgcattaaatgcccaatttacccctttttgctttacagggctgaaatctcctagaaggtggctggcctgcgcccatttcagaaggctgcaggctagtgtacgctgagttaacctagatagtttttcaaccaaagagacctgctcagattctaaatcactacagacctttcctctttagtcttcacaggatccactgataatatgatcatctccttccctttctcctgtctatgctaaaaatgctggaattaatactgacctcaactactgaagtcattagttatatctgatcttcagtaatcagtcatttaggactggtttgctggatattctcatttttctctcccaaatggagatactattgtttctaagtactaaacttccatgaatctgcttgaatgagaagagttgggatgtttaccacctgctctaagtgcacttggaagaagaaattcatgcagctaagaggaaaaataatttgtgagaatataaaggttgaaatgttgatgactttcatgtttgggactaaggcaaggcatggattaaattatggcgctacaagtttaatttagcaacaacaaaagattggtaacttgtaactggcaggacagtacagttttggtatctagactcatttggcctgatggtctgtgactacataggcagtgacttttattctttatactgtgacccactggatgaaatacaggacacacatgtatgtatgtagagagaaagataactggaatagtgtcatgaagccacttaatgcttactatgtgctatgcacccatattttcaaattctctctttttttttttcttaacatttgttgtggcccactgaaatgatttcagttttgagtaatgggttgtgacttgctcttaaacctcactgaagtagtaagttgctgacccaaagtagagttagctaaatatttttattatttatttatttttttgagacagttttgctcttgttgcccaggctggagtgcaatggcatgatcttggctcaccacaacctctacctcccgggttcaagcaattctcctgcttcagcctcccaagtaactgggattacaggcgtgcaccaccaagcccggctgattttgtatttttagtagagacggggtttctccatgttggtcaggctggtctccaactcctgacctcaggtggtccgcctgcctcagcctcccaaagtgctgggattacagacatgatcaccgcacctcgccaatattttaattttttaccttattttagattgagggattatatgtgtattttgttagatggagctaagtatttttaatcttgctaattaattcttggaataatcaggaacgaaacagacaactttaagaaaatattgttcttacttagactatactgaactgctatgtgccggtgaagagaagtttgtatgccagatttccattgtaaacagttctttgtgataaactaaaaagtctcccatgatgctcttaacactcattctttatgtggtagaagcaaagctcagagatgagtgaaattagaatcattttaaaaacagaaacttagatattttcgttgtgtcctttatggatcatttgtaagaaaaaccagtctctttcctttttgacttggaatgtagaccaacttaaattgtgatagacagtaatttcatgtatattttagtttgtgtgaccacatgatcaaaattgaaagcagaatttaaaatgaaaagatacatagtcaccatagaattgtagtttggggccgggcgcggtggctcatgcttgtaatcccagcactttgggaggccgaggtgggtggatcatgaggtcaggagttcaagaccagcctggccaagttggtgaaacctcatctctactaaaaactagaaaaactaaccaggtgcagtggcaggcgcctgtaatcccagctacttcggaggctgaggcaggagaatcacttgagcctggtaggcggaggttgcagtgagccaagatcgtgccactgtactccagcctgggcgacagagtgcgatgctgtctcaaaaaaaaaaaaaaaaagttcaaaaacaaaaaaagttttagttttgaagggacctcaatttgtttctaattttttttttttttttttttttgagacagagtctcgccctgtcactcaggttggagtgcagtggtgcgaacttgggtgactgcaaccactacctcccgggtttgagcgattctcctgcttcagcctcccgagtagctgggattacacatgtgcatcaccacgcccagctaatttttgtatttttagtagatacgtggtttcaccgtgttggtcagtctggtcttgaactcccaacctcaggtgatccacggacctcagcctcccaaagtgctgggattacaggcgtgagctgccgcgtctggccttgtgtctgatttttaaagattaatcattttggggtatgatagaatttccagtttataagtacaaacagtccctgacttcatggttcaaccttcagttatttgactttttgatgggtttataggtacataacctcattgtaagttgaggagcatctgtgatttcgtacataacaagcaaaataaagcaaaacaagcagaagtaactaagctattcctagatatcaactacagatcattataatatcttttatgggttttttttttttttttttaccttttttgtttttcagggatggggtcttgctgtgttgcccaggctggccttgtattcctgggctcagggtgttctcacacttcagtctcctgagtagctagagatcattataacatctgttagatttaaataggattgtatagtgctttacttcttttcgtttgtttttgtgacggagtttcgctcttgtcacccaggctggctggagtgcagtggcacgatcttggctcactgcaacctcgacctcctgggttcaagtgattctcctgcctcagcctcccaagtagctgggattatagaagcccaccaccacatccagctgatttttttaattttcagtggagacggggtttcaccatgttggccaggctggtcttgaactcgtgacctcaggtgctccacctgtctcagcctcccaaagtgctgggattacaggtgtgagccactgtgcctggccagtgctttacttctgtctttagtacaggctaatggtttggagcctactggcgtgcatatgacagtcagataatgactaatattactcattcttaaaccatgtgaacagtgttgctaggcaagtctttttttaaggtaagacttgtaagtgaaattaccactaaactttgtgtgtgagaaagacaaaactttttttttttttttttttttttgagacaaagtctgactttgtcacccaggctggagtgcagtggcgcaatctcagctcactgcaacctccgccctgccaggttcaagtgattctcccacctcagcctcccgagtagctgggactacaggcgcccaccaccatgcccggctaatttttttttgtatttttagtagagatggggttttgccatgttgggcaggctggtctcgaactcctgacctcaagtgatctgcctgccacggcctcccaaagtgctgggattacaggcatgagccaccgtgcctggctgaaagacaaagcttttacaactattcttaaattatcaacttttgatagataatatccttgttttctgtatcttgctttgatactgctttcaaggagataatctcattaaagcattttactaaaggccagtatagtgaatgtaatcacttttacacagaattgtgtcagcatgacaaatgtgactactgagacatcattctgttaacattaaaataagtttgtaggtggtaatggaatatgtggcagttaacgatcatgagctaggagagtggaacacttgctgtctttttcatagctagtcataggtccttagcgtgtagtgatctttattatcttccaaggtgaagaaaggaaaaggctcgtatgttgagaagcataggaacttgagtcccgcaggtgttcaagtgggctaggctggtgtgggttttcagatgatcattgagtttttctcccaaatttgtataggcactagcacagtaatcctgtgcacttaaatctggcagcagctgtcaggggtgatgggctggtatggggaacccctcagtccccagaggagggtttacacaatattgcagggggctgttgccctggggttttcaagatgcaccattttatctcctagtgctgggctttgacaaacttcctctgtggggtaccatcctcatctcggtgggatgtgcagttttctgtgcccttatcgtctggttctttgtatgtcccaggatgaagagaaaaattgaacgtaagtaataactaaacagcagaaaagtttaactactaatgttgtgtttattttttatttggccacctgtaaaaatctattagaagagattggcaaaataagagattttaaagggaaatttgaggatatgggtttgttgtccaaactgtttttagaaatggacttacatgacctaagacctgttcttaaaaatggacttacatgacctaagacctagtgataaagagtattcaacctatgctgtagagacaatctggggcattgaatttttttatgttccttgatcagttgccagtgacatgatagataaatagagaaatcatagcctacatttactgagaagtagaaggataccttaatgaaaaataaggggtagatacaagatattttcgtagaggaaatatttaccccaactgcttctgtgtataacttcagattcagacaagcaaagctaagtctaatgtgtacatgttgtatataggctagaatacatgtagacattgtattgcagtatacaatgcaaatacatatacaaacacacattgtgtgtctgctagaattgtagcacagattctagaagtaaacattttcaagtgtcaaggaatcatttaggccattaccacacactcatgtaattaaatactgagtaaattttggttagtatcggacttttttttccttaaaataatcattttctgcccttttcatcgatgtgaaggctgggttagcaatttgaagtttatcgtttcgaagctgagggatgcatagactgcagtggtgttaggaagaacgctgcgtcaccgcagctgaaccgaagagcctccgagaggttctgtgctagtctggctgtgccgagtgcacggtgggaaccaggctttcaggactctctggcctcattttccctctctgggaggagttgagacaagtcttgctttatgttagtcagtctgtagtttgactgaggtgcctggatggataggtcagcatactgagcactggcatgagagaggcagaagatactctggtctgcctgtgggatttacagccatgatgcacatctctttgttttatagaggtggaaattaaagttgtcgtctttagttccctgcattgagctgtgccactttgcttgaattgttggactgaaatttgagagaatcctcttttgaaaagaatagaattgggtacagttcagatttttagtttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgctggttgttcccaagtgagagttgctggcaaatgataaagcaggcaggaaaaatgttcctgaatgttaattgaagttcacatacattcttgttttgagatgagttttttgggggtggaggaaaggagacgtggaacaaagtagtatggccacaaccaaaccaaaaaagaccccccttttttttcctaggagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgagttggaattcctggtttcacttttgttacctgcagtggtgaggaggcttattgttttggatttgatgctttttgtattgaatgtcaccttggtgatcttgactaggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaaggtcagttgacattgatcttagtgttgctaaccctatttttaaaccatttatccttgtcacaggcctgtgcttgtggtagtggtactcctagcatttacaggaccccaaataatacaaataggatgaggtaatagcagttattgacataataagacagtacagttttattcttcagaggaattacaaagaatgtttatttttgtagatgataaatataaacagatacacttcacagagaaggcttttgtccatcaagatgagattcagttctttggtagtgaattgtgggatgtaagatgtaagatgaaaaacttaaaagtttttcatatagaatgattttgtagtttggtttgtaaactgtttattggaacctgagagttgctttaagctgcctataggaggaaagaggccaccatttgcctggcattccctccatcagagctgtgttcatttttctgttgtgtatgttggggttccatttatgtctttagaaagaaaggcccttttgccagatgagcttgaaagctgtactttagacaacctggtagatcattcagcagattgggtcttgccaagatctagttctgcctgaaaagtcacttctgccctctttgtttcttccagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcattgttctttttagattttacttgtctggcccttaaacattttggtcagacattttacccatttagctctggtggtctctgaagaaaatgacttttctgagaaagctgtgtatgctaagagcggatagttatgtatacttgccttttatttgtcttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatcttaggggttatagcaaataaagatgtcagtggaggttttgtgactgagtagaacaaagcaggactgtgttaacttgaggtgtagtgttagcttctcaaaaaagtcaaactcacttcctgacaagaatccttttgtgtctgtagtggcttcagtattgaactggcatctgccctcactgtggtgattgcatcaaatattggccttcccatcagtacaacacattgtaaagtaagtgtaatgccaatgtgtgtctttcaaatggttcttctaatatgtagggtttttagttttacttctctgatactttgatttagaaagttttgtgcagttggagtcttgaagagttcataagttatttcttgtgtttattcttatttaagcaattaaatagatattctccccaaataatagaaacattgttttatatacagcttactgtagtttctggctactaacctcttcctttgttactttatcctccctcattgtagtctctttataataattttttttttaatctcaagagtcatttctacttggcaccattatgttttatttatttatgtatgagttggagtcttgctgtgtcacctgggctggagttcagtggcacaatctcggctcattgcaacctccgcctcctgggctcaagtgattcttgtgcttcagcctctcaagtagctgggattataggcacccgccaccatgcctggctaatttttgtatttttagtagacacaggatttcaccatgttggccaagctggtcatgaactcctaacctcaggtgatccacctggctcggcctcccaaagtgctaggattacatgcgtgagccaccgcgcccggccgacagcattatgttctttgcctttggggaagccattcagagcagggtaggtgtatgcttagaaactggcaggtgctttaattctggccaggtgggtttctgctgccatttgtggtggctgaaggcctggttctaacaagtctgtgaggcttgccaaaatgttggcaaagcagtttatttacagaaggcatatttcagggcctctcaggattgaaatactgagaaacaaaacaaatcttaaggttgtttgatgacaatctaataattataggagaaggaagaaactggtttccttaagagcatttaagctggtccatcatggatcctgctgagtcatctgtttgctacccggatgtgtctccagacaattgtttattaggtttaatatcagccactctgtaaataatcttaggaagacttacaatgcaatttgttattaaaagcagtgtataggccaggtgcagtggctcatgcctgtaatcccagcactttgggaggccaaggcaggtggatcacaaggtcaggagtttgagaccagcctggccaacatagtgaaaccccatctctactaaaaatacaaaaaattagctaggcgtggtggtgggtgcctgtaatcccagcacttgggaggctgaggcaggagaatcacatgaaaccaggaggtggaggttgcagtgagccaagattgcgccactgtactccagcctgggcgacagtgcgagactccgtctcaaaaaataaataaataaaagcagtatatattcattaaattttagcagtagctgagaaggggaaaagaaatagttcttgtgtccttttactaccgttagtatagattatgattggattttcaaattgccttcattttcccagcttaacctgttgtaaaccagctttcttggactttgtcttgtccaggggtctggggctccttgtccaaacagtctcaggtgtctgtttgccagaataccactggcacttcaataacctgtttccttggtctgcttctcttctaggtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgtt

SEQ ID NO: 113 - DNA, 4572 bp, Homo sapiens
aacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcaggtcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgtt

SEQ ID NO: 114 - protein, 679 aa, Homo sapiens
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 115 - DNA, 699 bp, Homo sapiens
atggatgagattagctacctgcagggcatggctacagctgtccatccacgcccccatcccctccgagaacacgcttcctcctgcagcccgcttcaggaccagcccacacaccacctcctccaggggcactggggttcctggaaggtgctggctcctcctcccaactccaggcaccctgacgccactttgtcagtgtggttttcacatcctgtcctagcgataataaaagaaggcgtgcaagaagatctatatgcagtgacgtgcaaaggtatcaagaacaagttgcgaaaccccatgaacactaaggactttgaacagatcatcccttttactcaatgttttcataaccttgaagtgaaggtggagggagcagtacgttttaaggtgccaggattacactacggggtcagtgctcccggatatgaactttctttttcagaccgaccttgggacctacagctttgcgagggacagtgccaggccaaggacaagtcacaggtgcaacaacgtgccagaactggatccggagccccagggcgcaagatctcccgcagcgtcacccggcagagggacgggtgtggccaccgggcgcggcaggtcctgcgtgcgctgaaagtgcggctggaggcgcggacggctttccggagccccgagagaggagctaggaatgactttggtcgcagcctctgtaaccccgca

SEQ ID NO: 116 - protein, 233 aa, Homo sapiens [sequence omitted]

SEQ ID NO: 117 - DNA, 4624 bp, Homo sapiens
aacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcaggtcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgtt

SEQ ID NO: 118 - protein, 679 aa, Homo sapiens; identical to SEQ ID NO: 114

SEQ ID NO: 119 - DNA, 33581 bp, Mus musculus
  misc_feature (1)  (33581): n = A, C, G, or T/U
ccgagaggtggaagaggggggagcgcctcaaagaagcgatcagaataataaaaggaggccgggctctttgccttctggaacgcgcggctcttgaaagggcttttgaaaagtagtgttgttttccagtcgtgcatgctccaatccacggagtatattagagccgggacgcggcggccgcgggggcagcgacgacggcagcctcggcgggagcaccagcgctagcagcggcggcggcgtccggagtgcccgtggcgcgcggcgcagcgatgcggtccccacggacgcgcggccggcccgggcgccccctgagtcttctgctcgccctgctctgtgccctgcgagccaaggtaggagtctctctcccgctcttgctccccgcggtcctctcccttccctcgtggcgttctggacgggagcggctgtggctcccagtgcaagttccggagcccttgagtacaaggctccctgaccctgacttttcacccgagaggcagcacccggtgagggaacgctggttccccagaggggagcccctggcctcgaaagataaactcctccaggctgggcaaaatgcgatcattacgttctcacggtccttcggggcacttgtcttagttttcccgcacttgtgttttttatgcccccaaaccaggttgagccctaaacctagtttttgcaaaattattttcacttgccaccgaggatctttggcagcctggggtgtgtgtattgggggtggggggtgtcaaggagtctccacctccaccttcagagaaaactttctcatgcgttgaccttccttcctcgctggcaggtgtgcggggcctcgggtcagtttgagctggagatcctgtccatgcagaacgtgaatggagagctacagaatgggaactgttgtggtggagtccggaaccctggcgaccgcaagtgcacccgcgacgagtgtgatacgtacttcaaagtgtgcctcaaggagtatcagtcccgcgtcactgccgggggaccctgcagcttcggctcagggtctacgcctgtcatcgggggtaacaccttcaatctcaaggccagccgtggcaacgaccgtaatcgcatcgtactgcctttcagtttcgcctggccggtgagtgagcgacacaccgacagagtcgaacgcggggccgagccctatattgccttgagaaggatttaatgccacttgaaacttggcactaagttgagaggctttgggggtggcaagtttgagagtccagactacagctggacctggacaagatgagacgggcgggtcttccattctgggtggtgtctgcttagcgcagcgaaatggggtctctgaagagcattgctgggggaaagtacgcaaggatgctaattttatgcttgctacttccagttcccaccctcgaccaggcggtcattatagatgatttctttgcttaactaattaaaactcgtagtgccctggaaggcgactgcgcatagtctgccctgcatacgctgtccaagttggcaccctcccctttcccgtgagccgccccgagggcgggtgtgtccttcctgcagggtgtgggggagcaggcttcccgcggctctagtggggagattttagtgtgttggaggggtgctctcccagcctgaagtggcggctgcaggaggggggttgtctccggctggcgtccaagctttagtctgggaacctccgccccctgccggccccttcctcccgcccccgctcggtgcagcccaggctgccttactcccagcggttccccagttctggaacagctgtgtttgcaaacttccccgggaagggcgggcgcactctctcgtccggagggcacccggcctccgcaagcccttcccgcgccctagtaaggcttagaagaggcagcccgctataagtcgtgtttgcgggtgcaactgcgtgcgccctcatctcccccttttccctcggagctgcttgaggccggcgtaccgctggcagactgcggcagaacccttgcaacatcccaaaatgggtggaaggaagatgggtgcgattgcagaaggggaggaaagggaaatggtggggggtgtgcccgttgtccaggaggcgtgactcgctgccaggactggtgctccgccaagcttgagctccgagggtgggtggtaagagggggagatctgtgccccagaggattgctttccgccacgtgctcggatggggtgcgctctgctgcctcctacccgcggctttgggctgtgatttgaaactctgaagaggggcgggagagaagcctgtctggctgtctgtgtgtgaagctgagctggctcttaatgtctgcgtttacaggagttggcctttgctgtgggtgcgataagacagttatcgaaaacatgctattaaaaagggtcttattttggcaggggactgccgctgtaggtgaaatctcttcagatctgaaggctgtgtccgctgtgggatttcacttttacaaagaatgtttgtcttgtttgttaatcccctattagggagaactttaagctaaagaggttggccacctctaaatctggctgggtccattcgagcttagggtgagtactggctgcccttgagctgtgtttggagttttcgggaggaaggggcttgcaggtggttccaccctccctaggatcagtccgagcccctcgcttttcacaagaccataaaaggaatcttattagtgatgtggaaagaacggcaggcctggctgaggtttattttggagagaggggtcagggggaggatggcttggatgaaagcagacagacttgctccacaggctggctgggggaaagtgacccagaagtgtggctgtctgcttttgacacctggaagagagagtttctcaccgacaaggagcagaaatggtgtgagtggatggatggagggttgccaccactgctgggctcctactgttcagtgccttcaggccccacgggtcaccgaccatgaaatagactcgggttttctagaaagagggagccccactgggtcagcaccgagaatgtggttcttttttgaagctgggccaagtacatggatcactcctaaacaagtctccacactgctgcccccaaacaggcctcctgcgaaacacaggctttacttccgaagagaaactcaagttggggggnnnnnnnnnnnnnnnnnnnntgtgtgtgtgtgtgtgtgtgtgtgtgtgtgtgtgtgtgtgtgtgtgtgtgtgtgtgtgtgtgtgtgtgtgtgtgtgtgtataaactcaagtggggtgtgtatgtgtgtgtgttgttttagtttattttcctcagtgtggttagagaaccgctgctgtctggaacttccaagaatggctccagggtgagtcttagcttcaatgaaagccttaagcttcacaagtgttagtaatgggtcgcacagcttcattcgctttgataattaacacgagaggcttgtttttaaaacgggctgggggtgtagctcatcaaaataggtatttgcctaccattcttaaaggtcctgggtttgaattcaagccccacaaacttaatttttatttctcctccttcttagttagtttacagtggaattggtgtggagatgttggaatttcagagtaggccataatttaaaaggcaaacaaagcctccagcctaccttggcctcatagccacataagctgccaacccctaagcaggcacagttgtcttttgggctaagtactcctaaattggcttacggagaaaggaaacactgtgtttggtaaagctagttcagtgaagaaagtcatgtaattcctttcttttgattgctagtatggcccctgttcgtggcctatagaggaagaggaggaaatgatctggtaggattgaaacacagtctacatcccagcttgtgagacgctctgcagtggacgtccctgccatctcagtatcgcattcgcttatattgcccttgggctacatcctactccagtatcagttgctctggccccagtcttttagctttgtgcttctgattgggttgtcatccatgctgtgagggagctcaacttgcagcagctagcttgatttattattttccaatttggatactaggtgataagagcatagttatgacaggtaattgggcttaacaagaaatgatttgggaataaccattaataaatcaccgaaatggttaatttgcacctccccaaactagctcaaaatcccagtagtgcctgctcattaaaaatgcattagtataattacttctgtttttgaaaacctcagtcatatggctgcattggtggccctaaatttgtaatgacttggggtaaagcaacaggggtgtctggctttatctttaaataccactgaccctattcagagtcttgctgagagcaactttaattattttaggaaaagccaatgaaacgtgaccaatgtagcagaagaggatgccagcttgaacccgtgtcacacttatagcctcagtaactaaataacaggagttagagtcaagttgccatcaggtagttaatcacagaatctaaattgccagtccttgggtatgattatgctgtctgctgtctttcctctagatgtgtgtggacacatggaagagagaggaataagactctctttaagttagctttttttctgtacctcacctgtgtgccgagcatgtatgcagacagtgcgcttgtgtaagtgctaagcacaagggatgatgtgtgtatggagagaacattgtttcttcttcttgttgttgttctaagaaacctgcctcaaatgtttaagttgctttactgggcttttggggaacacggaggtagagtggctttcaagcactgtaaaacagctgtgacctggagtactttcttggttcctaatagttttccttttcctgcaggtatagacctctctgtgttttcttcctccttttcttgtttcttagcaacttgctcaaacctccagtacgtaaaagaatctgcaacccatcaactccacacccatagctgtgtagggccttggaacatttgtagagaatagtgaaggctcagtgctgttggtagctgaattgggcagaggcagaggcagcagcaatgtggtaggggtaaacctcctagagagccagcaatctgaatgctgcctaaggtctttacaagctctggtaccttcagggacactttgtacagagggcaggtgggaaatttaccatggagggaaaaggcgctttgtgagaaaacaaggctaaggctacaaggagtcctcacttcacatgggagccagattcggagtagccatgttgtggaaaggcctaacttggttccagagtgtcaggctttctattcacatagattatttctgcgtggacgcatagtctgtggttgtgcacactgccagcttggtaatccatagtgacaaatattcctgagaattcttcttggtggagctttagagacatacccctaactagcccaaggttttaggattcaaactgttcccaagtgacatttggctccagcccttaaatctactttaacaataatgagaacaaaataaacttttcttccaagggctggaagatgtatctggaggcatgaaagtgaggactctgacaggatggggagggaggtgagtcttgggctcagaaaactggtgttgctaggttactgcttggcccacagcagccccttggtccttactcatagtgtcagtaacatctctctctggagcagcatgtggactgggaagacattcccagggtggctcctagtggttaaagggggcatgtaaataatcaaactgagccctctaccagctcagcctagtttttatgcacttttggtaaatcagtagaaaggcttcttgtttgggcttgctctgtgtgaactggacggttgtgcttggctggctccctggtattctatctattaacctcaccacccttttgtaactggtgcatttaattatcagtgggatgcctttcaaacaggtaagggtaatgatgggaaaggggttaggggcctctcattgagagcctgcaatctgggtatgagctctggggccccttggtgagtctttgaggtgggctttgatgagaaaatcactctttgtggccagatcacactctattgacatgtcaaatcctgcaaaaatggtcgctttctgtggctggagcctcagcttgcatgcacgaggggagtggtctttttttccacccctcaccttgccaaaaccctaaaagacaggaattgtgtgtgcccacacatggactctctgaactcgttttttgtttcccatgttttgtgactggaatattttatactctggccacccagactcaggcaggacaatagagttggctggactgactgaagtgcggattacagagaagaatggggcctctccagaaatactgctaatacaggacaagtgacaggaagcaacagttgagtcagcagagcgcatgcagggcccctgacagacctggggccagcaggctgtgtacaatggctgtgttggcactcgggacattctcaggatgtgcatgcctctggcgggcctgcctgtcgcagcggtctggggttttggactccccacgcgtgccatttggatggcggtttgtttgtgtcggtcagcttggcaggaggggaggcagccgcttcttagggcttggtttggctaccactgttgccaggaaaaggaagctcccagctgccaacacaatcacctttgtttcttacatccccccctgtttaatgtggcaattaagtgcttactgctttgcccagtgccaaggtaacctccatagagtggagcaggacaaagaatgaaccctagaccagcagctcaagtgtggagaataggaggaggaggaggtgcctggtggcccagccttggtaaggtgaccctgtgaccgtggtatacctggagggctttgatgccaaggtaaaattgtatggaaatctcccaaaagtccgttctgaaagctgaccagtacttttgacgcttcacaagcatggaagccagccaccttactgccagatgtccttgagcctcaagctgggaaggggcagaagtgactcacttgcaaatccagatggatgatctggtaactatcgtgtgtctcttgttttgcctctcagacaactactctgggaagactcaggacaaaatatgaaatctgagtaattcatcaaaaatttcttttattgtttgaactacagcaaaactcaggatttgcttgttgtttgcttttttgggtgtaaagttaagatcaaggaaaacttgccttttgaagccccttacaaactcccataggactggggacttggcctctgctgaggatgggttttgtagcatccaatcccatgtgggtgatttgtggctgggtggcatgaggtccacatggtctaaaatctcagtgtccggacatatagctggggatgtacagaggtcaagcgtgggcctgggaaaaattaaagctccctagcaactaataatcattgccaaattatcttgattgttgatctatagtgtggggatggagtgggagggaagaatgcctcttaatagaagccttggagggaatcctttctctaaaggcagggcacccatgccccaggaaacctggaactccaatgcatgctttcaagagaaagcaaagtccaggcttggctagtctctctccacgcccttacccttattctagcccaccttcaacccccaaaaggaaggcacttgattaggggaaaatactgccagcccatggggctgtgggacatttcttttccatccagctggggtagtgttggtcagcaacttttgagtccaagacgaacctggcagatggcttgatcttacaagttcttgtgcaaggtctaaggatgccttctgccttgagaatgaagctgagttaatactgctgtgccagctggttccaaggcaccttcctttgcagtggtgtttgtgggtatgatgtgtgtttagtgcttgtgcaagtctgtcaaaactcttggtatcaatgcatttagtcagaggattaattacagcgatattgttgaagtgaaggatgtgggcctcaacgtgaccaacaaatgaagggcttaattatacagaatcagccacacatctggcctcatttcgacttggctctcactgtgaaccagtagagaaatataatttcttactgctcttcgggaagagtcctataatttgtaggaagtcctagggaacttaaagaggctgtaaataaggtgtaactttcactaataaaatattaacgacaataacaatgtattcggacctacaaccactaacaggagagcgtgaggtatgtgtcctggcttgcccggttttgcttgctttgtgagcattttcccacagttatcagtgaacgaaatggaatcctgctgtaagtatgaagcatatttaggctgaattccaaagcaggggcctatcacaagatatttttgtcgtcagagcagacctgctgtgtcaccgagagaggagtgagcttccttgatttatgaatgaaacctcctgcttttctctcatgcctttcccctatcggtgccatctcttcccctggcagcagtgttttctggtggcattgtggttatctgagcaacagaagcattgtggcaggcagagcagcgctgcacaaacctgttgcagtcctgtttctccgctgtatttctccagcacccagataggcttagcaagattcacctcaatgcctgttgtaagtgaaggttggagtaaaagtggaaatttgctaatggtttgggtcttggggtgaagcggagatggggttcagagacatgcttagaagattaaaaaaaaaaaacaggtttcagtaggataactggcatcttgccagcctccagggaattgtttagttactgaactgattattccaggaatgttagatcttattgacagatacattcatcaataaacataacccatgggtgtgcggtgcccgtctcctttgtgctttctcccacagacagccacaacccaccccaccatggaagctaggttgctgcctttgtcttaagtctttgagccttacccctccttttttcctagagtcacctgatacttgtgggagctgggatggtctcacacagacagggctttcaaaggggttctgaaaaggaaaagggggcctccctggggactgctccaccagggcccaaagcgtaaccttagcagttctctctcaggacaaatacctgagtaggttggcttgggataaattctttgtgtgggtttttttctcatgcactaagactagggactgaaaagttttgggaaacctatatgctacgtgttcccatataggcaggtactactttctgatcagggtttggagcagcttggcttgctgggtgtgagccccagtgttcccctgccaggtgaaaggagttatttgtcaacctgtgaagagcgctgcagcgagaagaggttggtcaggcttcaaataccctgttgccttttttctgccttctattttgggttggttcctggtaccagagcaccagagactgcaggcagcatcagcatcgtagagttgacccctgtatgtgaatcactaaactttgcttatctgtcttgcagaggtcctacactttgctggtggaggcctgggattccagtaatgacactattcgtaagtatctcatcaggaattcttctttaaatgctggtgcgtttaaagtgctgtgcttggaagcacagaggaaagcctccagtgccccacccccaccacaggctgaacctatccggggactctattccttaacttctagaactttcaactgaaatattaagtagccagaatagactcccagtttattcagtccttgcagaaagggacatagtttatctctggatagagatcttaatggttttacaactttaaaaccttgtagactgccaaaggatcaaagtagtgactttttaaaagtccatttaaactttaagtgagcatttaatctctcatcagaaagataaagctgtaaagggtggtgctgggctctaaagaccaaccttaaatttcactcagtgggcaggtgagccccacgtcagcctgagtttcccacactgctcaccacaaacctcccattgaagccgaatttcagagccccccgcagtcaggacctgccctgtccgttttgaaagatggctctgttctctgggcaggttgcttttcaggcctgcagagaagtggctggggcttgtggggtgtgtggagaggtagtgaaggtgtactctgctgatggtggtcaactctattgtaacacgttcgttctccctcccagtgagatacacagttcctcctttatcaccagagcctggttgcctttggaaaacctgattcactcggacagttttgatctgttcaggaaagagagttgatccatttttttgcctttgcccactgctctcagagtgcctcacaccttctacttctctcacttattcaccctttcttattttttttttttctcaacatcactgtgctttcccaccataggtgaaggtactgagtgtccagcatgggcctagtcacagctgctcataaactcaatggcagctcaacatggccgactccttgggcctcttagggtcacacaatccttggcaagccctggtgtgcagcaggctgcctgtcactgggattactttcttgctttggtattcagctatttagacagcagccctgcctaggagggagtttgtggaaggccaggatctgcgctgtctcattgtgatagacatttatatgttgaggttagtggtaggacacattgccaggcttggttgatgccagccaaggtcatagatacctgttagtcctccccacaaaacactgagctctgcatggacatcctatcattgtacccttaatgtacaaaacgctgggtaggggacagaagtgggccttctgagtgcactggtgccagaactaaagctgggagaggattcctgcccagcatctgtagaatctctgctaagctatctgtcctctcactttccagggctatgcctccagggacctgaggcctgcccacagttccccatacttatccacatttccaggcaatggaaatctctacattttgggactcctggatatctcatttcttcctagggtaactagtctctggataggagacaaagaagactgagatgagaacagtttgctttcagatctttcagattttagaaagtgagacacagtcccagatgcccatcacagttatagaaacttacagtatgagccttgggctttgtggtttatctgtttttctgttgactctcattatttttcatctgtattttccaaggtaccacaaattgccgagtcaaagccaaattggaggtccaagagcactcccctttaatggagccctttctgggtgacaagcaccagtattgggacagctagtgccataagccattcatttggaaggcccctatgtactttatgtagcatctgtacctatacagcctccaacttctgaatagtcttgatcttttgctctccatatgaacccagctgcgtcctgccatgtctactgctgccctgatccacttcactgcctgcttataccttcagagttagtgttactgctacatggcctgtccttactggctctccctggtcaactttcaatatcttctccattcttgggccatcttattttttttttccttgagcataacatttgatggtcaccctggtggtagaagctaacagctcacgggctttctatagctcttggtcagatctttgtatgccttttcttcctgatggcttgtcttaacacaccgtgtctactgtgtctgtttcctagccattcttgattcacttgtatcctggagtgtatcacattactttcttgtctcaggacctttgtgcgcactgtttgtatgtttggctccctgttttctttaccctctgcccttacaaagcatctgaggatgtcaaggaggagcccggtagtgtgggctgttctttggttgcaaagttcatcaagttgcaaacatcctggctttgcttgtatcttataggcagatccccaagtttgggtcagaattccttttcacatcagctctgtaattatccccaaggaaggttttgctcgccattctttggtctgtgtctatttgcaaaaactcaagtataagtctagaccggattaagctcaggtgcttctgaagttccaaggctggctcccagcctcagtcttccagttgttcctaatatggctcaggagtataacatctttatagatctctttttccacctgagcaaatgattttagtatattgtaacatttaactgattgatgggcaagcatacccaggagtcctggagaccaaggtttccatacagcagagacttctctcagctaaggtcattatctaggttttctgattggtccttgagttgtgttcctggtggtccctcctcctttcttctgggtgtacaaagctctgtgtatgcttcatgatgcatctttacaccagtgacattaacagggaagtgtgctaatactcttttccagccctaaggctggagctaccccaggtgagctgccccctgtccttagtggtttaagccaatgggagagctgagtcaggtggtagtatcgaatcatcacacagtaaactcgggctctgtaacccagacagtgtagagcatgctacatatttcgtagcctcatggctccgtggttgtaaagttatttccatagctttgttagccacctacccttctgtggattctgaagttaccttcacagaatttcctgaaagttaggtagaaagtgcaccaaactatacagagtcctttgttaaggcacatggctactgtgtttaataattccttcattaagctcttagagcaacaccggaatagcccactacatttctcaacggaaccagcaaagcaaacaggcagttagtggagaggcatttttgccattctctagtctgtgtgtatttgcaaaaacttgagtacagtgtgacatgcatgcacgtggttctacatgttactgaatgtaagctacagatacgtgggctttcaaggattgccctacccacaccatggtccagactggctggggctgtgttggttgtgcatagagccacccaggagttgttctcctggtcacctgtagggcttgtctagctttgtcaaagagcacaggctcaaggcctagaaaaacagtggtgtgggtgtacaggaatcacaaagacattgaaagtaggtcctaagttgcctctccaaggtggccttgaatttgacaaggtgatgactagcaggtttaagaaaacaaacacagcaccaggttgagtgctgacttagagccttgtctgttcacatcctcctgtacttcttgcttctgggctttaaagctattttagtacctgtctcttagactagcttgtaggtgacctcaggagaggggccagtcatactgcttctgggaactgttgggctctagacatttgctttgcctctcaggcatctttaaggtacctgacttaaaacagacacaaacaaaccgaatgccttgacctacctgtctgcaggctgagatgaatttagtcatatgatgagaagagtgaactgaattatgtttttgctgttgctgatggaatgccagcttaaaagagtttattagtggtttgtttttcacatattacaattcaccccttggccctcagtgaggaattttgaaatggaactttttctaagcaagacttgcaagtaaaatgtaaaaaagaaaaaaccaaaacaaaacaaaacactaaccttgtctggaatagtaaaatttctttcagagcaaaatctcctaaggcgcagctttctataacatttaggagtttttgaacatttgctatggacagcaatatgttagaaaagttggcaaaggatacggatcacaggaacaaataaaaatactgtcactaaaggtcagttaaaacaggagatactattgtatctgttggacctgttgtgcagagatgagaaactgagctgtgatactgttgctgaggtagcaccttatgctgagggtctgcaggttttgctggcaggtatctgtgcatcacctggggatggaatgtgttgtttgtgtccactgaatctgttagggtatttcttgctgctggccaacatgcattcaacatgcttattgtagctttgaataacaagaggctaacttaaaaaaaatatatatatatatatatattttaaagactttcttttttatgtatgtgagtacactgttggtgtcttcagacacaccagaagagggcatctgatcccattacagatggttgtaagctaccatgtggtcgctaggaattgaactcaggacagtgctcttaaccactgagccatctatctctccatccctgcaagagactaactctaatgtcttgaatgcctacagatcaaggaagaggtgcatttattcaatgttgtttccaggcacctgacaactagtttgaatggtaaattggcatacaaaaacgagggtacagctcttgttactatttttttttaataacagtttgatttttgtactgtgtgtgtttctagtccgaaagtaggcaaaatggtcaaatcggaagatgcttatgtgactgttaatgagtttcatcttcttctccccctctagaacctgatagcataattgaaaaggcttctcactcaggcatgataaaccctagccggcaatggcagacactgaaacaaaacacagggattgcccacttcgagtatcagatccgagtgacctgtgatgaccactactatggctttggctgcaataagttctgtcgtcccagagatgacttctttggacattatgcctgtgaccagaacggcaacaaaacttgcatggaaggctggatgggtcctgattgcaacaaaggtatccaagcatgcaactggatgcataaaactgcaaatgatgttggcttatcagtttgggtaccaggttctcacccttatagcagtcgggtggcagggtgggatgctgccgctatcattatcttagactgaagcatgtagatgctgtatgtagaagattctgttagtgccctgtctggagtccccgttaccagctggtgtccccatcccccagctgctgtgagtgttggctgctaagagctcgcagctgctccttctccagggagttgtccttggccaggcaggagccactctctgccccatccctgcagcgaacagttactgagtggctgacacggggggatggggatgttgggaaggccagcctctttgctttaacactgtggagtaagattcacactctggaggttcccctgggatcacactgaagtcagaccccagctgagaccacatccttgctcagctcctccttaggcctcatctggctccccattccttcctcctattaccaaatctcctcctcagactgcttctgagaagagcctgatgccaaacaggaccaggccaagccagtggtgtttgaacagacagtgctatgggcaatgactgtcactgagctcacatgtcactgcagcacgtttcactgggcatctttgaggttgcggcattaaaggaggcgggggaagtaggtggtaaccttgggagtcccttactgtcttttgccccttatactagaattaaataattctaattcctagcaatagagttggaggtcacagcacaacagatgctatgccctcacggacatataatataccttggtggtcttggaaaatcattagataaactccttcttttagctttaaattgtgtggaatgatgcaggagaggatatttggtctctgaggaagtagtcctgtctcctggtatctggcgacagtagtttgcttaaactggaattgatgacagaaggaattgctcaatattttaaaattcagtagcaattactgaggttctgtgttcttttttaagtgtccacttgatttctttctttctgtgagcaagtatagaacagcttgtaagcttacttgtctgcaagatcagcttgcctggttttttagctccatgggattgttgaaaccaggcatttagtgggaggctcacctgaaaataccatgctaggaccatgttggggcagggaaggcaaatgaatgaatgaatatcttcatttttcctcttgatgaggggggaactaggccctgacagggctcaaggaataagcatgttgaggaaccccctaatcatttgtccccaaacaatgttgtgacttgaggttctactaacatggccttggagtttgaacctggatttattgggcccccaattctatgtactagaccatttacataactgtggcccgaaaggcatagacagcgctaatgtaactttccgattttttttccagctatctgccgacagggctgcagtcccaagcatgggtcttgtaaacttccaggtgactgcaggtaaatgaccaactaattgaactctagtaatcaatcactttctcccctccccaccccacccctgccctttctctccctttctctttgatgcaagacagaaaaactgacttccttatgaatgtgcctcgttattttctttggaggatgaaaaaattaggggaaaacacaaaacaaaacaagcacatgagaagcataatgaatcataccagctgtttggtggaatgcacccttcttcattggtgctggcgggtgggtttagtcaaaaccccaaaccaaaatccttaatgggcatagctggcatctttgtgtattaactgttctgtaaattggtaagacctatttgtaatcttccttaagtgctaatgtactggactgggacgaagctttgtttcccctgtctcctcctccaccctggcttttcctctggcaccctcccccacttttcccatcaataggcaaaagtccagcattctttagaatgggattagtacaatctcctggcccctttgcagtgggagctgcgctgttgctggaggttaatggctgtgctggaatctgctcggtggagcctgatgaatgtagactttgctgctggcctttgaagtctgctctttatggtccagggacaatactgaaaccaaacggaaacctacccagcctgtttccccttccgatgccggttttgggggctttttgaaatgtacattatgccaatttggaaaaagacttgtttcaggaaatacctttggggtctgtggcatttttgactggtctcaggctttattctccctgaagcctttcagaattagcaaatttgatgagacactaagtggaccctcttcaagtcctgtcacctttgctctgaaaggctgcactgacttgagccaaagacagttttgaaacagtctaaaggcacaaacccatagaaggaggtgcctggtgcccttactaaaacaaaacaaaacaaaaaaacagtttttggtcaccaaactgtagaatttacagagaattgttagaagtgcaggttcccagttcccacaactggcacagatttcccaggccttggttgggcctaggagtctgtatttgacaactttgctcagtgatttatccctcagcaaacacgcgggctactgctttaaccagccacccataggtttaaccttgatgactcttagccccaccctgagttctcttccccaaccatgggagtgcaaacttgatgcttaagagatccaaggcagcgggagtaaactaagaacaggttgtcctggaattgtttcttcctgcttttgaaagttgatttccaggaagcctgaataggatttgcccactaaggaacgggcctggtcacagctgacccggcatccaacagcatctttgtcagaggtggagcagaaacctaccttcaatgactctgctaattaaggctgttctggagaaagtaagagcgctagttattctccagcctctgagcctgctccctgctccgatagcatcagcgagatgtgtgctactgtcatcagaataaacaccctgctgggcaggggagggccctcctagccagaacaacaggctttgtttccagaattgagccctttctctttcgaagtctcacctcccactccctgcccagacatgcaccagtgctcttatttacttaaggtgcaactttcccacacgccatttgcatagtctcccagcccagttccttctctctgccttgaaagaaaatcaaaacagaaccttccagctaaggaagttcaggttgagtcctgctcccgaaatagttgcattacaagttacctgtaagttgtcttttgggttatgtattacatgagctttgttgttgttgttgttgttgttgttgactcacccacaggagaaaacttcactgattttgttggtctcaggtggacttgggttgtcccttactgggtgtacagactggtttcgnnnnnnnnnnnnnnnnnnnnctggtttcgtgccagcctgacaataatatcaaacttaattatgaatcatcatctccagaacgtcagcttctcatggggctgctaatcatctatcattaccccgggataacgtggtagatgcctctgttagggtcaggatttttatttgttcttgtttgaagtcatccatggcctcctatggttgcttttttaggcttgggcattgagccttcattaattaggaggttggttgggtcctcagccgtccggcttggttttattaggcaaactgaagacgtgtagtgacgcttcacttgggacaacgcgggaggacagaggattgtggtcccatcagttacctcatgtcttctaagctaagaatattgatctgacagaatggcttcccaccctcctacctcccactgacttgggtgtctgcctctgaagagaatggttcccatctagtggcatactctgtccttagatcagtcttttcaatagtcatttgtcatttaaactgatggtctagtttagagatgccagactcctgtgtctgattaacttttaagccccacattctagtggttgtctgtcggtgtttgggtgtagatagaggttaggaagtagtcaggattctcaagggttcagtggcttctcagcctgggtgattagctaatagctagatttctataattttcccatgaccaggatttgctcctttgcctccagctctctggaactgaaagcaaagttcctcccctccccctccgcccccgccccccgctccccgccccccaagagtcacagcagagaagttcacagggctttggatctgatcctgcatttccctaggccctgctctgggctgattctgcaggcccaacatctgctccatcttcactctgttatcagcatgccggtgggtggctgggccctgcctttccgagagggccctttgttaaagcttgattttgagagggaggttcaaattgcagagggcttgaaactaacttaaggggaaagtggttttgagaccttgccctgtcccaccccaggtgaaggttcatgtttgtggttttgtttgggcatcagacattccatctgacctcaaaagaagtcttgaactcttagaaaggagacccagctccctcaaagctagacaaatcaagcttggcccctctcttctgaccccccccctctttttttctaaagtgaaaaataactataaatcagcatgcctggcttgggtaatgggtcataaattatatatgaattggttcccagtgttgccgttccccgttcccctctctccttcctacagagattggtttagagatccagggctctgtaaggaggccattctccttcccatttgagtctacaaaaccagcgaggtgctaccctggcaccctgtggccctgaatcctgtgcactctgagcagagtggggcttcatgtgcattgttgcagagctgcacagctggtgtcaccagaggctccttcccttgtatggtctgtcctgatgaggacttgggattgatttattcccatccccaccccttggttcaattcctgagagactgagaagagaatggctttgtgcagggcaccccatgctggccgctccctggatagctcttcttttgtcagggtatgctgagaggacacactttgggccaactgtgaggttactcatacagaaccctgtgaaagtctgaaaaatctgccatcctgtccttttcagggggcaaaacccagaaatagctgtgtgttgtaactatgtgcatccccggctgtttgtctgcaggtgccagtacggttggcagggcctgtactgcgacaagtgcatcccgcacccaggatgtgtccacggcacctgcaatgaaccctggcagtgcctctgtgagaccaactggggtggacagctctgtgacaaaggtatgaccattgtgaagccttggggggtggcatgagggcttagtgggcgggaactgaggttatgggacaggttatgtatgtgaacagacaccgtgaccaaggcaactctaataaggacaacatttcatgggggctggcttacaggttcagaggttcagtccattatcaccaaggtgggagcatagcagcatccaggcaggcatggcacaggagaagctgagagttctaaatcttcatctgaaggctgctagcaaagtactgtcttccaggcagctagggtgagggtcttaaagcccacgcccaccagtgacacaccctctaatagtgccattctctgggccaagcatatgcaaaccgtcacaaacagtaatagccactctgtatttttggtgttgctggggcaacccaggtcctctgagatgttagtgctcagctgtagccacacccctggccctgtttaagttgttataggggctcttattaggaatgtgtttcaatttgcctttaaagttggtttatttggggataagccatatttttttaaaatggcatggcctagaactgggatcaattaggagtttttttccctaactttggttttttttttttttttttttttttggcagatctgaattactgtgggactcatcagccctgtctcaaccggggaacatgtagcaacactgggcctgacaaataccagtgctcctgcccagagggctactcgggccccaactgtgaaattggtaagtggccgagctgggagggggaggggtccctttgcgtttgtgtcctgcacatccagtttcaaaaccaaataggtttttgtttgtttgtttgtttgttttgattcacttttttttttaaaaaaagacacaaaattgggtgggtagaaaaggggtgttggctgtgataggatttggggggaggagtgaatatgatcaaaagtatattgtaggaaattcttaaaatatttaaaaatttggagctggaaagtggtagcttaaggtcacaggtggatgatcaccaaaggatccaaggatgtttttgtagctaaattcagtgacgcagtgaagaggtgcaggacagagctagacaagtggtgagaagacgctagattatcctatttaaatcactacagatggcattattttgatatggccttcataatattcatggagaaacatgatacgtgagtgtgagtgtgtgtgtgtatgtatgtgagagacagacagacagacagatggagagagagagagactatacactgaactcacttgtgaaaaagaagaaaaccgcttcaaagttgagactggttatcccagaccttctgtgaacctatgaaatccccaacactttgtgttgagtaggttgcaggcttttaaatgaaccggagttctaaaaaggtattgaaatctgccttgagccagcttagttggagagtgtcttcccttttgcgtcacagcacagcattgttacatctcaagcttgcttttgttgttggtttgtcatcggcttcaactagtcgcagaggcaggggactggcccttggagggaagggccagttttaccgcattttaccgcgttgttttaccaccttgctgactgtctttctcttgtatgcagctgagcatgcttgtctctctgacccctgccataaccgaggcagctgcaaggagacctcctcaggctttgagtgtgagtgttctccaggctggactggccccacgtgttccacaagtaagtcagtccaggttttgccatgtgcctgttctgcaaggttattgtgttgagagggagggttggtgggagagacttaggctgttcaatatatctatcttggtgacagagggctgggtgcattcgacaggttagtggctggtctagtagctcttgtatgattcctagaatctctttcctacccactaaggtggctggtgatgtctgtggtagaaatcaatcagattcccttgcatgtgtgtttggagtggtctcctccaatcctataggaaaggaatttagatcaactactgaatgttgtcttgaggtgccactttgctttgaggcttggccatattattggggtacttttcagtgaagaactctggtcatatatgatctcctccagaattaggcagtctgtggtctttagagagttagttcctgaaactttgagggttaccgaagcctgataatctactgtctttgacaccttaggagcagtgtgtggcatggctaagattgttctggaggctgtaggtgcttctgtgactaatggaactcagcaggcctttcaacctttcctgggccgtctttaaccagggaagcagcagttcccatttgggagggttgttatatagtcttggtgagcaaatttgtgaagagtgtgtggcacacattgtaaatgaatgagatctctggcaggggctcagaaaaatcttctaaggaaatcacaggcctaagatttctctatgtgtaaagaagaatgccttttccatgcctcctcttggtgtgcagcctctgaaccatgaaggaaagagttcttttaaaagtgaagattaagcagataagaatgtcccttgtcaccactgagttgatgccctgtgtgtctccggctatctttctttccctcgatgcttagggacggattaactgaactagggcagtgagggatttcaagctaaaataagggcttgggtcctttcatcacctcccttccctgttgtggcttttcttagatttgtagcaggtgtccgtccggttcctaggtgaagactcttcttgtggagagtgctgttgcattatctaattgccaagtggatcaaatgaaattaaattgccgcccctttcttgttctcattgcattggacagacatcgatgactgttctccaaataactgttcccatgggggcacctgccaggatctggtgaatggattcaagtgtgtgtgcccgccccagtggactggcaagacttgtcagttaggtaaggaaactctcgtgactgtaattctttgccaaggttggctgtgctcctcagagctgtgaggagggacgagcatgtggccagcagtgtgtgcgtatctgtatcccatcatacgaagtaatttattatcagggtctaacgagcctgggagaaataccttgcatgcaaatggcctagggtttttaggtcctgtgggaaagccctgggattccttgaaccatgtcaattgtcccaggagtgttcagctgggttctaaacagggatgacctcgtgaggaacgagctgtctgcattctttttgccacatttaaagcccagcaactggattgtgctgggttttgcacacaagtgcctggtggcttgctgtttgtcagccagcagcccaaaagaaagttatcaattagcaacccttgatggataaaggctgggagagggttccaacgctccaaatagaagacacctcctatttcttatttagctagcttgttaaaatgtctcatatttcagaccagcactatggtgttttcatttcaaggggacagcagtggggtgggggcagtcccccatttgtcactgttcatccttgctgcttttcagatgcaaatgagtgcgaggccaaaccttgtgtaaatgccagatcctgtaagaatctgattgccagctactactgtgattgccttcctggctggatgggtcagaactgtgacataagtgagtgactttgttttgattttcatgaaacttgggtgacaagtcttttttccattcatccccctccaacccctgctcgggttctgggactcttttccccttactttgtgatgttaaggacggaacccacagcttcttgatataagctgtttaagcaccttccagctgaatagaaggaaaaaccttattagggggaggggaagggaatgtttttggagagggaggggccaggctaaagcagtaaggaaaacatacaatttatcaggcttgttagttgctaaaattgggcatattctgataaggtgatgagaacaatgaggtgaagtttcactccctcgtctgggaggattagggagggtccccaccctgtggcatagccttatctcaccggaagcacagggaaatctgattgaaacttttatcagtcttgtacttttcaggtgaacccgaattcaatgtcacgtgcctccttaatgtgacggcttgtttatttttttcagatatcaatgactgccttggccagtgtcagaatgacgcctcctgtcgggtacgtaagtcattgcttgaacagaaaccttgtcattgcttgaacagaaaccttgcttgacacatgacaacaatcttttaagatttatgtgacacgggagagtcttgctcctatgggatttaaaatgctggtgagaagctgagtccctcaccaaccctagcttgtcaggagcctcttaaaggcaggcattcggaaccgctagtctgggcccaggcttagcacgaggccatttcagtgaatggcctgaaccacagcagtcttgtcaaatccctgacgacgtcctgggttcgtggatacatagataaatatgtatgtgtttctcccccttctcttctcccaggatttggttaatggttatcgctgtatctgtccacctggctatgcaggcgatcactgtgagagagacatcgatgagtgtgctagcaacccctgcttgaatgggggtcactgtcagaatgaaatcaacagattccagtgtctctgtcccactggtttctctggaaacctctgtcaggtgagcggaggcaaaaacttcaggtcaccaagctttagtgttgaaccctattctccatcaccattctttcccctccttgccccactctagttgtttagacccctgacaccaactagcaccccactgactggaggatgtctgctagacaaatgctgtagaaggcagagttgaatgatttcttattgattactgtggcctgtttgcttggctgagtgtcatcccatagccctgttttctatgctgtcaccgtgccctgggctttaatgctttcctgggacctgacgaccttaagggttacatgggtgtattctgtatagggggtctccttgtggaaggggttggagcaatcaattgtttactgcccagagaagtgatgatgacgcctttgttttcctttgatctgctccttcccactcttgccatatggcagctggacatcgattactgcgagcccaacccttgccagaatggcgcccagtgctacaatcgtgccagtgactatttctgcaagtgccccgaggactatgagggcaagaactgctcacacctgaaagaccactgccgtaccaccacctgcgaaggtatctccctcacccagggcccatctatccacagatgggctcctgccacctccccctagagctctgataagtggtaaatgggtgaggaaggttttcagatgaaacttaatctgatcacttagggaaacaaaaccatacggaggtaatctgtcaggctgctgttgggagagcccgagtaccgttgcccaagggagagaatgtgaaatccatttatcatcccagttcagaggtggccaagtttgtgacagaagagaagaattgctctgaggagcgctgtcagcaggggtctatagcagtggggaagttaggcgtttgtatcagttattgtagccatggctggctattggtgcttgagacacttttttggagtagttcatataaaaatacgtacacgtggcctatggctactatattgggaggcataacttaaagacttgtctagataggtttgtcctttagttttggttaagatgaaggagggctggacagtggtggcgcacgcctttagtcccagcactcaggaggcagaggcaggcagttctctgaattggaagcaagcctggtctacaaaatgagttccaggacagccagggctacacagagaaaccctgtcaagggggaagctggggtggggtagcagggaagtatagaggtgaccttctttgacaagcatttaacatgagatagatattaaggtgccattaaaagaaacttaaaaagactttctgtccacttgggagtcttacattttacctgtcataagaacattgttgggttttagttcccaagcacctcttgatgagttaactcattagcccaaggagtggccctatccaatcaggcaggcatacatgggctaagtcctctacttagaaatgctgtcggtgggtatgtggctggagtctgatcccaagcctgtgttcagtgattgacagctgcactgtggccatggcctccaacgacacgcctgaaggggtgcggtatatctcttctaacgtctgtggtccccatgggaagtgcaagagccagtcgggaggcaaattcacctgtgactgtaacaaaggcttcaccggcacctactgccatgaaagtaagattccacttggaacgggggagcccagtgggtacccagcttgggggagcagatgtatttgaattgctttaggaagaaaataaggtagaggacaagtagtggcttccttaggcccctgatggaggcattagtcagttgataagaccaccaatagtctcttgagctcttcaagatgattttggaatgttgtagaaccttcctttatttgagtggtccctcttttctatagaagctttccccccaggcctaccaaataagccaatgtgtgagggtcttaaaatggggaggtaccatctagaagccccggcacagaaagggtagtgatgtatccaggtacgtttgctaaggaggcagctgtgacaatgaccaggcggtgccccggtggctgcatgactggcccttcggctcctcagtttgcccatgcttcctttcccagatatcaacgactgcgagagcaacccctgtaaaaacggtggcacctgcatcgatggcgttaactcctacaagtgtatctgtagtgacggctgggagggagcgcactgtgagaacagtgagtctgctgctgcttttggggacagatggctccagggtgagggctcggggtagagcagggataacaccttcccttgggggaagccctttttttttttttttccagagatttctattatggtggctgtaatgatctcctgtatctccttggtatttattaaggctgctgggcagtagtgggaggagccaccactgggggatgatagaattagattggcagttaggttctttccaggcacgtattctgacttgttgacatttctgaccatcttgattttaattgccatgggcattccggaggattgtgtgctctttataacttgtattctttccgcctagccgagaacttgtctaaaaggttgatgatgaagttgaggtcctaggacatctcacttgttcttggaagatagcatagaaagccagggttggatcttctcatagtcgagctttgccccttatcatgacggacttcttcagccttgtgtctctttggttctagacataaatgactgtagccagaacccttgtcactacgggggtacatgtcgagacctggtcaatgacttttactgtgactgcaaaaatggctggaaaggaaagacttgccattcccgtaagtgttgctgccggggtctcctgtctgtcttctgagggaggggaactctctagcagagagactcatgctaaggtctttcttcaggtgacagccagtgtgacgaagccacgtgtaataatggtggtacctgctatgatgaagtggacacgtttaagtgcatgtgtcccggtggctgggaaggaacaacctgtaatataggtaaccttctgccccctaggtgggatttgctgcgggcaaggctattgtctgaggtggtctgccgccaggctcttaggaaatgatcatttccttgggtctggttctgccccttagaccaccttggatcctctggaaaagggtggtcttaacctgtttttgttttatagctagaaacagtagctgcctgccgaacccctgtcataatggaggtacctgcgtggtcaatggagactccttcacctgtgtctgcaaagaaggctgggaggggcctatttgtactcaaagtgagtggcctcccctgaactctttctgggttgctgcagcctacccaaaatacccatggggacttggaatcgaaaccagaagcacagctgtttgatgtctgctttcgtatcacctgggtccttactaatgacttgatgggctgcagccctgacctgggcatgagaaagttccctgggagataagtggagacagatgctgactctgttcccagccgcgggtctgaccagcagcctgcctcctcccattctcagccctccctactccctgttccctacaagggcctcttcctgtatacatgtgtcccacagcaaatgaaactgagtatggtccaggcctgcttccaatttagactaggttttcggcgtatttgactggtattaagtgtgacttttatcatttgggtgctatggaaataagtaaatggtgctgtgatggagacccccaaggctgttgtcttttctttgcagataccaacgactgcagtccccatccttggtaagtgcggcaacctcttaagctggttcttggctgttaggatgcatgggaatctcccgggatgatgctgaaaatgtaggttctgattcaggaggtctgcggtggggctgtgtgtttctaacaagctcccaggtgaccctgccctgctgctccgcggaccacactttaattatccaggttgtgtcttcatttagtgcaatgattctcaacctcaggctgcacaggggaatcacctggggagcttttaaaagtcccaatccctgggttgcgactgagacctaggaaatgagattctcagggggtaggacccaggcatcagtatttttaagctcctcggtcagcagcagatatggcctggggtgaaagcctgtgtttgtggcaggcacggcttccaagtgctgggtatgttgtggacctggatgtcggtaactaaggtcacctttggtttcttagttacaatagcgggacctgtgtggacggagacaactggtatcggtgcgaatgtgccccgggttttgctgggccagactgcaggataagtaagtgtcactgtatctgatgtccccttgtctgtcctcctcagcattcaaatctttcctctttaaaaacaatgaagaccataattccaaataaccctgacaactcaagccctctcctccctctagcttggatttaaaagtccctcgctgttgtcctccctcgtcattctctgggtggcacagccttctttgttctcggggagagtgccaaccatagaatttgacaattaagctatgagagagccctgagggaaaaaagtgtatgcatccctcgtgattagcatgaaattatggccaagccattgtccatgaagacggctgtctctggctccatagactgttttgtagtgggtttgaccaggccccagagaaacaattagtaggatcaaggagtaaggttttttcttagtgtttgttttgtttgtttttctttttgcctactttttaaaacatctttttcccacacaaaacagtgtaggaaaactcttatttttgttgttgttgtttttttttttcctcaaaactttaaaatgttagttgtatttgaagtcccataatctgagatgggctggacttgagcactaggtgagtaagttatatctgtttcaccttctaaagcgggtttggcaaaggcatctgtcccacctgtttttgtaaatgaagtttattggcacttggctgtccttacttgggcttgtctatttcctgcatctgcttacagggtgccaccagacaccactggttatgaccgactttatggcctatgaagttaaaatgctcgctctgacccattttcagggaacgatggtcagccttggtgtaaagtcagaggagagagaagctaagggaaaattgctccctttgcagaggttctcagatttaggaatcagaactgttgtggtctttggtagtcaggggctggtacaggctttgtgtgttgtgtgcatggaaattcaccaagtttgtatcagcatttggatgcttttgggcaatgtctgtgaaaaaacttcccaccgaagtctgaacttgacctcatttctcctagacatcaatgagtgccagtcttccccttgtgcctttggggccacctgtgtggatgagatcaatggctaccagtgtatctgccctccaggacatagtggtgccaagtgccatgaaggtaggcatgccagggtgtgtcttctgaattgagtgggcttcacagttaccacagctcacagtggggggggggggtgcaccatgctcaacggggaagggaacaaagcagggtggtacctatgggtttctgttgccacttagttgccatgtaacaaagttccttaaaacccaatagcttgcagtatccatttttgtggcttgtagcatgatagctgggcagagcactgattccaggcgcagttctggtcaactggtccttagctatctctgaggcatgttcttcttctcatgatagatggcaggcacacgggaggccagctcaactgggaaagctctgttacagggcctctcgggtcacatctgctgagactgctttagtcaagtgacccaagtgagcagtcagaggggatggatggccagtgcacgtgcctgacattgtgggaggagctgtcatcacgtggcagaggaaggacacgggtgtaaccaatttcttaacagggagggggtaaacaaattcagtctgtgggaaaagaaactcctacttaagcgtctccacctctcagtttcagggcgatcttgcatcaccatggggagagtgatacttgatggggccaagtgggatgatgactgtaacacctgccagtgcctgaatggacgggtggcctgctccaaggtagggcaatgaaagttgctgaagctcccaagtgttaatcatgggtggacattcctgctaagccaccagttcctcttctctcctctctaggtctggtgtggcccgagaccttgcaggctccacaaaagccacaatgagtgccccagtgggcagagctgcatcccggtcctggatgaccagtgtttcgtgcgcccctgcactggtgttggcgagtgtcggtcctccagcctccagccagtgaagaccaagtgcacatctgactcctattaccaggataactgtgcaaacatcactttcacctttaacaaagagatgatgtctccagtgcgtaacttctttaatggggatgagaacgtggctgcttgtttcaaagtagtacaacagtttcagagtagcatgagggagtcctctcctccccttagccgaaatctgtctcttagaacagactgaggcttctatctagcccgttgaggagacttgtgagccttttatttcatccattatttgacatttgtgttaacctttctaaaaatttatagggtcttaccaccgaacacatttgcagcgaattgaggaatttgaatatcctgaagaatgtttctgctgaatattcgatctacatagcctgtgagccttccctgtcagcaaacaatgaaatacacgtggccatcgtgagtagaagaccatttcactcctaattatttgattacaagggatttaagttagcaagtatcagacaacaattgcaatgaaaacattagctagtcttgttaagtttgagtgataactaccatgggtttgcttttattttagtctgcagaagacatccgggatgatgggaaccctgtcaaggaaattaccgataaaataatagatctcgttagtaaacgggatggaaacagctcacttattgctgcggttgcagaagtcagagttcagaggcgtcctctgaaaaacagaacaggtgggtgtctatttggaagatacccttgcctggtgactgtgaaaatgattctcctgcaccatccaggaaagtcctcacctagggaatgatcttccagccatcttagaagcccctcacttccagcctcctggcccaggctcacaaaatcaatattggtattggctgaggaaggcagagaggtacacctgacccattatcccactagcgtgctgtatgcattttcttcttggaaagctcccatgcataagaggtatgatttagatccagtgcaaagccctggggcacagcagtgcctgctctgagctgttgatgctctacagagccagttttagggttctagcacagctgaccctgaacactaaacagcatcactgacgcttgatggtgactcagggtattcaaactgaccctttgatgattcagagcctcgctgtttaggctgagctgaaatcaggacttctattttgggggaattggagttgtctgtgcttgcactgggtttctgatgattctgaactcagtcctaatcctgagccaccgaagtcctctggaactggaaataacccaatgtggagttggaagaaagacataggagtgctattctatccacctggtgcactgaacacaggtgtcctaaagaccagcttctggcaatagtgaacctatctgtgaagtttcaaagaggttcttgtccccacagtgcccctcttagggaccgaatacaggaagaccactgttggcattctgttcctatggcaatagctcttcttgagttaactggtccttggcttgtcttccagatttcctggttcctctgctgagctctgtcttaacagtggcttgggtctgttgcttggtgacagccttctactggtgtgtaaggaagcggcggaagcccagcagccacactcactccgcccccgaggacaacaccaccaacaatgtgcgggagcagctgaaccaaatcaaaaaccccatcgagaaacacggagccaacacggtccccattaaggattacgagaacaaaaactcgaaaatgtcaaaaatcaggacacacaactcggaagtggaggaggatgacatggataaacaccagcagaaagtccgctttgccaaacagccagtgtatacgctggtagacagagaggagaaggcccccagcggcacgccgacaaaacacccgaactggacaaataaacaggacaacagagacttggaaagtgcccagagcttgaaccggatggaatacatcgtatagcagacagtgggctgccgccataggtagagtttgagggcaccgcgggg

SEQ ID NO: 120 - DNA, 3970 bp, Mus musculus
ccgagaggtggaagaggggggagcgcctcaaagaagcgatcagaataataaaaggaggccgggctctttgccttctggaacgcgcggctcttgaaagggcttttgaaaagtagtgttgttttccagtcgtgcatgctccaatccacggagtatattagagccgggacgcggcggccgcgggggcagcgacgacggcagcctcggcgggagcaccagcgctagcagcggcggcggcgtccggagtgcccgtggcgcgcggcgcagcgatgcggtccccacggacgcgcggccggcccgggcgccccctgagtcttctgctcgccctgctctgtgccctgcgagccaaggtgtgcggggcctcgggtcagtttgagctggagatcctgtccatgcagaacgtgaatggagagctacagaatgggaactgttgtggtggagtccggaaccctggcgaccgcaagtgcacccgcgacgagtgtgatacgtacttcaaagtgtgcctcaaggagtatcagtcccgcgtcactgccgggggaccctgcagcttcggctcagggtctacgcctgtcatcgggggtaacaccttcaatctcaaggccagccgtggcaacgaccgtaatcgcatcgtactgcctttcagtttcgcctggccgaggtcctacactttgctggtggaggcctgggattccagtaatgacactattcaacctgatagcataattgaaaaggcttctcactcaggcatgataaaccctagccggcaatggcagacactgaaacaaaacacagggattgcccacttcgagtatcagatccgagtgacctgtgatgaccactactatggctttggctgcaataagttctgtcgtcccagagatgacttctttggacattatgcctgtgaccagaacggcaacaaaacttgcatggaaggctggatgggtcctgattgcaacaaagctatctgccgacagggctgcagtcccaagcatgggtcttgtaaacttccaggtgactgcaggtgccagtacggttggcagggcctgtactgcgacaagtgcatcccgcacccaggatgtgtccacggcacctgcaatgaaccctggcagtgcctctgtgagaccaactggggtggacagctctgtgacaaagatctgaattactgtgggactcatcagccctgtctcaaccggggaacatgtagcaacactgggcctgacaaataccagtgctcctgcccagagggctactcgggccccaactgtgaaattgctgagcatgcttgtctctctgacccctgccataaccgaggcagctgcaaggagacctcctcaggctttgagtgtgagtgttctccaggctggactggccccacgtgttccacaaacatcgatgactgttctccaaataactgttcccatgggggcacctgccaggatctggtgaatggattcaagtgtgtgtgcccgccccagtggactggcaagacttgtcagttagatgcaaatgagtgcgaggccaaaccttgtgtaaatgccagatcctgtaagaatctgattgccagctactactgtgattgccttcctggctggatgggtcagaactgtgacataaatatcaatgactgccttggccagtgtcagaatgacgcctcctgtcgggatttggttaatggttatcgctgtatctgtccacctggctatgcaggcgatcactgtgagagagacatcgatgagtgtgctagcaacccctgcttgaatgggggtcactgtcagaatgaaatcaacagattccagtgtctctgtcccactggtttctctggaaacctctgtcagctggacatcgattactgcgagcccaacccttgccagaatggcgcccagtgctacaatcgtgccagtgactatttctgcaagtgccccgaggactatgagggcaagaactgctcacacctgaaagaccactgccgtaccaccacctgcgaagtgattgacagctgcactgtggccatggcctccaacgacacgcctgaaggggtgcggtatatctcttctaacgtctgtggtccccatgggaagtgcaagagccagtcgggaggcaaattcacctgtgactgtaacaaaggcttcaccggcacctactgccatgaaaatatcaacgactgcgagagcaacccctgtaaaaacggtggcacctgcatcgatggcgttaactcctacaagtgtatctgtagtgacggctgggagggagcgcactgtgagaacaacataaatgactgtagccagaacccttgtcactacgggggtacatgtcgagacctggtcaatgacttttactgtgactgcaaaaatggctggaaaggaaagacttgccattcccgtgacagccagtgtgacgaagccacgtgtaataatggtggtacctgctatgatgaagtggacacgtttaagtgcatgtgtcccggtggctgggaaggaacaacctgtaatatagctagaaacagtagctgcctgccgaacccctgtcataatggaggtacctgcgtggtcaatggagactccttcacctgtgtctgcaaagaaggctgggaggggcctatttgtactcaaaataccaacgactgcagtccccatccttgttacaatagcgggacctgtgtggacggagacaactggtatcggtgcgaatgtgccccgggttttgctgggccagactgcaggataaacatcaatgagtgccagtcttccccttgtgcctttggggccacctgtgtggatgagatcaatggctaccagtgtatctgccctccaggacatagtggtgccaagtgccatgaagtttcagggcgatcttgcatcaccatggggagagtgatacttgatggggccaagtgggatgatgactgtaacacctgccagtgcctgaatggacgggtggcctgctccaaggtctggtgtggcccgagaccttgcaggctccacaaaagccacaatgagtgccccagtgggcagagctgcatcccggtcctggatgaccagtgtttcgtgcgcccctgcactggtgttggcgagtgtcggtcctccagcctccagccagtgaagaccaagtgcacatctgactcctattaccaggataactgtgcaaacatcactttcacctttaacaaagagatgatgtctccaggtcttaccaccgaacacatttgcagcgaattgaggaatttgaatatcctgaagaatgtttctgctgaatattcgatctacatagcctgtgagccttccctgtcagcaaacaatgaaatacacgtggccatctctgcagaagacatccgggatgatgggaaccctgtcaaggaaattaccgataaaataatagatctcgttagtaaacgggatggaaacagctcacttattgctgcggttgcagaagtcagagttcagaggcgtcctctgaaaaacagaacagatttcctggttcctctgctgagctctgtcttaacagtggcttgggtctgttgcttggtgacagccttctactggtgtgtaaggaagcggcggaagcccagcagccacactcactccgcccccgaggacaacaccaccaacaatgtgcgggagcagctgaaccaaatcaaaaaccccatcgagaaacacggagccaacacggtccccattaaggattacgagaacaaaaactcgaaaatgtcaaaaatcaggacacacaactcggaagtggaggaggatgacatggataaacaccagcagaaagtccgctttgccaaacagccagtgtatacgctggtagacagagaggagaaggcccccagcggcacgccgacaaaacacccgaactggacaaataaacaggacaacagagacttggaaagtgcccagagcttgaaccggatggaatacatcgtatagcagacagtgggctgccgccataggtagagtttgagggcaccgcgggg

SEQ ID NO: 121 - protein, 1218 aa, Mus musculus
MRSPRTRGRPGRPLSLLLALLCALRAKVCGASGQFELEILSMQNVNGELQNGNCCGGVRNPGDRKCTRDECDTYFKVCLKEYQSRVTAGGPCSFGSGSTPVIGGNTFNLKASRGNDRNRIVLPFSFAWPRSYTLLVEAWDSSNDTIQPDSIIEKASHSGMINPSRQWQTLKQNTGIAHFEYQIRVTCDDHYYGFGCNKFCRPRDDFFGHYACDQNGNKTCMEGWMGPDCNKAICRQGCSPKHGSCKLPGDCRCQYGWQGLYCDKCIPHPGCVHGTCNEPWQCLCETNWGGQLCDKDLNYCGTHQPCLNRGTCSNTGPDKYQCSCPEGYSGPNCEIAEHACLSDPCHNRGSCKETSSGFECECSPGWTGPTCSTNIDDCSPNNCSHGGTCQDLVNGFKCVCPPQWTGKTCQLDANECEAKPCVNARSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTTCEVIDSCTVAMASNDTPEGVRYISSNVCGPHGKCKSQSGGKFTCDCNKGFTGTYCHENINDCESNPCKNGGTCIDGVNSYKCICSDGWEGAHCENNINDCSQNPCHYGGTCRDLVNDFYCDCKNGWKGKTCHSRDSQCDEATCNNGGTCYDEVDTFKCMCPGGWEGTTCNIARNSSCLPNPCHNGGTCVVNGDSFTCVCKEGWEGPICTQNTNDCSPHPCYNSGTCVDGDNWYRCECAPGFAGPDCRININECQSSPCAFGATCVDEINGYQCICPPGHSGAKCHEVSGRSCITMGRVILDGAKWDDDCNTCQCLNGRVACSKVWCGPRPCRLHKSHNECPSGQSCIPVLDDQCFVRPCTGVGECRSSSLQPVKTKCTSDSYYQDNCANITFTFNKEMMSPGLTTEHICSELRNLNILKNVSAEYSIYIACEPSLSANNEIHVAISAEDIRDDGNPVKEITDKIIDLVSKRDGNSSLIAAVAEVRVQRRPLKNRTDFLVPLLSSVLTVAWVCCLVTAFYWCVRKRRKPSSHTHSAPEDNTTNNVREQLNQIKNPIEKHGANTVPIKDYENKNSKMSKIRTHNSEVEEDDMDKHQQKVRFAKQPVYTLVDREEKAPSGTPTKHPNWTNKQDNRDLESAQSLNRMEYIV

SEQ ID NO: 122 - DNA, 36302 bp, Homo sapiens
cagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtaggagcccttctccgggcctccctcccagccgtcctctccctcccctcgcggcgccctgggcggttgagccccgcgagcaggctcggcagccctcgagcgcccgactcctcgcccctgcgcccgagcggctgcacctgggctgagcgcgccaactcccccacgggagcccctgcctcctgagggtgacccctccaggccggacaggggcgcgttcgctccgctgttgccccccgggaagtcgtcggatttcttccgcactcgtgcatttttttttttttttgccccggaatcatgttgagtccttgaacgtagtttcgcaaaattattttcactcggcgaggagggctcgtcggggcggggagtgggagggagtcgccacctctatactcgaagaaaacagctttctcccgcgctgacctacctccttccctcgccggcaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccggtgagtgactactcgggaaggaggccgggcggagcctcacacccgcgcctggccgagccctgttatcccttgcgagagggatttaaagggctttggcttgaaactaggcgctaactggggaaatctctaggggtggcgggtgagggagccgggacactatagttagatctcggctggggtagtcgaggtgggtcccattcctgctgctatttgcttagtgcacaaaagtggggatcccagagggtttatgggaccaggctcctaggaaggccggtgtaaacttgcaacttgaagttcccagagtaactctcccggccccaagccaagagatcgttgtagctgatctctttgcttaactaattaaacctggtgcgccgtggaaggcgactcggcgcagttctggcctgcgaacgccgtccaaattggcaacctcccctttcccgtgaacggccgggagggcgggtgtgtccttcctggagggtgtgggggagtccgtttcccgctgctccccgggagattttagtgtgtgcgggggcgctctccaggttcggcttaagggccgggggcggccgccgcaggaggaggttcttggggccctcacaggagctgtagacctgggaacccccgcccgctgctggccccttcctgcccccgcccccgagtggtgtagctcttgtggcctcacttccagcggttcccgggctctggaacagctgtgtttgcagacttccccgggaagggcgggtgcacggcccccgcaagccttcgggggccgtgccaaggcttggaaggggtggtcttctggaggtagtgcctgagggtgtaagtgataggccctcatccccccgccccattccgcccccaaaggagctcgaggcccgggcccagctggcagatcctgcagcgaggcccttgcaacatcccaaaatgggtggaaggaagatgggtgcgattgcagaaggggaggaaagggaaatgttgggggtgtgccctctgcctggctcctgctgtccaggaggcatgactcattgccaagactggggcttggcctagcctgtgctgggagggtgggtggtgagagggggagctcggtgccccagagcattgctttccaccacgtgctctaatggggtgcactctgctgcctcctgtccgccggcttaggttgtgattctgggaggagacagaggggagactatctggctgtgtctgtgtatgaagcttggggtggctcttaaaatccacgattacaggagctggcattataaagtgccctctgctgtgggtgagataagacagttatcaaaaactgccatgaaaaggggtttataaaaagaaaaattaaaaccaacgctgtctgtgaagctctcttgaggtccaagggctgtttctgttgtgggatttcatttttaccaagagtatttatcttgtttgttaatcccctattagggagaactttaagctaaagagtctggctgcgtttaaatctggctggcccaagctgactgtgaatactcaaactgcccttgaacgtgtgtttggagtttagggggaaggggcctgcaggtggttccaccctcctgccggaggatctgtctggagcccctcgcttttcacaagaccataaaaggaatcttattagtgatgtggaaaagcagcagcctggctgaggctcattttggagagtagggtcagagggatggctaacatgaaaacaaggaggcttgctccctcgctggccaaggaaaagtgacctagaaaagtgcgtctgtccgcttttgacacttggtcagagtcctcaatggaaaacgagcggaaatagtgtgggagggtaggagaggcgattgatttgcatttgctggtgctcttctgtggtttcaggccccacgggtcaccaaccatgaaatagactctcggcttttctcgaatgggggaagaccgatggggcaccactgaaaatgtggttcttttgaagttgggacaaacgcatgtatcactcataaacaagtctccaccctgatgccccagaaaggcctgctgtgaaacataagatttaattctcaagagaaattggagtttaggtgtatttgtttttctgtatgtggttggagaaacggcacagtccgtaactttcaagaatgattccaggctgagtagaaacgtaactgaaacacttaagtagctgagcgagtatttaactagagggcacagcttcatttagtttggcaattaactatgtcttttaaaactgatttccttgaatgggaaataaatgaacttagtacagaattcaagagatagcaagaaaaggatatatggttaaaaacaaaacaaaactccaaaccaccttgggctcccaacccctagcaggcacaattaccatttgcatgagtcctcccaaatttgctgacgctgggtatcagcaaagggtgcaggggtaggtcagtgtagaaggtcatgtagttcatgctttttgtttggaattatgacccctatccaagcaactgttcatgttctagagaggacgaggaggaaacgatttggtcagatatgaaatacagtccatgttctggtgtgcatgtgaaaggctttgtagaggtggcccttcctgtcatatatcatatctgagtatgtcccacgtggtgtcccctgccccggctctggtcttggggtagtttttcaccactggcttctaattctcatactgttgctgctctaaggggcttaacttgcagcaactatctggattaatgattctcaaattgggggaccaagtgataagaaccattattgtgggaagtaattgggcttaacaggaaataatttaggaattaccacttataaatcactgaaacggttaatctgtacctcccaaaattagtgctaaatcccagtagtgcctgcttattaaaaatacattagtgtaattaccactactcatctccaaaagctttttgggaacttcagaaccccagttagctgtattgctgcatcggtggccccagagtgaaatgaatctagagaaacgttaggggaagaaattggggtatctggcttattagcctcatatttaaattccattgatcctattaaaagacttgctgagatcaacttttttttttttttttttggaaaatccaatgaaacgtgattcttctgtgtgagggatgccagctttggcccccttcatgcttcaggcctgaatgaccaattgccacgatgctaatcacagaatgtaattgacaggcccttacttttatgccttttgctgtcttttccagtccctgagcttctgtagatatggtgtgggcacatggagggcttaaggatggggttctgatttgacctgcctcctttctgcagccaggatttgcatcctgcccgtgtagtcagcatgtatacaaagaaagagcatgtgtgtacgtatgtgctcagagcaagggactttctgcatgtggagaaaacgccttttgccctaagaagtctacctcaaaccaaagggatgaagtgatgtatctgtgttgcaacactgggcttgggggaaagtgaagctgtgcttgctttgaaagagctgtgctaagtatctgcagaatagctgctccaaaaatggaatctttattccaggtacttggtttctaatttttttttctcttgcaggtgtaaccttctgtgttttctttctccttgttgtcttgtttcttagcaacttattcaaacctccagtacttataggaatttgcaacccaccagttccacacccgtaattctacagggacttaagatgtttttagaaaacggtgaaactttggcgtggaggctcttgggggagttcagtgggttaaaaggagagtcagcagcaacttacaggcatgcaacctcccagaaaatcagcaatctaagtgctgctcaaaatcttcacaccaaatagtggtgcctttggggaccttttagatagaagacgtggaaagtttagcatggagaaaaaagttacttaaaaaaaaaaaaacagtgtcaaggtaacaaggagccttcacagttcctgatctgaaaacaggaatgtgaaccagaggccttggctggattcatatcacccactggccccattgtagaagggccagaagttggtcccaatgtccggctttcaaggttagtgacaatgtaagaatgcatgatctctggatgtgcatacaattagcgttgtaatccataaatgcaaatactcctgcaaattcttccatggtaaacttctgtaaggcatgttgctcttccacctacccccatccttcaagcctaggatctaggctgctgagagaagtgactcttggcttcagcttttaaatatatatatatctctcaaaacttaatcttttcttccaactgttggaagatacattgggatgaatggaaagtggtgattctaaaatggtggtggaaatggaggagggtcctgggttcagaaaaatcccacctttactttggtgcatggcactgggtggctgtgttgtgacttctttgctgatttctgattaccgcatggaccacagcagccctgtgactgctgttttttttttttttttttttttttatggtgccagtgacatctaccattggtgcagtgcgtgtgctgggaagaaattccgcaaggtggctcccagtagttaaaggagtacataaatagtcaaacatgcagagtcctctaccagctcaacccagtttttatgcacttttggtaaataaacagaaaggcttcttgttcaggcttgctctgtgtgaaccagaccgttgtgcttggctggcttcttggtattctatctattaacctcgccacccttttgtaactggtgcatttaattatcagtgggatgcttttcaaacaggtaagggtaatgatgggaaagggggtggggatgtctcattgagagtcacaaatctggatatgagctttggggccccttggtgagcctttgagtgggctttgatgagaaaatcaccctttgtaaccagatcggactctattgacatgtcaagccctacagacttgattgctttctgtgcctgaagtcttagcctagatgctataggatagttgtcctttcttatctcactttcccaaaacccactcgcattgtgtgcatgagtacgtgtgcatgcgccacacatggactccctgcaaccttttctgcttaatatgttttgtgactggaatattttatactctggccacccagacacaggcaggacaatagagttggccgaattgactgaaatgaggattatggagaataatagggcctctccaaaaataatgctaacacaggacaagcgacaggaagcaacagttgagtcagcagagctcagggcccctgacgaaccccgggagccgactgactgtgcacaatggccgcgttggcacgtcgggcattcccaggatgtgcgtgccgccggcgggcctgcctgtcgcagcagcctggggttttggacgccgcacgcgtgccgtttggatggcggtttatttgtgtccgtcagcttggcaggaggggaggcagccgcttctcagggcttggtttggctgtcactgttgccaggaaaaggaagctcccggctgccaacacaattacctttgtttcttacatccccccttcttaatgtggcaattaagtgcttaccgctctgcccagtgccaaggtaaccgccatggagtgggacagggcagagaacacaaccttggcacagcagcctaagtgtggagggcgggaggaggtgcaggggccccagccttgctgggaacctggtggcccttggatgccttggggctttgatgccaggactctcctctaggtagaattccacagaaatcttccaaaaagcaattccgaaggctgaccattcctctttgatgccacaccagaatgggaaccagctgccaggtttccagatttccttgggcttggagctgggaaggggctgaagtgactcactttgcaaatccagactaaagatctgtttgctacccctccttcctgtgtggccttcacagtactgttctggaaaacataaggaaagatgaaagccaggtgactcttcggcagagtcttagttctgtagtctgaaatcaagaaaaacccaggtatttgcttttgttgttgttgttttgctgtataaacttaagtttgaacacttgcctttccaagccctcctgggatggaggactccgcctctactgggggtcagagttgcagtggctgcttgtatgtgacttcggcatagtggatttgctgctctgtggcctggtccctgctttgatgtggggtgcatgatctgggatctcagtgcctgggtgtatgttcagggatgtacagaggtcaagtgtgggcctgggaaaaattaaagttctctagcaactaataatcattgttaaattatcttgattgctgatctatagtgtggggatggagtgggaggttgagtgcctcctaataggaaccttggagggaatcctttttctctgtagggctgggcaggaggaatcctcctgccccaggagaccctaatcccctccctgaaacagacaggaaaaaaagtccaggctttgttgccgtcactgtagctccctgccctcaccctgtctctgcctctgagaaagaagggcagttcctggaaaatcacagagccaggcacgtagggctgtgtgcaattcttttctctccaggtggggtgatgtcggtcagcaacttctgaggttttcccagttctggcgaggatgagcctggtagactgcttggtcgtccaagttcttgtgcaagacctaaggatgctttcctctttgagtattaaactgagttagtactgccatgccagctcagtcccggcaccttcccttgcagtggggtttgtgggtattatgtgtttagcgcttgtgcaagtctgtcaaaactcctggtatcaatgcatttaatcagaggattaattacaacaatactgttgaagtggaggacgtgggcctcaacgtgaccagcaaatgaagggcttaattatacagaatcagccacacatctggcctcattttgactgtgctcttacctcaaatcagtagagaaatataatttcttgctgctcttagggaagagtcctgtaatttgcaggaagtcctaagaaacttaaagaggcagtaaataaggtataactttcgctaataaaatagtaacaacagcaatgaatttggacctgtggccactaacaggagagggctgggtatgtgccctggcttgcccggttttgcttgcttttctgagcattttcccacagttatcagtgaacgaaatggaatcctactctgctttgagtatgaaacatatttcggctgaattccaaggcagggtctatcacaagatatttttatattcagagatgacctgctgtgtcactctgagagcgctaagctggccttgagttatgaatgaaactcccttttaccctccctttttctctttttcctttatcttataggtgctttctcttctcttggcagcagtgtgcttctggtggcacagcacggtattatttaatctatacacgcttctatttcctatggcttggtttctgacacagcaaagcagggattcataacctagttcatgttccttgtctaccccacctgccttgagtacatttcttcagtgccaagatagcagaagcttcatttaaacgctggtgttttgtgagactgaccttactgtaaattacgaaggaaaattttagaaaaggagggaatttgctaatagcttaggtttggctgggggtggggaggtggaattctgagataagcttggaagataaaaggtgccttcagtttaacagctggcatcttgccagtatccagggaatttgtttagttagtagactctgattattcttggaatgttagatcttattaacagataagttcatcaataaatataacccatgggtgtgcggttgtttctccctttgtactttcttccctgggatctgcccccaactccaccgcccaagtgaggttgacttctttgtcttgcagagtcactttgcatctaccccctcctgtttcctagagttacccgatacttgtgggagccaggatggtctcacatagacagagttttcaaaggggttctaaaaaggaaaagggggcctccctagagactgcctcaccagggcccaaagtgtaaccttagcaataccccctcggtacaaatacctggttaggttagcttagaataaattctttgtgtgtgtgtgtgtgtgtgtgtgtgtgtgtgtgtgtgtgtttcctcatgcactagggtcagggtctggaaagttttgggaaactatatgctaaatactctcatatcatatagtgaggtggcatttcctgatctcaactttgagctgcctgcatgcatgttgactccagtgcgtccctgccaggtgaaaggagtcatttgtcaacctgggaagagtgctgacaaaggaaggggagttggtttggatttaaacatccaggaactcaatgcaacaaccaacagaatttttattttggcattatggttttgtttggtggggtattctgggaggccaagaatgtacgagattttggaaagtcgaccctgtttctgaattgctaaattgtttgtttgtcttgcagaggtcctatacgttgcttgtggaggcgtgggattccagtaatgacaccgttcgtaagtatcgcttctgtggacttttctctaaacacacgtggaagtgtggggcttggccaaccagttggagctggatctgtctccttagtacttagcatttctgccacctcttgccttctgttctcccctgtaccccagggtgaaccttcagtggaatgtattccttaacttttctaggatttttgcttggaatattaagtggccagaacagaatcccagttaactcattccctgattatgaaacctagattatcttcgggatagagatcttaatggttttacaactttaaaaccttgtagtctgctaaaggatcaaagtagtgactttttaaaagtccatttaaactttaagtgagtgtttaatctctcatcagaaagataaagccataaaggtggtgctgggctctagagaccgaccttgaatttcacttggtgggcaggtgagcttctagtctctccgggtttcccacactgctccacaaacctttcattgaagcgcaattccagagcttcacagccattacctgccttgtccctttctgaaagatggctctgttttcagtgcaggttgcctttcaggactgaggggttggttttggtggataagccatggaggatgtgattgaaatgacatagtctggcttacaaagtagtcttgctctttaattgtaactttacagtgttttcgctcacgagccgaaacttcaagttccctttttgccagcagagtttgggttgcggtcgctggaaaacttgatgcgcactgaaatctcttggtctgtgcatgaggaagagtggatccagcttcttgtcttggctctctgttctctgaatgccttgtactttttgcttttctatcttaccattttttttttgtttgctttcactgtgaataatatattttcatctttccttgccttgctttttttgctgacagaaaatggtgaatgcacaccgtgggtgcagtgagggcttggtgcctgctacgtgggcagcttccacctgtggctggcttattgggctacttggagccacagaatcattgctgagctccgatgtgccagagagtcccaggccatttgggtcactcttctagcttgggaatcttaagtccagctttttggatgtcatcctccctggagggggagctcatgaaagtccaaggttcgagtcttcctccccagagggctaccctgtaatgccgtgggggggtgtgtgtgggggtggcagggaagctctgtcagccttggctatggctgatgccagtcagggtcatagacacctgtttgttctcccctccctgccacaaacgttgaggactgtgaacattatgtcactgtgacctgcttacaatggtaactaagcgttaggcagaaggggttgaggaggggggagacataggctcttctgtaatagtatggtgtcgacatggtgttctttcccctcccttttagctattgaaacaatccacccggtagagtgaacagcttgaggttgatcctggcctgtgataagagccaggtcagtatacttgttagggacatgtgagagacctccccgccacactgcagcattcacagcacctttcctggacctcctgtcacctcgcaggtcagggagttatgtcccctgggaacccagggcttgtccagagctacccacagttgtctgcatttccaggtagcccgattttggggttctaggatgtttcatctcctgggggggtaatcaaatccctggaagaggacaagaaagactgaggtaggaataaagttcttttaaacctcaagggtgcccattgcaggttatcaaaactcacttggtgaaccctgaagagggagatgggtttggtggaaatggtttctccacttgcctatttggcctcttttatgatgcttccaaggaatcttgaattcagcacagtcaaaaccaaactcaggatcttctcttgccaaaagcagtcccttcccagggccccttctgggtgtctggcaccgatatttgaacactcattgccataagccagaaatatagaaggcgatctgtgtaccccctctctgttagcatccatacctagtccacctccaagttctgaaaaatctctccagctcttcacttgaatctgcctgccttctgccactgccctggtccaagtcaccatctgctcatgactgaacttagagtagccttcgtctggtccacctttatctgctctgactcacctctagtgctttctccattcttctgccatcctggtcttttcagagccataacatttgcttgtcacccttattatgaaaaaccaaccacttggtggccttctgttgctcttgggacagatcttcatgtggcccacaaggctctgtgcagcccagctttgtctccctgccagccttgtcttacacaccgtgttgtccatcgtatctgtagcctggccataccctagcagttgccttcctatcctcaactacatcacatgctttctggcctcaggacctttgcacatgctgtttatgctacttggagtgttttgttcctttcttcaccctcagccactccctctggactgcactccacagggcagaagctgaggatgttcagaagcccaaacggagttggctgccctgtgggacccaagcgagttgtaaacattctggcttcagatgtaaatcaaaggcagagccctgagttttagggcagagaattccttctatcagctctgcagtgagccctcacaggcagactcgggcccaaatatagcctaggtgctgtttatgtatttgaaagtatttaaggctggtccttctgtcatcggtcctccaaagtcttttattacattttgggactgtggtatatagagttccaaatttctttctcccctagagcaaatggtttcagtttactgtaatgcataataaacatgtaaacataaataggcacacttcagaccaggttttccctgtagcttagctttctcggctaaggcccccttccaggtttttgggtcggtgtggtcccaggttatgctcagactcgcccttcatcacctcctccttggcctgcgaggcggtcatggcttcttcgtgactcatcttcgtggcactggggattgcagggaggcatggtgatgtccttttccagtcacaaggctggactgccaaacgaactgccacagattcctttccagtgccccaagctgaaggaaagcgtgatcaggaagcaggcagcagacgtatttgaacccagacatgctcgaccccctccctgagcaggtgtgaaattatgtatgcagctccatagctccactgaggattctgaagtgatcctctgcacgacacttcccggaaataagtggaaagcttactgcatgactgaaaagtacatatcagtcctgcacccctaggattgccctggactcttgtctaaactgtttgttgttgataccagcctcagaagctggatgcctttaagccatggctagtgtgtttaaccgatcccttttatgaagatcttgtaagcgcgtggtaatagcccactatgctttttaactgaaccagcagagcaaacatagttaatggagagacatttttgtcattccttggcctctgtttatttgcaaaaacgagtaaagtgttacctgcctgcaagtggttcagtgcgtgccggggtgtcaggctgcaggtatgtgagcttgttcaaggcttgtcttgcccacgcagcagtttgagagccctagagggcgaacgctggggccctgttggaagcggtgtgtggatgaagccacccaggagtcccttctctcctggtcacttatagggcttgcatcactttttaaaggagcactggcccgaggcctagaaaaacagccatgtgggtgggtaagaatcacaaagacattgcaagtcagtcctaactgtctctccaagatggtcttgaatttgacaaggtgatgaagagttggtgctggcaggtttaagaaaacaaacacaaaaccaggttggggtgctgatttagtgccttgctgccttttcagatccctcccctgaactgctggcacctgatgtttgagctatttttgtacctgtctcttctcaaactagatgataagtggcctcagggcagggactacatactcctgagagctgcttgagctcgaggtgtttattatcctcagtaagcattttttttcaggagcatgacttggctcaaaaaaacaaaaagaaaaaagaaaccctcccctcaatttacctgtgtctaaactttggtgaattattctcccatctgccttctgggcagaggagaaaggtggaatgcatcaagttcaaggtcttggtatttaagagctggctttaaaggttgccatgttaacaattgtaaaaaaaaaaaaaaaaaaaaaaaaaaaagtaactcaatcgtctccttggcttccagttaagagttttgaaatggacaaaaagcttttctgagcaagacataaaaccctaaaaccagaaatgattgctgacctttatctggaataatgaaatttcttcaagagcaacattccatagggagctactgtctctcatatgtaaagagcacttgcaagtcagtatggcaatgtaatagaaaagttggcagagaagagaagctgttgctgttcacaggaacaaatataaatggttttgtaactaccagaaagggctcttgccatcacttagttaaatgctaattaaatgagatacctctttacctatcaggcatagattagaaggtttgataatgtacaacgttggcagtgttattgggaaacacagcttcctgggtggtgggaggacagactggtagtttgagactgtggacagaggttgatttgttgtgcacggactctgattcagcacttccatttctagagtatctcattgtgggaaccatacacaggcagatacgttcaaggaatgctcactgtggctttgtttaatagtaagaagcccaaacgactcacatgcacacatgtcagggactaggtaaattatttattggtgtttccagacaatgaaatactgtgtacccattaaagaaggtaaacaagtggtaacaggttgtctctgggtaggggcataaacttttcatttctttgccttttttacaacagatagaattttgtagcaggtgcatatgtttttattttaaaaagccaaaatggtcagggaagaaggctgcaatgtgaatattaacatgattcatcactttgtctctagaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagaggtatgtgtgtgtgtgtgcatgtgcacgtgtgcctgttgcttttagtgtccatttatcaccccaccagcaggcaggtggcatgcggctatctcaggtggggtgggattttggctgttattctgggcctgcagtatgaagatgcggagtgtagaagatgctgttggtgccccatccagatcccctttactggcatccccatcccccaggtgctgtgttggctgccaacagctcacagctgctccttctcaggagactcgtccttggccaaaccagtgcatgccccattcctccagctcacagtcagtgattgacagacatagggctacaaagcccagcttcctttgccttaaaacagtagtacaatttgcactctagagcttaccctgggattaggctgaaatcagactccagttgagaccatgttcttgctcagctctttcccctaccccatctgcttccctcaattccttctacctatgtccagatccccttctcagactctgcttctaaggaacttgacccaaaatagatccagacaggactaggtcagcccagttgttgtctgaacaggctatcctataggaaatgatagcccctgcattcagggtagccttgcagcaagttttcactaggtgtctttgggggcatggctttgatggggagaggtatgtggttagctcaagctttcctattggtgtaggagtgggcccacttttagtctctgtgctgtctactgtcccagtccctttatagaattcagtgattccaattcatagcaacttgatgggtaattctgttaactgtataatatcccctcatgagcaataatgtactctgcttattttacatgataattaggtaaattgttttgatagactcaatttcaaagtgagtttttcaaccatgagagaggggtgggtcatgggggaaggaatttacagctctcccgggtagtactactgctttcttaaataattggagagaagagtttaaaaaggatggcatttctggaattcaaatgaaaaggggaattcattaacatattttagtgtgttttaaaaattaaacgacctaacacttagtgtgggttttttgtttggtgttttttttttttttttttaagataaggtgctcactttgtcacccatgatggcacaatcatggctcactggagccttgaactcctgggttcaagtgatcctcctgcctcagcctcccaagtagctgggactataggcacatgccaccacacccagcttttttattttgtgtagacatagtcttgctatgttgttgaggctggtctcgaactcctggcctcaagctatccttctgcctcaatctcccaaagtgttgggattataggcatgggccactgttgcctggtcttagaaactgacattttttagaagttacttttttcttttttttaaacgaagtagagaattgctctgcaaggatactttataaaagtctcaccagatctggccaccagattagcctgcccaatgagtccagcctggctggctctgttagtcccatggaattttcaaaccaggcatttggtatgggttgtttttttttttttttttttttttaaaggctgaggctcatctgaatgtgtcctggtgggatggggaaggattatctatacctttttttcttctaatgaaaagggtgtgggcagaatggaaactgaccaagctctgctcaaggagccagggtagctgtggtttagagaggctggacgaaggtcccccttccctcgtcaacttgtctgcattttgtccccaaacaatatcatgttttcagaatctgctaacaaggccttgaagtttaaagctggttttgttatttgggcccctcccatcttcctctccttacaagggacttgatatgagacctgttaaaatcgtggaatttgcagactttaatgcaatgggccattctcatgaccggggcgatgcaaggaacaggcagtgtgctgacacgcccttctctgttttttacagctatttgccgacaaggctgcagtcctaagcatgggtcttgcaaactcccaggtgactgcaggtaaatcaactggtcttttgtgagatttcttttaattttcctttatgtaagagaggaactgactttattgtgactatgcctcttttttccttggagaacaagaaagcttttttaaaaaaaaaattcagatagacacatccgaagcttattaaattataccagctgtctggtggaatgcacacaccacttctctcttggaataaaaagaaactctttgggcatagccagtgacttcatgtattaactgttctgtaaattgataacacatttttataatcttcccttatagtgctgatgggctagatggagggatgtgggcttgtttctttgcgtctctctcctcttccaccaaggctttcttctcccagccccctccccgacttttcccatcaataggcgaaagtccagcattctttagaatgggattagtccaatctcctggcccctttgcaggcgggagctgggttggtgctgagaggttaatggctgccctggaatcttgtcagttgagcctgatgaatgtagacttttgctgcagtcctttgaagtctgttcctttatggtccaggaacaatgcggaagccaaagggaggcctgccctgaccacttcacgatggcgggttttggaacttcttgaaatttatattacgcccgtttggaaaaggcttattttgggaaatattgttggtgtctgtggtgtttttggcagtcttaatgctttgctctccctcctcccaaattttaaggagtaacgctaaatggatcctttgagcctgtcacttttgcccccaaagctactctgacatgagtaaagggaatcttatgaaacatagtctaaaccagtatgtcccaaactaatgttatttggggctcttattaaaacgcaggtcctgattctataggtctgggctgagcccaggtttctgcatttctaacaagctcccaagcgatgctgctgatggaaccatcagcaatcactgcccccagacctcagtactcaaagtgtaacttccagaattaacaagggagctgttaaaatgcaggttcgtgggctccgtcccacatccatagaatcctagtccttggtttggcccaggagtctgcatttgacaagctggccacatgactttgctgcttagtaaattttgaggctactcctttaaagagaactatctgtggcctttacctttatgattccaccgctccgtctgttcccctcccatgcaagggggaacatggaactaaattaagaactggttgtcccgaattgtctcttcctacacttcagaaagatagtttatttcctggaaggctgaggggcttctcctgctgtctcccattggtggcgatggactgtagtatttaacagcattgctgtccaatgcggagcaggaatccacctaccttaactcttcctaattaagggtgttctggagaaagtcccaatggcagtgctattagtgattccaagcctgctgcctgctcagatggatatcagcggaggccgactgtgatttgtgctgctgtcatcagaacacacatacagctatacaggggagggccctcccagccagaacaacaggctttgtttccagaatttagccctttctctttcgaagtcccacctccctctccctgcccagacacgcactgatggccttatttacttaaggtgcgactttcccacacatcatttgcatagtctcccagcccagttttccctccctaccttgaaagaaagtcaaaacagaaccttcacgctgaggaagttcaggttgtgtcctgctgcagaaatagttgaatggcaagttacctgcaagttgtcttttggattatgtattacacaggttattttttttttcacccccacatgagaaaatttactggtttttgttgttcccaagtagactgagtccctttccctgggtatacatgcttgcttattgcaagcctgccaataatatcaaacttaattatgaatcatcatctgaggaaagtcacttcaatttctcatgagaatcttaatcatatattattaaactgggataacttggttggtgcctcttttagggtcagtatttttatttgttttcttttgaagtcatccatggcctcttgtggttgcttttttatgcttggggattgaggtctctttaattaggtgaggttgggtcctcagctgcctctccttgcctttatgaggcaacttgaagagggctagtgatcctgaatttggaagagaataagggaagacggtgagaatattgccatttcgtaatcagttccctcttactatctttcaggctaagaatatcagccttgacagaatggctacacccttacctcccactaacgtgggtgtccgcttttgagaaattatttagattgtaattttgttcttatcttactcctttagtcacttgtcacgttgacattccattttacataaaccagaatccagtgtctaactttaaaccacacattctagtgatttctttgcatgtgggtgtgcatagcttggtttcagaagttaggaagtggttagtcagtattctcaggggttaagttgactctcagccgtgggtgattagctattagctagatccctataattttcccatgacaaggatttgctagcctgcctcccgctcttgggaaaccgaaagcctttccttctggggagctagagggggcgggggttgttttccagagttacagctgagcagcttagggggttggcgctgatcgtggcttttcccaggtcccgttctggaaacatgttgcccatcccacccgcaccccaccctccaccctccaccctccacgctccaccgggaggctagttgatgtttctccctgccttcccccacccttgttaaagcttggctcttgagaaggcaattaaagtttcagagggcttgaaaattcaagggagagtggtttgagacgctgccccctctcccaccccagatgaaagttgttgtatttgtttttgtttttgcttggggatcagaggcactatttggccccaaaagagtatgattaatcaaggtgcttatataaaagaacctcaactccgccaatactagataaattaagcagactgctttcttttttttttcttttcttggcaaagcaagaaatcactataaattagcacacagtaatgggacacaaattatggagttggttccaagtgttgtcatttccttctccttccctatagaagtgggtttagagagcctactctggctttggccaagggagggtgcccctttctctccttgtttttttaaataaagcgtcatcgtgaggcagtttcctgctgcacttggtggcttgttgcatttctgtgcactggggtcatgactttctgtgcagacaaagagcagagtggcaagtgcagcgtctgcagagactttggcatagctctcttgtcaccgagagagtcctttcctctatagtctgtcgcaactaggtgcacgggttgatttattccatgccttcacctttggctcactcgtgtgagcctgagaagagagtggctttgtgaagggcatccccatgctggcctcttcccaaacagccctccttttgtcaggagtcggctgggaggggacctcagctcaactgtgaaaatgtttgtttatacggagcccctgatgagccttgggagtctaccttcctgtccccagaaacaaaacagaaaaagcctggactttgcagtcttccatttgaattgtacaggtgtctcttaacgttcaaaaggctaacctggaggtgtgctgtgtgtctccaggtgccagtacggctggcaaggcctgtactgtgataagtgcatcccacacccgggatgcgtccacggcatctgtaatgagccctggcagtgcctctgtgagaccaactggggcggccagctctgtgacaaaggtatggcccttagggatgagacccagggtgggatctgggggtgggatggcactaatttggtttctaattttattggcaggggcttttattctgaattctccttgaatgctgtgtgggttttctggtttttctttttaaaagacgactggggctagaaacatggtgggttcgccatcttcacaggcgtctcttagtgactccaggatctttttggcagatctcaattactgtgggactcatcagccgtgtctcaacgggggaacttgtagcaacacaggccctgacaaatatcagtgttcctgccctgaggggtattcaggacccaactgtgaaattggtaagtggtccaagatgaatgagagccctttgtctaatttttctgtactcagcttttaaaaaatatacttaaggacttgtttaaggaaaaaaaagtgaaaatagcttccaaagataggccttatcccaaccattctataagcctttgtaactttcaagtctctaaagttttttgggtgatgctgattcgtataggaggcagcgggagatgaaatgaccccagctctgagatgtcttggaatgtggttagagacagctcagcgagaaagatgacttcctttctttcctagacacagcagggttctatcacacgcttgcttttggtttttgaaatatgcttgcactagtggctgtggtgtgggattcggttggaggggggtgtggggaggtaacggtgtgcaggcatccctctctgactgccatcctggtttttgcagctgagcacgcctgcctctctgatccctgtcacaacagaggcagctgtaaggagacctccctgggctttgagtgtgagtgttccccaggctggaccggccccacatgctctacaagtaagtccaattttcagcctgtgtccattctaaggatccttgtgccaagataccacgctggggagaggtacctaggcttgtccagtgtgaatgtctcggtgagagaggggcgggtgcaggcctaagtctggtaagcagtctggtggcttgtgtgtttggaagtctcccagcacccccatcctgtcccactaaggtagcgcatgtatctgttcttggaaggaacgtcctcgtggaatcgcttgttcctttgcatctgcttcctggagctggccaccttccaattgtggttattcttcttgcagccatggagaggctgccttcaggggaggttgtcacttactactggattctgtcatagggccagggggccccagagaagaacctggcctgcagagttcctttggctgtgagacagggctgtatatcagaatcacctgggctgctttacagtgtaaatctctgggtcccccagattccctccagaatcggggagtccatggtctttgataaacttctggaattctgcagtgcagccaggtctgagaaccgctgtcatcagcaccccaggtgtggttatggatgtggatttctggggtcagattgcctgtgctggtcctaggcccccacctgtcacttgcggaactccagcaggccacagaagctccccgggccctctttaaatggcacagtagcaattcccatctccgaggttgtcataaagacacaaaagtgaatacttcataaattgttaggagttgtctctggtcagagcagaagtggagaatgcagcctctaggtgtgctattttgggcaaactctgtaagcaaatgagaggaataaggttttccacctgtaaagaactatttttcctgacttcttagctacttctgagccatgatgaaacttttctttaaaaataaagattaggcagatagagatgtcctgtgttcctcctgggcggatgctccgtcagtatccagctgtctttctcccccactgcttaggttggggattacatgaactggggcagtgggggatttaaagctaaaatcaaggcttcggccttatcgtcaccgtcccacttgtcctgctgtagctttccttgtagcaggtgtctggctcttcaatgacagcccctcatgtaagaggtgatgttaaaggatctaattgtcagatggattgaattaaattgtcaaccccctccttttcttgttgaccagacattgatgactgttctcctaataactgttcccacgggggcacctgccaggacctggttaacggatttaagtgtgtgtgccccccacagtggactgggaaaacgtgccagttaggtaagaacatccctgtgactgtaatttttataccaaggttggctttgattgtcaaagccattacagaagacgagcgtgtggccggcagtgtgagttcacactccatcatgctaagaagtaatttattatcaagagtctagcaggcctgggagaaataacttgaatgcaaatggactagctcttttaggccctgtgggaaagtcgtgggattccttgaaccatgtcaatcgtctgtccgaggagtgttcagctgggttccaaaaggggatgatctcatgaggaatgagctgtctgcattctttttgccacatttaaatcccagcaactaggctgcctgggttttgcacagaaatgcctggtggctttctgctgttttgttgggggctggttaactagcagctggaaagttatcaattagggttcttattggataatagctagggagagggatcagatgcttaaaatagagggaacctctagtatcttttatttagctagcttattaaaatgtctcatgtctcagacaaactctggcctgttctttttttttccaaggtgggggagatgggggttgaacttcatttctcatgctcatccccatctcctttcagatgcaaatgaatgtgaggccaaaccttgtgtaaacgccaaatcctgtaagaatctcattgccagctactactgcgactgtcttcccggctggatgggtcagaattgtgacataagtgagtgactttgtttccattttgattttcatgaaacttgggtagccgacttgctggtccgtactggggctccagtcctaggacttgagcagtagaaggaaaaccttagagtgggaatggttttttgagagggagtggtcagggcagcagtgaaaacatacactttatcaggctcattagctgcgaaaaccagccatattctgataatgtggctgaaacaatgatgtgaagtttcactccctcattctggaagaattagggagggtccccacccagcgtaataaccttatctcacggaaagcacacaggaaatctgatttgaaacttatctatcctgagctgagaaggcttttcaattaagcccaatttcactgtaaattacctctttaaaatgatgacttatttattttttagatattaatgactgccttggccagtgtcagaatgacgcctcctgtcgggtatgtaaatctttgcttaaatcaaaactttgacaattgacaacaaatctttagatttgtgcgacactaggagagctctgtccctgtgagatttaaaaatttgggtgaaaaaagagtctcttggaagtttcgctagggcttatgttaccccagcctcgtgggagtcattttgaaggcatgcacatagaaattcctctaaccactttcagaggtttagcatttggctatttcagtgaaccagctaaaccgcaacagtcatgctaaaccgctgaagccctgtgtttgtggaatacatagaaaaaaagcatgtgtctctctctccccttctcctcttctaggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcaggtgagtggtggcaaaacctcagatggccaagtttttagagcagagccgctgcctcctccgcttccctttacttttccctcagctcttgtgtctggaatttcctaacatctattaacatcctattgatgagagagtctctgctagacaaatgctggtggaaggagatactgacgaattattttcttcttagtgtcttcgtctttgtgttctttttggttccctccaccccctcttgtgctccctctcccactctgccccgttgtttcaaatactggacattggcagtccctacagcatagagatgtatcttacagggtgtctcctaatagaaaccgaaggaactgtcagattccagtgcctgctgccccagagaagttatcgtgacacctttgttttactctgatccctcccccttttcgctgttcctgatatttgcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaaggtacctcccttctcccgggacctggctgtctccagacttgctccttttgtccccacttactaccactgccccttgttacacttgagaagtaatgtattggtgaggaggacctctatagtgaaatgatcctgcctgtgtagcgggccgcaacacgtggaaacaatctattccggcctgccagtgggagagccgtgtctacaagtagcccaggggagagaatgtgaaatccatttagcattcctgttctggggtgggctgatgtgcaacgctgaggcaaatgcctgagaacaacactgtcaacagaacttcctgcaacggcagacagagggggatgttctgtatctgcacggtcaggtatgggagccccaggccatgtggactgtgactagtgtaactagaaactgattttatttcattttagttcatttaaatgtaaatagccacatgtggccggtggctgctgtattaggcagcacaacatttaaagcttctataagattgtccttgagccttgcttaagatcaaaaaggaagtaaataaagcaggtccttttgccttagcaagtgtttaccaaattgggtagatgtcaaaggtaggatgaaggggatccacaagcatgtgggttttcctggttgtgtggagggagaaaatgctttaaaactctttgcctggagtctcaactttgcctgtcataatgtgatgtggcacgttgccagtatcttggcttccctggggtgtgtctcattagccagagggtccctgtctccaggaaagtgggcttggcccaggcccttggcttaggaatgccgcatctgtgggtgcatggctgtgatctgatcccaagcctatcttctagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaagtaagactccctcatccgggaatggaccagtgctccccagcctgcccctgcccctgcctctgcccctggcccaccctgggatcattggtgttgaaagttttttttttttttttgagaccgaatttcgctgttgttgcccaggctagagtgcagtggcacgatctcggctcaccacaacctcggcctcccaggttcaagcgattctcctgcctgcctcagccttcctgagtagctgggattacaggcatgcgcaccacgcccaccacgcccagctaattttgtatttttagtagagatggggtttccccatgttggtcaggctggtctcgaactcccagcctcagatgatccaccccccgacccccaacttggcctcccaaagtgctgggattacaggtgtgagccaccatgcccagcagtgttgaaattgttttaatcagaaacagtaaggctggggagactggttgagacttatccttacatctgggatctaagactgaggtcgtgttcaatttaccagatcactctgcctcggagcctccatatctatgttggaacattctggaatgttgctaggttgggtgattcctcttttctgtaggagtttcttccccactttcacctagtaccggtgactaaatgcccatgtgagggcattaagtgggtaaggcactctctggaagcttctgcttgataagccgcctgtctaatttgagaaacagccctgatggagggtagcaggtggaggtgccaggtgcattgtgtcaggagggagccatgaaaactgctgaacagtgcttgtctatggcttcacaagtccttcagttctttttttgctttactttgtttcatagatattaatgactgtgagagcaacccttgtagaaacggtggcacttgcatcgatggtgtcaactcctacaagtgcatctgtagtgacggctgggagggggcctactgtgaaaccagtgagtctgccactctttggggagctctgggatgtatgggtcatgttggagggatcccacttcaacgtgggaaaactttctttgtactggaaatctctggaagcaagaccgcagtgatttctgcactgggacagtatcacttgtgtctcatttgcatttatgagtcctgatgatagcttatggggaggagcttctgctgaggacctatagaattagactgtgtaataaatattcctgcttgcaaggaaagtcatatttctactttcatttccatgggacttccagaggcccaccccacatcttgcctaacttgtggcattcaaagtaacccagttgggagctcctttattcctggaaaagcctgattgtgttaaagtactacgactgtggctgttctcagaataggatgttggatgtaagcagtaggaaaggcttggctctcgcctgtcgtgaatggtcctggatctcgtcttcagccgattgtctcccctttgattctagatattaatgactgcagccagaacccctgccacaatgggggcacgtgtcgcgacctggtcaatgacttctactgtgactgtaaaaatgggtggaaaggaaagacctgccactcacgtaagtggtagttggccttggatgctatctctgggacccttccctctgtcttctgtgggagggggccactgggactcacactgaaatattttcctccaggtgacagtcagtgtgatgaggccacgtgcaacaacggtggcacctgctatgatgagggggatgcttttaagtgcatgtgtcctggcggctgggaaggaacaacctgtaacataggtaactttatgccccacgtgggatctgcagtgggcatggccacctgggcgtgtctgctggttggcccctggagcttatgatatttctctgggcctggttcttgcccctccagactgtttctggatactcagggagggtggtcgtgtctgctcttcttttatagcccgaaacagtagctgcctgcccaacccctgccataatgggggcacatgtgtggtcaacggcgagtcctttacgtgcgtctgcaaggaaggctgggaggggcccatctgtgctcagagtgagtgtcctccccccttgaactctcccagggctgtcggagcagatcctgacacccttggggacttgcaatggaaaccagaagcagagctgtttgatgtctgcttttgtatcacctgggtctgcattaatgacttgatgggatacagccctgacctgggcatgagaaagtcgccaataagataagtggagacagatggcgtctcagttcccagctctgggtctgaccagcagcctgtctccttccattctcacccccacccctatcccctaccagggcctcttcctgtgtacatgtgtcccacagcaaatgaaactaagtgtggtgcgggcctggttccaatttagcaaaggtattttgctggtgttaactacgactttatcatttgggtattaggaaaataagtggtggttttacttagggctaagaccgctttccctgttgaagtcctcactattaagttgtcttttctttgcagataccaatgactgcagccctcatccctggtaagtgtgacatccttttaagccagcactcatccactatcgtgtgtgtgtgtgtgtgtgtgtgtgtgtgtgtgtgtgtgaagaatcacccagggattgtgtttaaaatgcaagttctgagtcaggaggtctggggtggggcctcagactgcttttctaacaagctcccaggtgaagcgatcctgctgccccatggaccacactttaattagccaggttgtgtcctcatttagagcagtgatttttcaaccttggctgcacaccagaatcacctgggagcttttaaaaatcccgctgcctgggctgcaaccaagacctgtgaaattagactttctgggggtgggacccaggcatcagtattcttttaaaattccccaggcaacggccatggggtgagagccactgactgtaactggtgtggtgacatgtgagtgattggcagccagagtaatggactgggaggttggtaaccaaggtggtctttgctttcttagttacaacagcggcacctgtgtggatggagacaactggtaccggtgcgaatgtgccccgggttttgctgggcccgactgcagaataagtaaggactgtctccgtctggttttcccaatggctttaccgcttcattccatgcctcaccccaagactttcatctttaaaaacaaagccaccattccctttaagtagctctcatagagcaaaggatctctctcctccagctgggattaagatatgccaggctggatcctcccaggtacctgctggtagttccctgggtggtgtagccctccttgttcttggggagagagtgccagtcacagaatctgatgattaatctacagtggggtcctgaagaaagtatgtgcatttccccatgactaacatgaaattatgggcaagcagatgttaaccacagctacactggtataggataaagctaatacaaacggaagggaggacgactgtggcttccagaggcttgtctgtgctgggtctgatcaggccctggagaaatgactaaaacaggaaaataggggcaggcaacgcagtttttcaagaggcttaaagcatattattttgagccttttctctacttttttacaagccctttctcttacagaacaaaaaaggtgctagagtagttatggtttgattcttgtacccaaattgtctgaaattttactggtgcttgaaatccaagtctgggattaactagtcttcagcactagatgggggcaggttgtatctgtttcatgtttctaaataaacagttggcaaactgtggcccaggggccgtatccagcccactgtctgtttttataaatacagttttcttggcacacagccacacattcatttatgtattgtctatggctactttcatgataccacaagagttggatagttgtgacagagactatataccccacaaagcctaagatgtttactgtctgaccccttccaggaaactttgccaggcttgctgtaaattgcactgtcaaaggaatcaaattaaaaattgctgcctcccaaaatggttctccactgttagaactcaggatggtggtggtctttgggagccagtgattggaggtttttgcaatagatctgtttcttcttttggatgctgcttacctgagtgaaaattcatcaagcttatgatgatatgcttttcttgtatgttatgtcaataaaaacaatctcaaaacattgccacacaccatcagtccctaaacttgaactccatttctcctagacatcaatgaatgccagtcttcaccttgtgcctttggagcgacctgtgtggatgagatcaatggctaccggtgtgtctgccctccagggcacagtggtgccaagtgccaggaaggtatgtgtgccaggcttcagctgcccatgggtcttctggggtgagcgagctttgcagtcaccatttgacttttcacaaataagccactgtgctcagggaagggaacacacagtgggactacaagggaaagggaacgtgaagagtcttccccaaaacaggtagctgttgtttttggtcagctgttgccacaaaactgtgtaccaaaccatcccaaactgctgtggcttgcagcaagcattatttttattgctcatgatatgcagcatgggcagagagattgcgctgtgggttgggttcagttcgaccagtggctgtgtctggggcatattcctttcatcgccagtgggtaggtgtgcaagaggctagtcaaaggctctgctcacatcacatctgccaatgttacattggccagagcaagtcttgtggccaagcgcagagccagcaaaggcaggaagtacacatgctgttactgtgggaagaatgatcttaacatggcaaagggcacaggcataaccatttcataacagggaccaaagaattgaaccccgatccggttcacagaaaaataaactgctcacccgtctccacctgtcagtttcagggagaccttgcatcaccatggggagtgtgataccagatggggccaaatgggatgatgactgtaatacctgccagtgcctgaatggacggatcgcctgctcaaaggtaggacatgatggctgccgcagttcacctgtgttctggaatcagggatgagcatgcctgctaagctgccagcttctgtttttctccaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccagtatgtaacaacctttgttttttttttgaatggtggatgtctgcttgcttgctttaaaggaggaatgccatgagctaggatctacttctccctagcttacattcctgttttataataaagtaagcttgaacttagccagcctcaaagagaacatctcagccttttgttcttcctctcaatcttacacgtgtgtgggtttttaaaaatcgttttagggtcttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaatggagcaaattcactgacaaaaagctttgcagacacagattgtcgagtaattttgaagaaaggctgctttgagtattcctctgactctcaagtctgacaattgtttttccagtctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacaggtaggtgtcaagtgggactagtttgtgtgatgatagtagatgatctcattatactattcaataaagccatcaggtcgagggattatctggcagtgccctaccctcgcaggagctcccaatttaactgagaactgagggcagcctactttactaaggtcacatggcccatgggaacagaggtctgcctcatattttccttcccaacacactatgcaacgttccctgcagaacaggtattgtgctagatccgtgacaaagccctaggacactgcttgtcctttgtccttgagtttgaagctgtacaaagcctgacttggcattttggtgtcctgggacagcctagccactgctgagctctgtgaggctcgatggccccgcaggggtgtccaggcttccctcctgaggatctcgagcaccgtttcagccaagggagagattgggcatggagccatggcacgtttgagctgtctgtgctaatttgaatcggatttctagttctgaaaaccaactcctgtactgagctgcctcagtagccagacttaacaagacactgctctccccatgcgaagtcaaagagcctgtaggagctgccgctccacccagtctctccagggataagagtatcaaggtctacaggggcctgatcccagcatttgcttatcaagttgtgaagtgaccatatgcaatgatgaaaagggacttgtccctgtggcccccctcttagggataaagggcaggagaaccactgttggtattcttttgttcctgcgatgatgcttttttctttctttcttggagagttaattggttttgtgcctgccttacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaattttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatctgactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcct

SEQ ID NO: 123 - DNA, 5943 bp, Homo sapiens
cagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaattttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatctgactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcct

SEQ ID NO: 124 - protein, 1218 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 125 - DNA, 1130575 bp, Mus musculus
  misc_feature (1)  (1130575): n = A, C, G, or T/U
ttggcgcgctcgccctctgcctgctccggctcctgctcctggggctgcagcggccgccgttgcccggcgccggagcgcagagcgccgcaggtgagtgcgcccgccgggctccccgggccccttcgctctccccagccctgggaggagaaagttgggtcccgtggccaggggatgccggggcccggtgggagtcccgtcccaacctccggacgcagctgctgtgtccaggcgtgcccagtcccgctccaggtccccccctggcccctcgtcgccttactttcctgccgcttcccccccacccccgggcgggagtaactttgcgcggctgttgcgaatatttccacttgctgcctcccacttgtcggaacctgtcactcgagtgtttcggggtggagggaggaggcgccgcttctcgcccggcgcggagcactgtcacccgggcagcttcctgggctgcgcgctcttggagtggggagcacaggtccctagcaggcccaggctgccagggcggtggcttttcctttctcctgggagacactgaagatcatccagtgttgttctaaacacgccgctccccttagcgagcccttagcagctgggacttcccatgggagtgttcttgtgaatgacccactcggctaaaccctcacctcacctcgtggctctgtccagagtaatgggtaccctgctaaggccctttaagtgcagtggctttgatcagtgagctagtgggcttctgaaaacttcgggacactcgtctttcggcttgcccatgggcaggtagctagttccccagagtgtgtctagtgtcttcttagtggcgactgagctgaagagaccactaccgagggtctctctcatcactaaaaccccactggtagggcttccttccgtgagtcccttaaagagggaaggagaggtggggagggatacctccaagttcaaaatcacctcgaagtttcttagcacctttggtttaggagtgaccacactgagctgctgtcgctggtcggggtcgggggcgggggggcacgttgaggcatgtcagcggaacttaggaaagggttctttttggattgctaagcaacagctgtgctcacataagaaatcaggggaggaagaaagggaaagaaaggcagtgagcctgatggaagtctctaaacaggctgcttttgagaggaagaaccgccggagtgacattccgttagaaatgtcttaggttttcttccctgacttgatgttaaaatggaaactggacacaggatgtatgggaaggaacagcttgttttcgtgccagcgaagttgagcaaggaggccactctttttgaggtgtctgaagctgaaaggctgggacaagagggggagaaaagagacggccgcaacatcattctgaagatgcttcaaggctcttgtttccctcgctttggggtctgcgttaggtgtgctgtgtcaggaagctggcaggagggtgcttgaggcagtcctggggacccgggtatgacttatgattctaatctttactgtcttctaaggcttggcgggacattcatacgttaatagtactcacgttcccgcagcagaaaccggatcaaacacgtcccacagaccttttttgggtagcagctgtaaacccagaacctgctccagaaagctgtccagggctgaaacgcacgccggttccgcatgttaccgcaaggtggcgctcgctcacagctgttaaatgcaaatcgagccgctttcatctcagggatagaacttcggttcaatttttaaatgagtaatgtgtttattcagcagccttttgttaaaacatttagagaagtgtgaggaggaagcaccttttctttgtttgctgctcggaacacaccgggaagaaaagcaatcctggagtacagtttgggaagaaatcgactgcgaaggcgccatatgtttcctttggttctacctgggcccatagcttttgcaaagctacaatagcatatatttagcaagcggctgcgttgttcccggctccttaaaggagtaggattagcttgtcttggtgacttggtgcgttctaagctccgctcatttatagaaatgggcatcttttttttttctatacctagctcattatcgctctactttaatgctaactagatcgtttaaactggattcttccggggctttccttatgaacatctgtaattgtcgacgcgttaatcctgcaactgttgacttgttaaaacggacttctcttcttattttattcctcattgtggtattgtcagaatccaaatttgttataagtatgattatagtttgggtctcttttgaaaaagcttattttaaactttctgcaagtctgagtaaataatgcattttaaaactcagtagtgtgttctccatattcctttgatctgaagattccccggtctcggaagcaatttcaatttgtgagcttacatctaggacattgagggctgatgggctttgctgtgactgttggtcacagtgtccaaaagtcggagtcagaagctgtcatcaaaggcaatttccccctaccttactctaccctgtgtttcatgagccactacattttttttttttttggcgagggattatagtaaaagaaaaaaagtgctttgataatagttggtaaacagaacacatgatttgggaatgagggaaggctatggctacgtaattagatacgggataattagtctatttatcagtgggtttcagtattacaagttaaagccaaatcttgacagggaccgactctgggtggcagttgtaagcaatgtagtcatttaactcaataattgctgccagatacctctggggagctgttcccactacagttgcattttactttctgtcctggattgcttgatttgtttcctaataacagaacaattaatgtggagacctggctttgattctgttccagcaacaacaacaaacatgaaataaatagagacctccgtcttgggttacagtctgtacctttctcttctgtttcagttccttcttgtttatcctaagcacatttccacaggcttcaggctgccagcagagatggcttctcttgtagtgttataactgtcaccttacagagccatgatcagaggatattacagcatcgttctcttaagcacgggatactcccatgactctctgactgcgtgttgctgtggaaacaagagcattgctatgtaggcagtggtccttgataaatatttatcgatggtgatgaagagatggtggagcctcacagtaaccaggatggggaaggagtatcgtgtttgggaggcagcgtggcttggagaaaagcactggagctcaatgttcttggtttgaatctcacctctgcctttggtactggctgtgccacattggacaggctgtttatcttctccaacctcaagctcttatctgcaaagtgaggataattagagctgcctcactgaattttgtgaggactaaagcagaagatgcatggggggggggtactctgtccagagtgggagccaactgttactctccttggcatggctctgtgctcctgcgtgtatccgagctggggccgtggtgctcctgccaagctaagtgaagcactaagcaggagacggctggactttcatgatgctttttagttttccatcctttattcattttttggggggggggagtgggtcttgattccctgatactatttttagaaagaaatttcaaatgaaaagtcccagcaagtgacagtagtcagtttagttgtcccagaatttgtggaaagaatgttttaactgcactttgacctttgaactggcacagatttaaaaaggtcatcagggtaaaatctttggggcttatcactgtttcctcttttttgcatacgctcctcctttctggtcaggctctgtccccacctctgctcctgcctcttatgaaccccagaaataaagtgtgcgctgcacctatgaagttgataaataagcaaagactaagaccaaggtatagcaggctatggtattccaaggaacaaatttaaaacgctatgagaacaagctgtgtccaacaggtgtgatgggtttaggagccggcaccacgaggctaggaaaagtcagttatgatgttttatggcatcttagaaaatggattcaaatggagtgagagaggaaggaagccacagggtttaattgttaaatcagatgtagttaaagggacagtggtaatcagttcagatgaaccaggatactaccccccctcccacccccacccccgcccaccgacccccactgggcctgttgaaagtgaatctcaatacaggaatgagaggcagagagatggagggacaacatgtgaatggcaaatggtgacacttagggcctctatggtccccagatctcagtgtgattcacttggcatttcctatgtacacaccaggagggctactcagaagcccagtgggatccgtattcagtaagtcactaagaaacataccaagtctgcagggtggtagacccacactggagtgttgaatgaagtacgcgtctcactcatacatccaacctctgcacaccagtggagtgtgcataggaccctttgtggtttttgaatattcatattaaaatttttattgggtgccggagggactaaaaagcagcaaaaagcatttttggtgattagtttgtcaatttctttaaaacgggaaacctgcatctgccataggacgacgccctcatgcttttaggaacctgcctggcagaaattaacacacaagtccagaggaagatgggagcatgaatgctcgaagaagtattatttggagtcgccccaaatggaaaggaacccacgtatccatccgattggatattgctgctaataaaagagaatgaatttcggatatctgctaagacatatatcaagaatcagatgctaagttaaagcggctagatgcttttcatagtgtatgggggactcagaaaaggcaaacctatggagaacattggcttcccaggctgggcacgggcaggggttctcagcaagctggtgtgagatcgcttttttgagacgatggaattgcttgaccgctgggaaggaggcgatcctgattggttaactccaggaatcggcaggacatgctagaaggatatacttagagtgggtggaatgttgtggaattaaatctttaaactgtttacttcaatgtgagcttccaaatgaagtatgtggtatgatcttgatgaagcatttctctgcttccacatctgtaaagcaggaataccaccaggcatccaaggagagtgtcttatctcgctccagtttccaaaatacttacatgggatacttgcaaggcctgtaggtttttagtctctttaatctgtgaattaaatctctaaactagttgcctccttactcattgctttggcaatagttaaaataaaatttaaggctatgaagttttggcaaagaactcgagtaattagatggctctatgcatttttgaggttgaaagcaggctctttgaatactgctagcagaatattgacttccaggcagctaggatgagagtcttaaagcccacacccacagtgacacacctactctaacaaggccacacctactccaacagggccacaccttctaatcatgccactccctgggctgggcatatataagtcacgatagcaaggatgtggcagtttagcagaagcatcttatgcttcccagataaacacaggtgtagtgctttttggccctgggtttccagccaagataaatagctgcacagttgaggaaaaaaaaaaaaaaagctctgtattggttttctgtctatcttttttaggggcttccatcaactctctggaatagtgtgtgtgtgtgtgtgtgtgtgtgtgtgtgtgtgtgtatgtaatatgtgcatacatgttttaggcatcaaacccaggtcttgcacattgctaggcaagtgctgcaccaatgaactatattcccagcccctggctttggatgtaggctcttgctctgtggttccccatgtaccaccatgtctgactttcatgctgatcttaaaccagtgttacccatcttgatctttttttttttttgccatcttgtaccttgtgctcagacaggattcagagctcatgtccctctgtccctgagctcctgcttcatggcatcctctcagcctgcttctcagaatgccccagacaccactgtatccccttttgtctcttgggtctggaaatggtcatgaaaacagaatctgtttttgtgagtcatcccccttgcccggcaggtggtcatgttttcatctcaaaatggcagttcagctgtctccttgttattgagtaaagatgaatgaaagaatgagtgactgcataggcaaactcatatcagcaggcataaaaaatgttttaaaagtacctgctatcggatggtcttgacttcctcaagtattaatgacttgtttctgctcgcgtgatcacaatttgggctgtgaatctcctccacaccacatcctttctcactatctttgagagttcttatttatttatttttgacagtaggctggatcttaggttaaccactaggtattctgactcaaacatacatctgggtgatattttaagagtcctggggacatcaacacatgaggtgtccatttgtgcttttgtttgaacattaacctagaacgggataaaacagaggcatctggtaatgttagggatggaaacgaaatctaaacagcagagacccacaatcatttagctcttgggtttaataaagttggttcgaatgtgagaacttattaatctaattaaaatgtttgtcacattgtcacactttgcgcttaaattagtacagcctagaaactgatgttacagtttctcttctccttaggcatttaggaagtggtccctccatgcatgcaagctccgtgctggggacccctgccagggttcactgggtgccaacttttaggaaaaagagaagggcgaaaaattttaagtctcaccttaaaaaggaaccactccccccccccccccccttctgttgtgcccttctgctgtctcaggatttctttgtagcaggaagcttagctgagtcctctggtctgagcctctcactggattcagtcaaggtgtttgtgagagcttccaggattgtgctgaggccctgctcttttgctttcccatgaggtagctgtgggattcagctcttccctgggacctcaggctgccctccattccttcacacatgggcccttctcagcgtggggcagcccacagctcagcagagtgagtgaagagggcagtgagccttttgtaacctgatttcgaaagtgacatcccattgcttttaccgtgctccctttggaagaggcaagaaactaaagaaccaatagaatgtactagaagatatatatatatttttttctatatatttatttacatatattcatcatgttatatttatcaacattatcaattatatagccattttatataaaatttctaaaaattagttgttccattatactgtattaaaattgtatcaatattaacaaaaatgatacttcacatattacaattatgctattactatacattacactagtatcctatgtatacatatacaaatgttatatttggagatttatcataggaattgactatcatagttatggaggctggcaggtgtcataatttgccatcttcaagctggataccaggaaatgtctcaagaggaatgtctttagacaccttgaatgtaccctttatgtgtctcaggaattgactggctggccttcccaattttgatgctgcaattttagagcagtttctcattgctttcctgttttcttcagccctgctaaatctggctgtgcatggtgtgtgtatgtgtatatatatatatatatatatatatatatatatgtatgtaaatatatatgtatacatatacatatatatatacacatacacacatatatgtaatatatgtgtgtgtgtatgcatacatatgtatgcaatatatatgcaatgtatacaatatatatgtgtgtgtgtgtgtatgcatgtggtaggtgaggagcatgatggcttccgtggagtctagatcagggatggtgcatgtggctacacgaagcctgtgccgctgtacttgccatgcctgggtcacgggtgctgctctgctctgctctgcagcatcagtgttgagtgtcgccctttccccatctgcacatgtcaagctctgaccgtcttagcagttgtgaatttattcacttgcgcctttcttctggttgatgaccacttgctatctcttcaagtccacctgttgcgatagggagtgtgggaatgggactgtggcgaagacatcaagccaggactctaaactgtctcgggcagaagtgggttggggctgggggggatgactggttatttattttctcaaagcttcaaagccctcaagaagccaggtgtgctgccagctgccaccacgtacccctgctggctctgcttcaaggcggttctcgtcccctaaacagaactgtgtggaacgaagcagaggccacctctctagtgctttgattgcactgtcttgaggccactttaactaggtttactcaggaactatggaacctgcaggatgtgaggggtcttatagcttttaactgttgagatgtgcatcgtaaccatgcaaaaccccttaactgcggcacctaactatggaaccaccctttgcttctgatagacttgccaacgggacgtttgtattttctccccagaaggtgcctattccaagtggtaaagtgtatttctgggccttttccatcccgtttttggtagacaagagcaactcagttgagccaattatagaatgtcagggtcaccgctacctataaaaactgtacatatattttaagatgttcattagttaaaactatatcctgagtcattttttaaagtgaagtagatggatttaagtttcttatctttattgcctttacctttccctgtatgaaaaacaattatccaataattaaattcctttgtgtataatcaccatattgcttttgctgacgcatttctcagttctgttcctggtttcttgcactttgataaccttaacagctaccatttatcccaggagcagcactggctacctgctccttcagggactctagggtcccacttacctccgccggccaaggcttcctttccttatgttgatccaggagcatccttttaggacccagaggttttgggctccaacctcagacatctctttttttgctcttttggatccttcctcctacctcttactttatctcacatagaagagtctacggattttgccttaggctcattgccttgggctcagacattttttttttttttttaatgttagtcccagcagttaagtggaggacagcagatacatttcatgaggctcagcttcttctaggacatttctcatgtttcagacatgcttgacccattgttgcctgctttaacattgtggttatccatggacatctggccaatgccatgagcctcttgttgtcatcccattacagaggccagtgacatggtttcagagcagtatggccaactctgtgttgcttgatttattaagtctccaaacataatttcctaaaagtaaggtgctcatgcaagcggagacatttgaagcctaccttgggctggccttctctggcctcagacttcactgttataatgtgtagctatgtgagacatcaacaccaggccagtcttgcttctttcctacctgcagcccatgtattgtgatgccattgtcttttacagtggcatcatggatgatcttaatgtcaatgaaccgagcatttacttaaggaatgttatagacaatagactcttcagtttatggactaaactcagtatctacaaggacatatcctctcctgtgggcagaaaacagaactgatcttatgggtgtaataatcagataagtagcaaccattgaagagtatcaaaataatcgaggtgttagcagcaggtgggtggtattaccccttggaagagacatgggagaaatggaagtggaatgctaactaagggcatcttggctttgtgtataatactctatttctttctgataaggggaatatattcaaaatagatttgttaaagacaagtcaatactttttgatagggaagaagacaggtgtcaatggcacctttctctataatagttctagactgaaattagtctctcaggaggagatactgggggcagctggttggagagatggctcaggggctaagtggaacctccggtttggttcccccaagcccacacggtgcagctgacaacctcctgtaacttcagtttcagggatctgatgccctcttctgacctccaaggacattaccacacacatgcgcatattaacacacaggcacacatatttatgggacatcaccatgcacatgcgcatattaacacacaggcacacatatttgtgcagggatagaaataaatcttaaatgatgcctgtggagtttaaaattgttaatgaagtgcagttgataaggacttagaatgcatatactattttccccgcttgtcttttcaaaaatcaattctgaaatttttttcctctatgtggaaagcctcattttagggtgctaatgatgatttctcagggggactcaggttggctggatccactcaggagatagggagaggctgttgctgacacgggcatagttgagtaggagcttatgagggtctacggaggggcttgtgatgtggtgtaacagctgccctcctcctgcacctatctttctcccgggacttccatggaacagatgttacctcttagacacaacagatggaacagcctttggctctgggtcatacgggccctaataaggccttttgacttacgtccttggtgtttgagggtgctataaatctgggcagcttttgtatctgtcgataacctgctgacttctatgtttgtttgcttgtttgtttgtttttctgttctggtgtgtggctctgtgtgggtgagcacacatgtggaagccggtggtcaatgttgagcgtcttcctaagttgccttccagcttatttactgagacaggggttcaccttgaacctgagttttacagatttagctagactagctgaccagggagcttccggggttttcatgtccctacccaaaccccatcggtgtttgttttctctctgtgtgaatggttttgcttgtatggatgtgtgtgtaccccttttgtgcagtgcctgtgaagaccagaagagggtattggagcccctgaaactagagctacaaatggttgagagcctccacattgaaggctgggaccccaggctggttcctctggaagagcatcagtgttcttccatgttcttccatctctccagcccctcaacttccatgtatttaaaggctggagttgtatatctctgactagggtttagagaaaaagcttattttcatgaaactcaaatcacttaaggtctttggtagaggttaagcatatatatatatatatatatatatatatatatatatatatatatatatatatatttaaaaatatctgcctttgttctattgaactattttattatttgacagtatccattcccccccacccccaacgaggatgaattgtgaagtcccagaaccaggatatgaaacagcttttccagggctgctcatttctagctgtatgtccttcaaaacagtctagattaggatgtgacaggaggggtcctgactctcttggaacgaagactggtaaccacccgaggtatacagaggagaagaacagttggcgtctgttggaacggaaagtagaaaatacaagatgtcaaagcatttggtgaaatgatggatgacagagggataataatagggaccagcctcaaaagttgtgaaaaacacaggtgcactgggtgtctcagagcaggaaggattcaaagtgagcatccccagaatgaatgcatgaggaaaatgactgccagacaggaggactgacgcccttgcatacttcaggtacttaaaataagccaggcagttgtcaagagctatgctaattgtcactcacccagtctccttaacagtcttaggatgcgggcacacttaagaaccaaatttaagaacatagccattaagactgagcctgaggtcacacagctagcaagtggtttcgtcaggatttgagcccaagtgactcaaggctggaatatctaatcttagctatcaatttatgttccctttttctcatttactttacacgcccactgtgtgaatttcatccttaggggagaaattaggtctacttgaaattcctggatagaaactctgcctttagaaacttccatgggaacattgttgggaagagatttaggatgccatttacatcttataattccatctagaagacatggtattcccatatatcatggaagacatttgatttcatggagattcaagggttgggacataaatcggctcatgctaatgtctaggttcttagtcaccacgtggtacagaatgttaggagctgtttttatggcagtaagaagtatgggagagaggatgttgtctgtgcaggaagccctgtttctcacaagagactcatcttttctagtctcttcttcttgttaaagatctacttatttattttttatgtacatgagtactctgttttcatggtcatcagatgagggcttcagatcccattatagatggttatgagccattatgtggtagctgggaatggaactcaggtgctctggaagagcagccaatggtcttaaccactgagccactagagaagattttgtggagagattccctcataccctgagtcagattttgttttactaggttctattagagggtcctgtgactgagggcagctgtgcccccaaaccctaggctatggtctttggtcctctgtggctctagcagattcagtagtctagaagaatctttagcttggggaggagattcctctttcaattcaacaagtttgaagttgatgctcataccattgggtggggttacctttgagtttagatgtatctagtgttgagtgttgcagatttttttttttttctgtaagtctctaaattttgagatgagaggcctggagaatttttttctttaatttttctaaagatacctaatctctttcctaccttcttactcttgtggtgtgagactggcaataaagaataggcagattccctcccagctcagtgtcagctccatgaacacagggttaaggcatgacccttcttggctttgggatgagtcttctttgtggaatcgggtcatttacagatgatccatctgttttcttaagaagaaatgtataggtgcgtaaggagtgggctcagcttggatatctgactgtaggctccagaaaatgtttgtctcaagcatacattatgaccttgatggagtcctctgaagacctccgtctggtcatctgttgagatgatgctaatggtgatgtcctgacagttgtggtggtgacagatcactgcggtgttacaggcagagtctcaggaaagggccaggctcatggcaagtgctcagtaaatgctcttgttgatattaggagttctgggaactcaccagagccctgccctgttagtgcctgaaagcacaagaagaaccttactgggctgaccagcagtttccatttgtcttagttccttttctattcctgtgacaacatcatgaccaaggcaacttataaaagaaagcatctaatttggggctcacagtctttctagtgagtccatggccattgtggcagagagcaggccagcaggccagtaggcaaacaggcatgaagctgcagcacccactgagagcttagaccttaaccaaatgttaatggagagagagagggagggagagagagggagggagggagggagggagggagagagagagagagagagagagaaagagagagagagagagaagaagaagaagaagaagaagaagaagaagaagaagaagaagaagaagaagaagaagaagaagaagaggaaagaaggaagaagaagaagaggaggaaagaaggaagaagaagaagaggaggaaagaaggaagaagaagaagaagaggaggaaagaaggaagaagaagaagaggaggaaagaaggaagaagaagaaggagggggaggaggaggaggaaaaagaaggaggatgaagaaggaggaagaaggaagaaggaagaaggaggaaggagaaagaaagaaagaaagaaagaaagaaagaaagaaagaagaaagaaagaaagaaagacgaaccaggaatagcatgggtttttgaaaccacaaagcccacctttgataacacacctcctccaggaaggccacacctcctccttattgccaaatacttccacttactgaggactaaacattcaaatatatgagcatatttgggggcagggtgtgcttgttcaaaccactacactatttgcccagaatggtggtatttcccaagatatagcttaccctacagacccagaaattttctaattttttttttaatagacaactaaggtccattgtgtctttggcactttggaaatgcttggcttatttatcttggtgtatttttgttgttgatgatgatgatgatgataatgtttgtttgtaattatttttactagaagttctgttccatgagggttgggtttctgtcctagtcagggatgatttcttgtgctgtccgtagttctatacacagtgtgagcttactgtgggtgaatgagtcatgatctcaaacttcagctgaagatggtatgttctgtcttttatagtagaagttggtttagcttacagctactaagaaatatctttaccagtgtttctgataatagttgatttagagtaagaatgcctgtggcaccccgatgtgtaccagaaaccacggtgcaatgttcctgtgtcacccactgtcccatttactcttcagggagtccctaacaaagtgcactcaacattcctgagggtatgtggcctactctgccagatagatgaccgttcactggccaagcctgggcttcagcctagcttgcatctatttccagggcagcgtccttttcatttcaacactgcgcaagattcaaaggagttttctgtattgtaaagatcaagtgcgtcgtaaaggaatagtttgaccttaaatatattttatctaaggtcacccaggatgctggacgtgaaatagacaatggagtaggggaaagcagaactaagtctcggctctgtgttctctggcaagttactgtgccttgtggaaccttggtttaccacgtgccagtgattctaccagctggcagggcattggtaaggtttgtggtgatgtatataagatcattggcattgggcagcagctatggtggttatgttatcttatagaaaattggtaattaatgcccaagctgtatgatgaacctcaatttcatgtgtggatctgaaattccactcttcactgttctttgctaggaagacttgctagagctggacctcacaagaaactggaaacattttaatccccatctggactggaatgcttaacacctgtctttctctctctttgtccttggggaaaaaattatccttttttctgagaccttcatttctccatcagagaaatgggaataattgtgcttctcctattggatgagtgtgagccgaaagcaaagacgtcaaagagtgaatggacagtgtagaaatggtgctcatgctaagtgcgacttttctctgcctgtcagataaagacctgtttcactacggaccttctaaatattggcattcagatatgtgtctaaattggtaggcaccgggcccggttctttttgggaatggtaagtggttaccagataacctttcaaatctcctttcttactttatccagagtcctgctgtttaagaggcttgccttccctcgcaccacgcagagcccagaaaatggtcaaagtgatgctaggcacacacaggcatctcgtctcctctccaagggagagccccagacccttcccgagtggctgaagttctatgaaaacttttaacaagtttttatctgattccatgagctcagagggtttaaaaggaggacggcctgctgttctggggaaacaggcttgccagggaggtaaataaaaggaacaacagcctgattgttagagaggaggaaggaaactgaaagacacagcagtgaagtcttaataaactcagtagccggagctgctggctctgtgggcagggattgctgtgtccctcgagcccccgagcccccaccttattgctttgctgaagatctactggcagtcatgaccattatgatgtcaggtgaagaaaacaggtgtgagattttaaacgctaactcatttttttcctaaccttggcttattgttttatctaattcccacaattctctcttagagtgcttcacttttaggcggttcatctcctgcagatcttacttttcacaatggctgataagtcttaagggacaggccaacccaaagccatatgggagatgagagttggggaaagagtctaaacctgtggtttagacatttatcctggggtgcacactatgatctccttgtgtcctggaagagggcagggtgtgtggctcagttttaatggctttcctccacagactgagtatctcctgtttggagtgatgctttccaactagtgacccgggctccaagtgtttggagaggtaagtgatttcaaggagggtgtgtagcttttcggatggttctgttgtcaatgtaagtcattcatgggaatagcttgactggggcttatgatgagcaagtaggaatggaagagaatgcacaagggagcattggggcaagaggagaatctgggtggcgtccagtacttggttaagagggctgggcccttgctctctacagaacttgtctgtgtcacctggtaactgtttccacgaacaacaatgctttttctcccttatctttggcttttaattttttttcttgaactatctcatcaggggagtaagtttatactttgggatctcagttttgaaatagcatttattttccatgtgaagtgcacataaacaattcctgatgtctggatagcaaacaatgaggatgtaacagctgagggaccccctcctagagtgacatcacagtgacaccaaaagtctgtgacagcaaggatcacaaaattgggattgaaatggtctggggaagcctcagtgccaagctatttaactgcaccctggttgtgtggcaaatcaggccaggctctgacatgacctcagcctcccaacttaagagatgtctgtgaaacagtttgacgtttctctttgtcatttgcttcaaagggaaagacttggcagctgatgcttttagcaagaaagtgctacagattggcttaatgtagagattcttttgatgaagtcaatctccaatatatttcaaatgtgcaaagtttttttttttgagaattttatacttataatatgtttggatcaagtccactctattttctcctttctaattttctctcatcccccaaactacctttccctccagaccttatgtcatctcttcttgttttggtttcttatctttttttcttttcttttttttttttttttgtaaatccagtgaatcctctcagtgctgcctgaatggggtgggtatggggccatcttctggagtataagtgacctcttggcagctgtattctttcctctctcagcagccatcagttttcagcagcttttcagctagggaagggataccatgaacccctaccctgcctgtgctgggattttggctggtttgatcttgtgcgggtctcatgcatttagtcacagctgctgtcaactgatgtgcacaagagccctgtgctgcacagcaaatgatctttctttcttttgcaaggtttcctgcagcccaggatgaccttgatcttcctacataactgagagtgaccttgaactcctggagctcctgcctgcatgtctgagtgctgagattatacataagagccactgcagtgggtttatatgatgctagggattatgtccagggcttgatgagtgctagacaaggactctatcaactgtgctgcatctccagccttctaagtgtgtgcaagcattggacggcacagtaagaggtatagaaagttgacatcatgacttttagatcggatgacttgacaaatccaaattgaaacgacagttgcgactctgtattcattaactgtccctgcatatcaaagtctgcaaaattagccacttattgcacatttatcatcatctctcaactctgagagccagtgatctgagaataacttacctgggtcttttgctttttggtctcacaaggtttcattcaaggtagcagccagggctgtgagctcatcagaagatgcactgggaaggaactgttttcatgcttggagagttgatggctacactaatttcttttgcaggtttctggattgagacctttggctccttggggctgttatctagaagtcatccttagtttcttgccacagtgatcactccatcatagtactggctttaaacccccactctgaagtactagaaaagacacttcatcacctttaccgtgttctgcttgttaaaaggtagttcttagtccatcccccacttaggcaaagggtagtagacatattgtgagtgatctgaggtaattatctggggccttcttggagccttccttttgtagactcacatctcaaaatttccttctagcagcctttagatccttgctacaaaaatgtcgcttctttagagacaagaaagattgaaatttaaccagaaaactgaaacggggatggattatcctgacatacttgctgaagttacttaggtatcttacaaaagctttgaaatatgtgacttcctctctgcatcacaataacctggaagtagacagcgtttcttagcacagaggaaggattcagaaacaagcctgagtctgctctggtcttacaatgtcaaaagctgttgggcttttaaagacatcaacaggcattgagagtaaagtttttgttggtgcgactgacatggtggcccttcctgtctgctgggacaggggttcgctgtggctaggaccacccatctaatctgcatatcaagatgtcaaggcatagcataggagggtacaaaggtcaagctaggttgcagggtgggtgtcggaggcagggcaggaaggagttagctaagagctgagtctttttttcctctcatacagggaagaattgtgagaactgtccattatccattcatgtctcccctgctgcgttgaatttggactttacaaaaccaatcaaagccattgtgcactaacgtctaccaactacaaggatggttgtcctcccccaaccccatctctgctttgtctgcagagctgtgattggaaccctttcagttttctcttatgggataaaaatgagtcgaaatgtagacgtgaaggtacagatactggcagtgatatgtctgaggcaaagatggagcctgtcagacgtacagaaagtgttgactgtttggctgtgatcggttgctggtcagatggcttcagttgtgaagagaaatgaaatgaaatgctggaaaaatgtatcttccaaacaccatcttcccaaggccaagtttagcgatagagggcccaggaatcagcattgggcacaaagaaaaaccttcactgagtcagacttagagaaatcaacagatagatccatagagtgtcctagaggaggagggcttgcttgctccagacacctccagacactccggacactgttctgttccctgctggcagattgcaaaggaggttgatgagaccaacagaactgccatgcaactgcaatgcaagttttgacagcataaatcagatcgagccttcccttatttcaagttgttctgctctgtacactccaagtgcagcccaaactgctgcctcctgcctcttagagccagctcctggcaaggtctcccaactccgcttctgccattcacttatttggttgagtttaacccaggggacagcagcctgcatcccagggcctattgctcattttttttttattacattagaatagtgtttctattttcgggggttatgaagattatatgaactttgaatttcaatgtctgtaaaacaaaacaaaaccacattggaacattacagtgcattgccatttgcttccatatcatctgtggctgctttcatgctagggccgtggaactgagtatctgcaatgaaaaccaaatggcctgcaaagttcaagtgactataacctggctgctcatagagaagggccactggcccctgctctgatgctctgaccacagcgggcgtcttatctttttctttcagggctgtgacctcagcttttactcactctgttttctgtctatgcagactgcgtcttcattttagatctattattgcttttacatgcgagtgtgtgtgtgtgtgtgtgtgtgtgtgtgtgtttgccacacatgcaggtgcccacagaggctagaagagggtgttggatccacttaatccagtttcaggaggttgtgagctgctcatcttgggtgctgagaaccagactcaggtcctgtggaggaacagtaccagtggacccatctctgcagagccgcctccccagaccttcctcttattcctcctctgtaatttctactcaggtaggtttcctttgtttgctgtttccattttcaggcaatgtccattggttaggactacagcttagctcgatgtctttcttttcttactggattgtttatcccatccaaaagtaaaatagataaaacttccttttgtgattgctgtctagaaagtatctgcctgtcaccatgcagagatggtaggcttaaattgctgctgctttgttgtgtgtgtgtgtgtgtttgtgtggcagtgtacttgcctctagtcaggcatgtttctggaagccctgacatttggcagcatctagtgggccatcatgaaaagccctttgctgtagtaggaatcatacaggctgtatttgtgtgatggtaggggaggagtagaacagagcagccccagatgggaatcccaaaggcacacatccttgctgcttctagagtgagggagcatggaaaatggctgtgcacatctgcccatgcagaaagtcaaggtcatactttccagggttggtgagattgcgttgagacattgtataactttagtgactcagcctgggacaacacatgacagcttttgcctctgcaggagcccatggctgctctaagtcttttgctcatgatcaggggatggtggataggaagagaacaagagatttggagtcagatgctggccctgtcactagtggattcctggcttgtgccttgatttccttatatgtcaaaggggtataatgacaagagccacttcaaaaaactgacatggggattaagagaggcagtgcctaggtgaagcagagagcatgcatccggtgccagatctgccaccaccatcattatctaagacattgtcctctcatgtccacaactgatgtcgtaggaaagtttctactgacttcaaatgtcatctgtggagtaaacctaagagtctcagtatatgtttctgttttgtcttgtttttatcaaacattgctcccctctctccccacgtgacagcatggttacttaattacatctcccagcttcctgccctccagtttccaaagcaggagtagccatattatcatggtaatgtggcagtaataacctaccacgtctgtgtaaataagaaacatctgtgcaatatttatgacccataaaacatagctacactctaaaatgttgttctaatcccaagtaggtcattgtgatggagccgtgatctgaggaccctcctggggcctcctgctcagcttgccggggtctgtgccagccgcccagatgggactgggcagtgccacatggcagttggcaagaggcaggctcctgagggggattttatgtccatcagagcaaaaaatgagttgcctttttacaggaaaaatggggtaaaggtgcttttgaaatcaagagcagccagcttttggttgtgggcagggttgggatctctgggcatggtgtagagggtgtggaagcttggcatcgtgtcctgacaccatgaacatttggttcgtcctgcctgtggtgaacttttgcaaaagcatccagaagactcaggatccggactgtggcccaatcttagtaattgtgcgtggagccacagtgggtgattctgaaatacctgtcatactcattggtcttaattctctctctggtttccctactggtcttctcagtgggtcctgtgcttctataagctaacttataattcctttgtgtgtttcttcatgtttatgaaggtatgtatatatgcctatgtgcttgtgtgtgtgtgcttgtgtgaatctgtgtatgtgtgaaagtgtgtgtgtgtgtgtgtgtatgtgtgcgtgcctgtgtgtgtgtgtgtgtgtgtgtgtgtgtgtgtgtgtgtgtgtgcacatgaggctagagattgatgtcaggagtcttcctcagttcctctccatgttaatttttgagccagggtttcccactgaaccaggagctcaccacttgcctaggctgactagctaaggaactgtagtgattcacctgtctcttctgccccagtgctgagggacttgtactaccatgtccggctattatataggtcttggagattcaaattctagtccttgtgctcatatagcaagcaattttcccgattaaaccattgccccagaccccagacccagcattttcatgtgggtctttgagcttgcatggcaagcactctcctgactgagtcagctttccatgcctaacttagaaattatttaatgaactcaaaatctcctcctctttcatgctgcttgatatgtccttaaagtccacaaactcatttgcaagtctggctaagaaaaacattggtagaaagagatttaatatgtgcctctattaagttctgtgttctgtgaacagcatgtcacaggactcagcaaaaaaatatttccatcaagggtcagattagtagccacagaaagaagtgtaaacaaagggacttggctgcatttcaataaaatcctataaagtgggaagctggccagaggcccatgtttctttgtttggctctatctgttggtggtaggacatacagcgatagataaactggtcctgggtaatggtgcatacctgtatccccactgcttgggagtatggggctggatggccagaagtttgaggcaagcatgggtggtagagtgaagtcctgtcttagaagacaggggagtaggaggaagagatacagaaggaacaggcagagaggaggaagaggagggaagagagcagataaattggtcatcaagtgtcctccttggtgagttgtcattacaaagtgaccttcccatagacctcacactagggctgtgaagcagaactggaccaatgtttttataagtaaaaaggtatgtgtgtgtgtgtgtgtgtgtgtgtgatgtctgtgataaacatatatgtgttggtcagaggacaacttgtgagagtcagtcctctccctctaccttatggattctggagatcaagctctgttcctcagacttggtggcaagcgtttttacccacgaggccatctcactgaacactagacctatgtctacaggttttataaagcactgtcacatgttacctctccttacagccccaaaggaagcactctcctgtttcctaaacggagggggatcttgggttacattaagtcccgtataaggaaacactagactttccccctttaatcttattctcatggggtggacatgacgggtggccagtgtgggcttacctgtggattggatttgtactgcagtcagatggttgatgtcttttgtgcttcactcatttacagggagaatgagagcagcaggcttggcctggaccactcagaataatcaatagggtaccatggtgggtgtgagatgcacaactctgtcctagacaaagcctgcgtgatgttttacttttcttacatctctatgtgtgacagagtgcccccccccgggggggtgcagttatgcatgccacacccacacatgcctgatcatcctcagcatggtctccttctctcagatccgtgttggctgcctccgtgaggtctctcagttgctgcactgttttcccaggatgccaaacaaatggcccttgtgggggattcctggcatgcggacttcccgcctcgttggtatgctgaggacttcttgcttacacataagtgcttgtttctgagctgaggctgtgttgctgggtcggctggcaggttgcaccaggcaggcttgcttcctgcaggggattggggatgggctttttgggcttttttttttcctttttttttctttttccatgcaggagagagaaggcagggggatagctcctccctgaatctgtgactagtgggtgtgcaatatgcacagcagtgctgtttggaatcaggttagcaatgaagccatcttgacctgggtgcggtaagccacagcgatggagttaaactcacctcggggccacgaattgtctctttcagtctcaaaacacctccacctctccatcccgaaaggaatatttgagggtcattatcagtgtcttacatggaaggggtgttctgcagcctgagaacagtgccataaaccggaatgtactctgtgaaaggaccatggagctgtcatcatctccctttatgtcagaaggctggagttggggagggggatgagagagagaaaggcaatggtaattcttcatggccggcatcctacctgaggctctgacaaacatttttctgcagaatccacaaggcaagtggctctgagaggcagcgtttcctgccattttataggtagaaagcttgatgttcacagaggagggatatactgccccagtattgggggacaaagcaacattaatgatagtgttgtagaagatacagggtgctcacctatatccttgaggaggacattccctctgcagtgtgaccagaggattggcaagctgacttccaactgggtctcttttaaaatcagaaagattcctcatcatcccccagcccaaagcatctctcaacaagtgacaatgatacagggctggaaggactggtacccaactctctcatggcacaggtgtgaatctgacatcttcctcacttggctttcagtttctttatctgtgaggtgaatgttgctaggtctcagtacgtatagacctaaggtaagcagaggttcccagacatgctctttccctgcacagaggcctgagaagcactgcctggcacccagtcacgttccctgttgcttgggtgtggaacagggagcgtgcagtgatcttggatgatgagctttcaaagagcttcctcggaggaatggtgacaacagaggttacttccgcagacaggagccccgtgagtggctcagctccatcacatcgtgaagtcttgtgctgagggctcagcatgatggtgtttctaaagagcaggaagttagtgtaagttttagaagggagttctgaggactcacccctcctgcaggagggcacggatgctccttcctcctccacagctctgagtatgccaaggtggaaccatctcgggaggctccacaggttacctggctcagaggggctcagtggactctggagcatgtgaacctcctgtgcaccatctaatttattcatccttttgtcttgtctatactgagcttgttcctggcctcccagagcaattcaatcccattgaaatcaccgtgactgatcactataatctttttattcaaccccttaaacaaatgaagccaaatacccgaatagaggcaccacgacacatgactctgagcaagacattcatgagggctatattgtctgaaacggctttccattcttcgagggaggatgaatctctctctctccttgtttaagcctctatccctctttgatttccccctccccattcattattgttttgtctgtgatgagcatgggccgaaataaactatacctaaaatgagagatgggtagagaattgtaaccttctgccattttaaggatcccctcggtctagatgtgacatagatgaagggctgattatctctactgagggtggtcttgaagtagaaccaagatttcatcattatgagagacaagggaaccagaaacacaaggagttatacaaaggtgcagaactgtggcttggcctggcaggctcaagggcctgtctgtgaacaagggtagagagaacatgtaaagagaatctgatagaaaaaaaaatgaggctggagatccagacttggccagctcactctggttctgctactgagtgtcaccaaagagtcccaaaggccataggaggccatgggaatgttctaagtgggtgagtgacatcatttaactcgcttttaaaaataattgctgttgtgactggcgacaggtgggtttggaaggtcgagtccatcattagcagcctaagagagttgaagagtgtggaatggttcagatcatggaagggtggctctggggctggagagatgactcagtggatgtcgtggctgccatgtgcacatggaggtctgagtttagatctccagaactcaggtaaaatcctgagtgatacccaccagcaatctcaatagtggatggaaggatggtgacagaactgggtctcgcccccagagcttactgccaaaccgacgggttccagattcagtgacagactctgtcttgggaactaaggtggagagccactgagaaagacacctgatattcacacacaaggctcacttacatgggcacacacataccacctaaacaaacatacctatagatatgctcatgtacaagagaaaagtaggtgttctctctctctctctctccctccctccctccctccctccctccatctgcatgcatgtgcacatgtgcatgtgtgtatgtgtgcattcatatgtgtgtgtgtaggtgcatgttcatgtgttgtgatagttgatgaaggtgtagatttggtattacttcatcaccaggcataggctgtgagaaagaagtttggataccacactagtaggatccttcctgtagaatatgaatacagcaggagccatcgtgtccacaagcctctatcctctcctccatcctcccagttgtgcccatgtttttcttttgccctaagaggggatctcactgctgatcaacccctttctccagtatctgggcctcatttactccatcatggtcccagaggttgacttagagctagagacttgaaccagttggctctcaccctgagtatagcagttgaactgagcagtatgtgaccctgtttgaaccagtgaagcatggagaaggaaaccaagtcacccctcttcctctgggtaaaattacgcacagtgtggatcttgatactgcacccattcagtctacatgtatgaggagcgggtccgctcagaatgatgttgtgccatgcaagcagaactgaaggacagctaggatgattggctttgggagctcatagcatcttcagcccttctggtatatgcactgagaaaatgtctcagtgtcttaagtcagttcatctgtatttcccaccacctcatgctgctagaagcatcttcctggggcatccggtcagaaggtgttttccatgagtcaaccaaggaggggcaggagacaggaaagaataatagtaaaacaatgggatccagaagctactgtcaggggaagaggctctggggagtgacccatgtctctggcaggtaaggcctatgcaggtagagtcaccaaggtcaggcttaggccattaggcgctactgtggcttcttaatgcacgttcatgcctgtgcttacctttggaacttcagtagtttacattgagccttaaagccatggagctgaaccttacacacacacacacacacacacacacacacacacacacacacacactgtggcatatgaacattcttattcgaagaacataggtaaacataatagcacactctatccacaacactagtcttgaatttttctcagctgcacttgttcaatcacagtcagtctgtctttcctggccttataaaaaaaaaacccacctcacttgcatatgtgtgtgtgtgtgtgtgtgtgtgtgtatgtgaagtgagtgtgcatgtatgtgtgggcacatacagctacacatgctgttggaagcccacagagggttagggcgtcctctgtcactctctgcctggttcctttgaggcagggtgtcttgtgagaactgaagtttgtggttttcagctaggtgggcagctgacaagccccagcttctgcctcccctcctttagctcaagagttccatgcatgtgagaccacggctggttttcacatgggtgctgggatctgaactctggcccatgcctgcacagcaagcattcttaacagacgagccttttctccagctcaatagctaattattgctgctgtcacatgtgcatatatatatattttaccttttttctatgcatgttctacacacacaaacacacacacacatacacacagaggcaagagagggagacactctcatgcatgcatgctctcgcttacttggtaaacacagttgcaattatgctttacaaatgggtctccggtgtccatgtgacagtgtggagcttcatagagagggacattctgagcaatgcttctctaagccttcggcatctgctctctactcagctcacgtttgctgtgagggaaatgccccttagtcttaggacaatgaaggtatctgattttaaaacaactctgagcctttttctaaattttcttgaccagtgcatagcagtctgagagggaaaaggggagctgataaaaaccctagtaaggggtaaaaattgggaacagaaaagtaaaaaaaaaaaaaaaatcagggaaatgtttaagcaatacaatctctatttcagggaattgagagccaagtgtagattgttaaatgggacattctcagagcttgggagaggtgtgatatatagtatgtaattaagaggcatgggagagtgccattttttatatcccccacttgtcacttgtgcagatttgatttcaaatatgatttcttaggttacaagggtaattaattgtacggactcttccaggagatatcagtcacccatgtcaccctctaaattgacagaccacgggaaggaacacttgggaaacactcactgtagatccactcacttaactggggttagttgtgcacctactatgtgctgagggtttttctgctcacactgagaagtataatggggtggaaggcattgtgggaatctcatgtagtctgttgaggacagaacagacagaagcacaggccaagccatactgagttagacctttggttttaaaccaggacagggcacctgactcgtcttcctcacttgaatggaactcgcctatatgtcttaattttctaaagtagttatatattattttaagctgtgaactcaagttcacttaagaggaataaaaggacaaaaggaaatttcatcagtgaccttacaacattgagtgaggcaccttcatactccagtgcattccctgttgatctcttgggcaacttgtgcggtatcatcaaacacgtgtttgcttagtctttgaatctgctgttaaacctgaacaggagacaggcttttcctgagcacatttagcatttgatgacatagctgctcccaggactccagaatgaagtgtgggaagctttatccagaagttcaaatcctctgtagggtttcttgcttggcaaggtggatggctccatcaggcgggctggctgagggtgccctttcttcttggtcttctgatgagttgtggctataattcctgtgtcccctaagtctttggattcttggtgtttaatgttttgaagtatctgttggttaaagtatcacgaaggccttagttatgcatacctggatctggagcttcctgagtcatttctcacttcttagatgtgtttcctaatacttcccgacactcagttttctaatgaggagtcttactaccccatctcccttcccttccctcccctcccctcccttaccctctccttctgtcccctcctatcctcttctctcctcccctcatttgcttttttttcccctttgaaatactgtatgatcttgctgtattgggacattactgttcccatgctatggtggcaaagtcctcttctctccattgaggtaatgaggtctgatgtgtgattttgaatttttgaatggagaatctttaggacactcagaccagtgatagtctattctttctgaaatgggaggttgaacccatggcagatcatgactgccctcctctctagagaagaacattttatttagccactgctgtggtaattcctccccctccccggacacccccccccccgagttcttcctcttcctggggctgagaaaggttcagcaactggaagacacagtgaggtcaggacaacaggcataattgtgcttttgggggaaggcagagcaaggagggccagctggggctgtagagcacagatgttactggctatgttggtgttgtgtagagagccatctcagagctttggtgttccaggggtgcctcagtggacactggggagggcagtctgctggttatgcctggctggaagatgctgctccttagctccaggcagttgtggccatgaaacagtttggaataggtcttgtcagaattttctgtgttcaaaagaatgtatgagttcagcattctggttggaaatctcattatctgaaatattggttaagtcttaaaattattcttttgtatagacgcaatgaaacctaagtgtaggctacttgttagttagggatcatctcatctgcagattttaggagtctgcattcctttccacagctcagggatgttcacatgacctttctccagacccttcacaattctcttggtacttaaatgagtccagctgtcatgagagtccaagagagtacaaccttagatgtgtcatgtggcaagtcaggtcaactgtgattcatattctctctctctctcactctctctctctctctctctctctctctctctctctctctcatacacacacacacacacacacacacacacacacacacacacacaaaaatacaatggtaatgttgggtcatgattcactagtgacagtggtaagctcctactgtgactatgagtgcttcctgagactgctagtgctcttcacgtgggctcatttaatcctcaagacccagtgactaccaagacaggcaattacctccactttatggaagctctgtaaggttctgtagtagcccaaggacacacggctgacagggacagagccagattttgtcatctgagtcttccacttcacacaaagtgactcttcatgagtccgtggaggggttatttctccctaccctaggctttcacacatgcctcctcggactgggtcttgatcatagtaggtcccctataattaccattcttggtaatcatgctgttgggttggcttttctccagtgggtcgatttagcccagtgcaagcagtttttcctagcagataatgagactctgtaaacccacattttcatgacagagtttattttggtgaaatacaaaactaatgcaaatatttactaatttttcctttattaaaccataatacacaggggcatatttttagagatgataaatcatttccttcacaaagggatcttgtggagaaagaaatgctgcacatttaaaaattatatactattctataattgtacaaatcaaacacgtgtattatttgtaattacactggtaatatatgtaattacatgagaaaacaattacagcaaactgcattccaagagaacatgaatcaagattttttcctctcttctcttggttattttgcagcattaatttgtttcacagaagtaagaatattgcacagaccttaaaaaaaatttctgacctaccttgggcactttaaagatgtctcaagcagactgtactgatgtcttccaatcttggaggagaccataaaacctatcttctttcttcacttattcttttgcctgccaaaaacaaaatgcagtggccagtaccttttgctctgtggatgctctaccaatgctgtaattgtgcctgcagagtggttttgttgtgggtaactttagaaaaaaaaagctgataatactttttatggcttctgtaaaaataaccaacatggtttggagaataatgcttatgacccactgggtagtaatacaagtctgaccgtccttccttctttccttcttcccctccttctttgaagaattgttacatttatttattcatttatttatgtatctatttattgtaggtgtgtgtgtgtgtgtgtgtgtgtgtgtgtgtgtgtgtgtgtatgttttgggacatacagatgtcatagtatatatgtggaagtcagatgacagcttgaggaagtttttttctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcctcctcctcttccttttcctctttcttctcctcttcttcatcttcttttcttttgtttgcttttttactgagacatgatctcactatgtattccgtgatagccttgaactcatgatccttctgcctcatcctctatatgtgaatttaccaccatcatcagtcaaaggacacgtgtcctcttaaagaactaagggattaagtggaacgggatagtaagggccacaacagcagataggacagcagaggtttttgggaaaggcagtgctggccccacagaagctatagcagaaggcggggactggtcaccatggactcttgccactcattctagtactgcctagagctccatccgagagtcactgtgttccaaggatgctttggctgacatcggtgtggtggaccagctagaaggcaacactctttggctccatctggctgttgctgtgaagcatcttgagcctggtactgccactggttctcactgtcaagagtctatgtagatccacctttaacgtgggctctggattttcagttacagggaatgtgagtcagagacttcaggagaagattatcattgattccttcatttatcagccatgtgtagagtaactggtgtttgcatctgttgccatgctgggccttggggttactgagatgataaaatatggtggtcaggagattcacaaacaaaggggctgaggaacttatgactagaaacatgggaatccagatgaccttggagggtgagggtgaatttagaagatataggtagagatgatcaaggtggaatgggtgatgggttggtgagaacacattccatgccagatgaaagatgtgccaggtcagagatgtatgggtaaatgagatgtcttttaggatatgtgtgctcagtggtgcaggtgtgtgtgtgtgtgtgtgtgtgtgtgtgtgtgtgtgtgtacagttgaacacggaggcagatcctcccctcctagcctgtggtgaaacatattagtgatctgatattttagatggtgtttgggaatcgagcatacctactagaactaccaaagacagccctttgctgcaagacattttttttctttttcatgtcttgtatgtgtgatatgcaagtatgtatatgttcatatgtgtattcctacatgtgtgtatatggcagaagcttgaggatgacattggaagtattccttgaacacgtttcacatattcactgaggcagagtttgtcagttgaacctagaatttgctgctttggctaacctctcctgtctctgccttctgagtgctggaaatagaggccaactgccacatacacacacacacacacacacacacacacacacacacacacacttgacatgcccatggaatctggggacctgaaattaggttcttacttggcaagttctttacccattgagctattgtgccaggccctctatgaaatgatttgtagatgtaacctctccttattgacatggagttgctcctggtgtctactgtgctaggaagtatctagctggacaaagtgtatatgtgtttgtggctgaagatgagaatgtcggtcctgtgttatcactgtgtcttacagcaggtggaaggagtatctcttttaggcctcttggaggtcacttcacaaactaaggaaggtaatggatttgtccttggaggcatccttagtggacaactggcatctctgggcttctgtaggtccatgacacagagagaggctctaggaacgcacagagaaacgtgttgcagagctaccttgttctgccgctgagtcaacttcctcttttttattacattctcccatcttgactaaaaatgttagcacacatatggctgcagagtgtggtgattggaatataaatatcacctactttcttcttgtgtttagcagacattcatgagtgtcaggctctgtgcacaagtttacatctctgatgaagaagccactggcctctgtttctctccactggcctggggtggggagagggaggagagagtttgagggatttctcacagggggatatgtagaaaggagatgatggtaacaatgatgctgaacatagggataaggctcgaacacacttctggtttaaaaaacccaccaatccctgtgctacaaaacccaccagtccctgagctaaaaaactcaacagttcctgagtttaaaaacccaccagttactgagctgaaaaacaacaacaacaaccacaaccacaaccactaccaccaccacaacaacaacaacccaccaatccctgaatcagcccaagctcaggacttgaaattccacctggaattttctactttgggaaactccacctcaaagaaacccttagaagtctgtctccagctcagttctttgctgcttctcaccctagcggaggcagccaccctcttgtgtctttctagataaatctcttatgtgaggtttgttgtgcaaagtaacaacaatgtaatgtaaaaagagtgatactctttttttcctgtttatagtgggggaaactgaggtatggcgaggttttggatcagtagaagcagcagaattgagaccaagagcaagtaccaaacacctatatgtggaagtcaggagacaatgcagtcagtttgatcagaggtcagtcaccaggaaggatttctttctgttggtcaggtgatgtcctttgcatcttggaagaggagtaccatgaagggagtgcctagaggcagagggtgtgtgtcagagcagtttgcttctacattaaatcctttcatcttgggggcaacttcttaagatattaaaggttggtgaaatagcaagtgttcaaatttgacttggagatgtcaaatatagcagggaatctgcttgagattggaagtaaacaactcaaaagtagctccaggaagtccctgaaaccgaccagattcactaagaccctccttccccaagagtatacaatgaagaatgaaagttactctcaaataagcccctcagcctcttagaagcagaaaccactaggacagcccagaagaaacaacaccaactgaggttcccagaagagggtttgagcaatcgagccctctgaaaaggacactctctaacttgctgagctgcctgcaggctgtgcagtgtgctccaggtttcccgcatccgtgagtggtcacccatgctagtcagggctttggtgattcagctgtctttgagtcatttctgcttctataaaccctcacccacattcctacaaatagtctgaaaaacctcattgcttcaccaagtctggcttcagtggtgtccatacttagatctgttgtaggttccatttctggggtgagtagataaatgtgttttgtctccccaggaaaagtctgtcataaacagtatgttaggtgggggtcctagagtgagtacagttgaccatgggtggaacatggacttgcagtcatcaatgtactgggtaaaaggtgaggggcagtgaccccaggagtcacagaggcttgtctggaccacgccaggaaggtcttaggttgaggctcagactgctctgttgtccttttagatggatgactcgggatggcagggactgctatcttcctgatcatcaaaagcatctctgaagttcttttagaatccacatgaagtggtccctggaggtttctgggaaccctatgctacttaggattgtattgcagaaagagtgcaacacctcaaaagcaaacagaagatctggaaagggggtcatacagatgaggatctctgaagagtctgctccatcaatagcatgcaaatccccactggatgatctttccctccccattgtatgtgtgtgtgcatgtgcgtgtgtgtatctaggtctatgtatctatatgtgtgtttttgtgtgtgtatctctctctgtgtgtatgtttgtgtgtttgtcttatgtgtctatgtttctgtggtatgtgtttgtgtgtctctgtgcacgtgtgtgtatgtctctctgtgtgagtttgtgtgtgtgtgtctgtgtttgtatttttgtgtgtgtctgtgtgtgtttctgttagtgtgtttgtgagtgtgtgtttttgtatgtgtatctgtatgtgtgcctctgtgtgtgtttgcgtgtgtgtatctctctgtgtgtacctgtgaaggaccaaagttgatgcccagaataacttgcaaccgactgctcttctaccttactctctgaggtaaagtctcttagtcaaacccagggctcatctataagactggcatatatatatatatttgctctatatggcaacccttgagccacatatttatcttcccagcctgagctttttcattgaaatcacaattgttatttacctcttctggtaaactatgatctattggtatttttgattaaaaaaaaagtgtcttaaccagtattgagaaatatttatatttccatgacatccacccatgtttgccaggaggggaggttggtaatcacaaccttttcccatgttgcctcttggaagtgtctgattgtgttttggacaggagactatcatcagtgtctacaaatgtcttttctggccatcccgtttttcactgtataagatttggcaatggttgatattctggatgtaactcccaggatgttcctgccttgctaaatttcagtttgtatgtctttcatcaaatatttggcttagctgggtctgcttggcatattgtgttagctcaaagtgagttattgtctcagtaccatccattcaatacagagaggtaatatttagtgtgtcagaggggattaagttgtaatctcaagaaaaatataggaagttgagtagagaagaaattccaaggagaagaaccaagtagttattaaaatagacttttctaatatatgttcattcactgcaagttacatccttagattcctttctcatcaaagcgtctcaaagagctaatttccagtagtttctatcccttcttgcagctgaatatttggggtattttaaagtgatatcatcaaatagatcaaaaatgaagtcctataaatgatccttaatcaacaggctccgtcacttcatggcacagaaaacagggaacaaaggacgatgattttaattcaaggaaagagagatatttattttaagtatttctgtggaatgacagaagtaatttattcagttataattaggcacattgtgaagtggacgattgcagagacagtgattcttgccggctctgggatatcagaggaggctctctgccctgcgtgctgtgctctgcagcctgccaggaattatctgagagttggggtagaagcagaggcaagtggacactgggattgtgtgcatttctatttggacagtgaaagtaggatttccttcttgacaaactctggatgcaagtgtttaaacagggaagttgcttgggtatgagatggaagtgacttggctcaacagtatggaatggaaacaactttaaggagcccagtaaagaggaaatgatctatgtatccatagtgaagtgtagcggcttaagtgggccatgccattttggggtgcattcacagacatttagcgaacccatcagtagaaaatcttattcccccctcccccaacaagtgtctgttgaaggcttcttacgggtcagatcttgggagagactgatgagccctgtaagtgcctttccttgatgattagggactttgcaaggaggcagataagtggattggataatcacaaaacagcaagggaagccacgagtcggggagtgtaatatctaagtgctgaggctaagaggtgaaggtcaagctgcagagacatggggaccctaggacaacctgtagctgcttctctaggccagcaggagccactggtgagttttagtctgtgatgggctgtgagctgctttgcttcttgacagcatcatcttcacttctgtgcctctgaagtagatggggaggggaagatagtggctggggcctggttaggatgcatccatgagagatgtgatagagggttatggcatttggaagaggaagggctgagtatctggacctcataatatattgaggatgcaccagagacagtggggtatgtgagtgttctagggagacagaatcaaagacgatgcctggctgtgaatgagtcagattcattcagtggtatagggcatttaactgtatggagtcgggatgtagagtcaagtttataggcattcaaatttaagtgactatgaaatgctgcagtaggggtgcccaagagatgattagaatacaaagcatgggattgaatctggcagcagatagatacctgtgtagtgggaagagcctaggggttggcccaacactggactgcttgaactatagaagggatgccctatcctggattatttgtgcacgtgccaatagcagactcagagcccagaactgttagtgggtagctccttccttggcattgggtggttgggcctttacatgggtatgaattcctgaccatggtggggaagtgtgttatgacacagattcaagcagcaacccatgtgaatgtttccaggagtagaagaagttaatggatttggtggtattggagctagggaccttttagatagatacatccacctagtccatcagctcagccactcagagtgtggtatttgatggtggttccagtatcggggactctctggttagtttgttgcctgtctgctgacttatgtgaccgataactcctcaagacagcttggattttgaaatgccccccagaagctcatgtgttgatcaccagttgttggtactactttagggtaggctgggcttcaggaagtaaatctgagtaaaagtgaggtcttgggctggggttgtgtgttattttgtccctggtcacatcctatcttccttttttttttgggctgctatgaatcgaactggtctgctctatatgttcccattgccataatgtcccaacctctcagcaggcccaaatcagcaaatccagttcaccaagactaactgtgaactccgagcctgagtccacctgtaccttgcgttgcttttgtcctgtattttgggcacagtgatgctaaaactaagtaataagggtcccagagctatcttggccactctgctcattcttgggatcataggtccttttctatctgcgtctccatccttcttgatatgtggacaaaggaccctcttttgtctccccttatatcagatggctggatagtgttggagaactcccctgttcccacctctaggcctgagcaccttggcgacagcacctggggaggaccttgcttcatttgtgcttgaggctagctcaaacatctgccctgttgtctatctactgttcccatcgcccgtgtagctcactacctctgtctccgtgcttgactctgggtatgtgtacctattactttccattcttaattctctatgtcttcgtctccttgcagatttggctctgtacccttttcctggattgcaccataaatgtggggacatcctagtctgtgctgagccctgtaaattccctcagcccatcatgggacatagggctctggtccccaagacacactttcctatcagtgtttataggaacctccctacttgtcaacctcaaagccaggccctctaccaccactgtcccttgcagacagatttctccaattgtctcagccttcattcctctctcctatgccagagtagctcccacttccgttcctctgtggccatcttctgacagcccctattttcttgtcactgacttagtcatccctcatctagttcccttgatgccatctactgtgtagtctcttttatttcccagagaactccttcatctggtatcaggatacaggaaacctaagtggtgcccttgtgttttgtggaggggaagatagaaggcgctacgggaacctttgaaagcagcaagcatctagtcctgccctgggaggctcacccagatctccaggcctgagcaaaagtcctctccaccctgccctcaaggaagttggacttagctactcctttaactttttacatggcccacatctagcacatttccaaggtagggttccccgtatctgtgtttccatctgacactcttcctctgactcctagaacaagacagttgttgccgtcagtatctgagtcagcgtgtctcagatcccctgcctctactctccagaatgaccccttgcttacagaatgaccccttgcttaccttgctctgtaagtgttgctgtttccacctgtgtaaaactctgtcccatctgctcagtgctcacatgttgaacctggcacttggcaggtcttgctaagtttttgttgaatgactaagtgaatgcatgaatgtgcaagtgttagattttagtcaagtgccgagttagcagccctgtgagccctttaggaggcaaatagagagccagagctgagctttagaggcagtgagctggtgaatttacattaggtcaatttgctgaagactcatgaaaatgggaaggaagggaggagagggagagggagagggagaaggagagggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagagaagagaagagaagagaagagaagaaacaggtacccctgctgttatgcagatcttcagaagagtcactgggattgttgaaagctagtcagaatgggaaggagggagactcctgaatatgccaagctcagctcatcctcagctcattgggacttctgatggggcaaagaggagggcaggatctcccggaagatgctcctgatggaaaaccaggtaggctttgagtattgttcctggtggatgctcttggggaggttataatagcagctgtggccataccttgaagccccatggtcaggcattacagttggcacccccctccccccacaagtgcttctatagccaattatctggagttgagaccataagttaccagggacatacttgtggcagggatgccaattatttaatgtaggtgggtagactggcactgtttctgccatatggttgctgttcaacaaactgcagctacaagttgagtaacttacctcaaatataatatgtggttcaatgggagagggctgtttgttttatagacggcaggcagtgtgactctttccacctagatggggggtgggtcacatctacacatgctcggcttttatcaggcagaggtgttttcttagtggagacacccgtggggagtcaattttctttgactcggtacattcagtgtgagaccaggcctgaaccaattgtgaagagagcttggaggacacacagttgatgaccagagggcgctccagtgctccgtgtccccacctgtactttccctatgtgctggctcatagcctttgccttcttttgcagcctctgtgtgtgcacatctgtcatttttatttgaacatctgagtccttttagaactccaggcctggttcactactgcaaggtcttctcatgcaacaacaccaggcacttgaatgcgcctggggctcaggcacacagtcatttccttcaaatcttcttagtgggttttgcatcgctcctgacaatctcataggcacgtgagagggaggggccatgcagagtacccgacctgcttctttggaaatcttgcgaccgagtcttgagtgttctaaatggatgccattttgtcaccttgaagaaagtccttgagatgccttctacccccagagcaagggcatctgcatacaactcaataggttatgacaccggaagcctctctccccgttgttgctttgtgtgaatcctgtttcaagacattgccccgggtgcttgcaagctgttctgtgtttcttgcaatatttgtgcagcctgatgaatttataagttgtcagtatggcaaatcatgaaaatggccattcattcctccttgtcccttgtctgctccacgatacagcttttctgatccctccatcgagaggcagaggctctttgtctacttttgaatctgggcttcgatttctgtgacttgttttggccaaagagacagtgccaagtggttcacaagagtccttgggcatgggccttcctctcttgtttcttgggttcttggagtctctgctgctgcttctgtgtggaaacgtggatcagcctgttgccaaccacacatgtagggcacacctagcggttcacatttccgtacccggtaagtaagcatctagaccagagcaatccattaccgatgcacagttgaggctggcagagatcagcaggaaaatggttcagctgagcctcgctcaagggatgagctacagagtcataaacagatacttggtggttatatgaagttttgaggcagttttgttacatagcaaagattaactgattcagtggatccccaaatctagtgagcgcgtgtgtatgtgtgtgaatctcaaagagattaaaaaagtagactacaaatatatttgctacagaacttcttttagaaaaactaaaaaaaaaactttctcaaggtcagtctaaaattcattctgtagcccaggctagcttggaactcttgatcccccaaactttgcctcccaagtgctgggattaaagacatatacagctttgagttaactattcattggggactggatgctgtcatcaagtttatcatcttggcatttcccctccacttttcctgaacacacatggcttcttgactgtggatttccaagttccctggattctctggtctaagtgtgaatctgaatatgtgtacataccagacactgggttagtcgtacccaagaattcatgatccaagaagtgaggaatttaagtgtagcgctatccttagcacagctctgctggttgggagtaattgactgaaaactataaactgctcagattcagcattgtaaaagataatttcacacacagtggctctaggagggtatcaaggctcaaaaaagtaaactggattaaaaaactcttgtgaccagggaaccctgaaagcagtgttaataagcacacgtatggctgacataagggatggcagacttgggacaagcagactgagtgaagtgggctgagtaccaggccagctgtaacatgcaatccaggagacccaccccactgtattgatagtctgaaagtcacttcacactcccatccctccacacacactttagattaaaaaaaaaagtttctttctttttgaaaccatgtcccactttgttgctagattcggctaagctagccttgagattgtggttgccttgtctcagcttcccgagtgcacagattataggtgtgttccatcatggccaacaagattggcttaagtattgtgcatttacaaatagttatagaaattctatctgatacatgatgtgtgtgtgtgtgtgtgtgtgtgtgtgtgtgtggtatgtggtggtgtatgtgtatgatgtgtgtgtgggtgagtgtgacatgcatgtacatgtgggtgcacttacagggcatgtctgtagtgagatgcttgttgaatgtttatcatccttgcaaagactggatacagcataaaggcatgcaagatgcaatattgtgaaagatctttatctatggaacaatacctaacatctattaattgggtacagaaccttgcccagtgaattatcagttgcctagcaaaaggacagatacatttatgggtatacacacttccatgtgtaagacactgactgacacgagagaagcactttcatcatcactgaaagcatgggggcggggaggctgttgtcagggctaggaggatgctcattgtatcctcctatatttttctatctctatttcctgactatctttataaaaggtatcgacatgcttggttatattaagatctttcaagctcagtagcatcctcccacagtggctgttgtcctgttgccggttttaaactctcagaaaaagagccccaaatcctacatagcagaggattgagacctcccaggagctcttcagtggcttcttggtctcatatgaccattttctgaggccacattgggtgtttgcacttgaaagaggaagaaagagcccttcactcacatggaaagttcaatgtctgtcttgcgtgcataccccagccctggtgccctcttgacactgtccagtccttagactggtgtgaacacagcatgcactgtacccaagtgggcaagctcttcatctttagggcattcccaccaaatgtgggcttggggatgctgagcaggttaatggggtgtgaggcttggctggtgctttcctagctacttcagcacatagagatcctcagggcttttaatacccaggggtaatcaaataaacctagaaactgaggagtgcgaagaaggaggcagcatgtgcaagttagctgggaaagccccgtggtcccacataagccaaaccaggccaaataaggattgaaaaccattgagtggagagaatgagatgagagaaaggggttgagagagagagagagagagagagagagataccgtgggaaccaggactaccaacaaatccagctatcacagtgcccagctgagtcctttcgtggtctgcttgacaaagcaaggcttctggtttgtactagcgcatgtgcttattagagtacacgatttattttcgtgtaaattgtcattttagtgagatacgcagggtgattttgttaccacgccacagcagaaagtccttctcaaggcggaagaggagggaacttggctgggtatcagatgcagatcctgtgttttatgaacgatcaagtttgtgtccagagagggtgaatgtgtagccttccccaggccatgcagggaagagcttaggggctaagtgtaggatgttcaggtgcctgctgcccacctccgcttttgctggtttgtacagtcatggctctgtgaccgtcagcaagtctctcattagtgaatccgtagactatgatatcacagccagcgccaagctgtggctttgaggtggcgtgagctgtggttggctacagacgatgcatacagcggggctgggcaaactcagagggagaatgttggtgactcggtcaggtggagcaggtgctggtgcccccggaggcaggtggtagaggcctcttcgaggctcatgggctgtcactgcagatgacaacaatggcttgtttatggaggattaagacctcaagtacccttgggataaagatgcatgttggggattcgtggtgtcagaggctctactggaccttggacttgtgcattgtacaaagaaccacatcacactctatagagtctaacttcagctcaccgcagacaatcctgtactcagacctctagttccatgattgggttcaagaaacccccagaactgttgatgccttgagtttcttgacaaaagatcatgaactctgagaaattaaaggactccatgtcatccaggtagtgacagacctggaaaaggccctttggctttcaggctttcaaggcctcttttatcccctctcacccgtgtgtgggcttcagggttctcttgcattctcagttaacattccaggtgtgggcttcagggttctcttgcattcttagttaacattccaggtctgcttctggaggctgtagcagtgtgcatgggtggtacatgtgtgtgtttggcggccaaggaaactccaggtgcttgccagtgaggaactgcaaagcagcacaggggacggaggtcaagaggatgactggacccacccaggagtccttcagacctcttgggaactagctacctatgagccaggctcagctggtagcccatggtctgtcagatctcctgagctacatgtttatttgtactttttggcaggagccagctaactaactcctctgtaaacagatgatagggaatcttttagacttgcagcttgtgtctgttgcagtttctcttctaggctgctgtcgctgaaaccagccacacgtggtacaggaatgaatgagtgtggctgtgttccaataaaactttatttgtaaagtagatagaagccacctctgtgtctgagaaaggaaactgggttcttaggggtcaggagagagcttagttctgacactgcatcagacactgcatctctaaggagtggtcaggagagggtttggggcaacgttttaagtgaggtggatagatagggcaacagaagtaggaagcctcagctgagagccaaccttggttccagaatctgatgccagctatcatgccagcccagagagggatctgggcagaaccatttgaaatgacatcagaatatagtgtagtctgctgaggacctagatagcccagcacaaacatctctaaataaacctagagcctttgaacgaggagcagaaagtctgcagctagggggaggtcaggagcagctatggatgctgatgatgcccgacaagctgtccttcacacaggcagattctgaaggtccaatcctggtaatgaatcagctctgttaataggaccgtgagaccaagcaacgatagctaagtcaaagcagataatgtgggattcctctctctctctctctgtcttgctgtctgtttttctctctttctctgtggtatatatgcatagcatgttcggggtgggtgggtatgtattaactcaccggatggaaggtactgtacgggaacggtgtccgaggctgttggatactgcagggcgtctgatagctttaggaagaacatgtgttctgggcaggccaggattaagaaagggaaggcagtgtaagcacacatccagcaactatctattgagcaactactctgcaccaggctttcttctcggtgctaggatcctggatggaaggcacctgatttgtatttgtgggtctctgcggaaaagaggttctgacatctcgagaggatgaagatggaaaggaagcttaaattcaaaccaggtattttatggggagccataacatcaggaattctggcttcctcttaattacttgtgcctaagccaggtcgcagctgtttaggtgaaccagagtgacaaacaactagacagcaactagtttctatttggttccgaggagaaagcaacacccagcttttagaatgttcagggcaggacccagcttgtcagcagtgtttcccacttggctagcggtgtaagcacccagacaattcttctttaagactttaaccagtttaagcatttcttcagcagagaaattgccttctttcctttgaaggctttctgaaatttattctgtgtgactttgccttttgaaacaaaaggggagagtaaatgaaattcagatgcctcaaggtcagagtcaggaccccccctccccagccccctcgtccccacgcaggcactcacacctacacgtgtgtgcacactgtcataacgtttccttaggggctgtctgatatcgttgcccttgttctcagtggcctgtgattattgtgccttttgagatcttgtattggctttgaatagtctttgtgtttcctcccttgccagcagcatgcctctctgtggcaatccccccctttctttattagtttttattttatttgtttgtttacattaagtgtgtcatagtcatagacaatgatctgagaaccacagcctaaggagcccattacctacagttccaccacacagagacacttaatgtgagtatttggattcatagcttctctgagtatctctctgagacttttttttctatcaaaatggggtcatggtgtacacattgtatgctctgttcattttcccacgtaatatcctaagcatctgttaaaaatgtgcttctatatagttcctttatgcgtgtgcatatgttcccacaaaaccctttttccagaagtgtcgaaacatatattaaagcatagagaattgaataatgtcagtgaactacattatactcagcttcaacaagtgccaatattagcccaccccagctgcctcttattaccccattgtgtgttctgcagcatttaaaaaccaaaaatcccaggtgtatcatcaccttgctcacaaacagttcagcaaacatttctctcacagtggcttttgatcaggggcaagctccatactactctccaccgaagggtcgttggccacgtctggggacattctgcttctcactgctgggagaggaaggtgctgatggctgttgctggcatctagcactacagagcgggggacgaatcctgcaatgcaaggcctggttgtttacttttagccaagaattgtctcaccccaagtgtcactaacccatgtgttaagaaaccctgaatgtaatgggattaggacctccaaaggcataaacagtcctgctgtcacaggaaacaaaacagacagttccttatcaccaagatttctttaacatctcaattattttattttcttactgtccttttaattggcataattttacatagttatacagggtgacaatttaatccatgtatgcaatgcacaaagatcaaatcatagtaattaacctctcacctcgttatttctttgtgtttggagtcttctctcttctagttctatataaaaacacaatagtttgttataatctatatccactgtgttgccttctaggaacctagaacttagtcctcatgcctaattgtgtcatgctgtctgttagattcctattcttctttcctgtcttcttctagtctgtggtaacactcttctttttgaataatcatttaaaaatagccatattgagtcattacccaagacattccttcaacttttttttttaatctgccaagatctcctccccacctcttctttctttcttttcttttcttttcttttcttttttttttttttttttcaagacagggtttctctgtataaccttggctctcctggaactcactctgtagaccaggctggcctcgaactcagaaatccacctgcctctgcctccctcccctttcttgctgggattaaaggcgtgcatcaccaccgcccagcctcccccccctttcttgataacgtttatttgttaaagatgcctcagccacttgctgtgtagttttcccatactggatttggctgaaaacatcttcctggtgtcattctgtctctgtctctctgtcctctacttcctgtagatccaaaggtcagaccaagtgggtatgcagtcaggtcagaagttggcagtcttagttacttgttataagtaccccggggacctcatgtctgtgtccaggttagtcgggtacaaagggaccatctcaccatcatctgataatgtgtaagaagtgctaattcttgtgctccaacacgtggattatggtggctggcgccgatggccgcagctccttctagtttcttctggagatattactgaatggcgagtttccatttcctccatcgagtctgctttttttttttgggagctgtaacttttgtatgaagaagaattttccttctgtcttaagccctggctggctctgaaatacaatctttgtggggaagacaggataaatgtttgatttattctccctattattttttcgttttttattgaggcatagtttacacaggataaaatgcacaaatcttaacttacagctcaatgaattttacatgtgtctacacccatgcatcctccacccaggccaggatgtaaaacacttccagaaccattcctcccacctctgtctggttgatacccagtcccctgcccctcctcacagtataccgtggtatttaaatggtatttatgctgtctctttctctaccacttatttctaatgtaaccaaaatagtcatttattttattcatggtttctgaacttgattttatattaagaattgcattatcctctctaagaggataacatacattctcacatttatacatgcatatggatctataacatacatatcttaaatctctgctccaagtagtctaaatgattatctaattatcgtaacatcatttattgtttttctctatactcctttctgatttgaaatgactttcaatctctattagatttttgtataaacttgtgtctaggcctgagttattcttctgttgaattccttatttctttttcctgtactgcggtgatacaaggtgatataatatgttttattattggcaggacaagccatcccaaatccttaaagtaattgtattttcccacttggacactcactgttcttgctgagttcattcttcgggtgactttcgagtcctgttgttctgcctcatcaatcgggattttggatagggatttacctccactgtgttacggaatcgaatatcacagagcatccgagaacaacctattcagtggatccaggaattccattttggttttctagcaaattccctggtgatgagaatgttcttgaaagatttattttgaaatgttttcatttgtattcttctggaagcatctcgatcacctttctttacattattatataattataaaatgaattacaagattacacaaattaatctttgttttctttttacttcaactcttactaaaacgtcttacttttttaacgtttacctttcagtttattattttgagattttcaagtatctagaaatgtcattttatggtatcttctccaatacagtgaatttacaatgttcttacctggttgcattagctagaaccctgagtaacagggtagtattgacgtgtgctctgttgctcctctatgtactaggcttttctgaaaagtgtctccatggaatagtatgatgttttgtggcgtgtgtgtgtgtgttttcattaaattcaattttaatttatccatttttttttaacctgtgtgaagaagctaagtatgactaaaagctttttggctattgagtgggttaaacataaaatgctttctttttaatgtattaatatggtatttatttaaattaggtccttttcttggggttatccttactaagatatgactatggtttttaaaagggcttttatagattgtgtttgctaagttcttgattaagacttgtttgcactcaaaaattatattgattaaattgttttttagatttatttgtgtgcacgtgtgcatatatgtaacacttggctcaggatgcttatgtagatcagaggtagcttcagggagtttgttctccctttctaccatgtgggtctcagggattgaagtcaggctctcgagattcgcagcaagtaccgttacctgctggcccatttcagcctcccattggattgatttgcagcttttctccattaaagagaaaaggctgctttcggtaccatatttttgttgttccttagaaattataagttttaaaaaaatgtctttgcctcatctcctttgctaagtttctgcactaaatcataaaagccctggctctcccagttcttgtaagcatggcagacagggtttggcaggcggcttcttttggctcctgttttcagaggcgcacaccccagggtcttttaatgccgcttccctttccattttacagcacgagaaaaatcagtcctgtgtttgattttcatctttacacttcaggatacaatctgtacagagcccgtgcatgtagaaagaaagggagtatgttgtccctgtgtgtgatggggaatatccccttggttctgtccctgtgtgtgatggggaatgtccccttggttctgtccctgtgtgtgatggggaatgtccccttggttctgtccctgtgtgtgatggggaatgtccccttggttctgtccctgtgtgtgatggggaatgtccccttggttctgtccctgtgtgtgatggggaatgtccccttggttctgtggctcttactaagatccataggtttggctattaggcagttagcattgtatttttgatttgatatgatgtgctctgttctggggtggggtatggggagaaagtgacagcatcattattgctttttctgctgtgtctgtcgggttttctgcaattaatcctttttgtttctaatcaacctcacctttacgaacacatgtgattgttgtctaagtctttgatgattgtgctgtaggagcacgaagggactaaaaatctttttttttttctgcttacacccaaaaggactattaatgccagcgtagatcccacagctggctgtccttgtcccacgtgtatgtctttctctcacagaccagcttagtacttttgtacactcctttctccctggtttatatcttttgtctccttactggatttttattttattttctatcctttttttctttttaaaattatttttatttattcttccgtcatacattacacggcaactgcagtttccgctcccgctgttcctcacagcctccccattctcttctaccccagatctgctcttcctgtttccctccagtaaagagcagggcttcctgggatatcaactgaacctggataacactaggcacaaagcctcacattccttttcatctcctatttcctctgtcatgtctccatctctgtgctctcttgctactgcagtacaaaatccccagcaaagggctattgggtatgagtagggttagcgtgtgtggagaagagaagctgggctgcagcagacagctttttgggagcaaggaaatgacgggaagttgctggcaaagaaatgcctgcctagtagagcaagtgctgatggagttggaagattgattagggcagaagtcagctctctccacggagtaggcaaatcagagcaagctggatccaaaagctagcagggctcctataccatgtgttgggtgtggcctggatatcagactctgtgccctagtgactgggatctgcattacagggcatactatggacaggaagtcacagaacgtacccctgataagggatcagagttatgcatccttcctcatgtagtgaacgttggagtttctcgaaagtgctggagaagccatcttttgtctccagactccaggttctttcccatcactggtgctaggacttaagagcccaagagattcagtctctcaattaggtttagagttaggtaggagtgagcaaaatccccaggaatgtcaaagaagacccttattgaggtagctttgtgtggaacagacatataaaatcatagctaaacacacgtacacagacacacatagacatttatggacatgtgtgcaggaacatagtctacattagtcaaacacctatgaacttaaggtggtggtgaaagggaacttaccttgctaaatgtgtggttcagaaagaaacggggaccactgaccttggcttacaacttgaagatctgtgggaagaagaaacaaatgaaactcatctccagtgaggtgaggtctgaattgctctgcaggcttagagctggcagcccgggatctgttgttcagctttctgcaaatgtgctggaggccaccaacactatagcttgtatctgcagtgctcagcaagaatggtagaaaccgaatgcctgatgtagccctcccttccttcaggttagctgactctctgagctgggtttgttttcttatccaggggaagcactgttctgccttctgtcctatatgatcaaatatattttttcttttttgatgtgtttattttagactctcttgggtaacagaacaaaggaagatgtttgtacatataattgaatacatgcatatccatttaactatctttacctatgttaaaatattaaggtagcatgagtataaaccaatgcctccaagtctcatccattactctatggataatttcccccctcccctttcctctagcttcacagatctctctcacttccaaagcaagaaccctgtcccctaggcccttagccattcacttgtctaattattcatttccagtatacagagaatagatggtagcttttaaactcttaacctgtgccaccatggaaagatccaatatttttgaggtcccataattgctctgctaggacagatagaacgagtactttgaggataccaagcttgttaagagcaacaaacgttctgatttctcaccaggaggtgaacctttttcaggactcaacaagtatactctgagatggaatagacaagcaactgatacaggaaaagacagtgtaggtcagtcaacaattggccattctttcatcttatcttattaaaacgtctttgccccctttttatacttccttttcactgcctgtaatgtttaatcgcagacattcttgttggcctagcagagggcctcaggctgtcctcatctgcctctgacttgttgacctgatggagacattagtgatagagaatttccctgtccattccacatctttgatctgactggcctgtctctccagtggccatgcttggaaataaagtatgattctggctgcagttgtcgctctcagcttgggaagattctgaaaaactcagactaatccaaagcagctgtcagcgtaaaagagcttagagtacccagatttgcatctgcctggatggtgaaggcatggcaagactgggtcgggccaggcagtagctatatgaacctttctttggaatccccaacttgaaaaggacataatcatgatccttagtctagcacttcaacctctctttgggactaatatggccaaaagaagttacttctgccccaagccgtgccttggagtcatggtctgggctcttcagctgataatcacagctatagcaaaagagctagctcctttgctatgatagtgaccatgtccaaacataacatggggaggaaagggcttgtatttccctcattgaggaagccagggaaggaactcgggcaggaacctggaggcaggagctaaggaagaaagctgcttactggcttgcttcccatggctttgtgtagcctgcttttgtatacaactctgagccaccttcccaagggtagcaccaccagcagggtcctattgatgaagaacatgtccccacagacttgcttccaagtcagtctgatggaagtgttttcttaactgaggttccctctttccagataatctgtcttgtgtcaaactgacaaaaaaaaaaaaaaatgagccagcacagatgcccatcagcatggaaaggtgtaacaaagatgtgagctcttaaagtatcatttaactaactcataatatttataatatcaatttctataaatttaaaataactgtaaatcgttaaagaatttgcgttacttgaatgatgaagcatgaacttttttacacaatgatgccactctctctggtcatctacaacccttgatcagttcagcggatcaataagatggagcatctcgtagcagaaatggaagtagtgagacaggtgtggccacacctctcagtgataccccctggtcacaagaagcttgcatagaaccctctcttggagcctggtttctagaatcatcctaatacctgctcagaacaacccaaacaggaaagtctacgttggttctacatggccaattctttcaagactattctttctattctttcttgccattggcatggagaatggagagatatctaaggagtgaaattattcatggttgcaagctgattctgtctcctttgcatcacttctcatctctacaggagaaaattgcaatcaggagagattaatcagcaatcattgccaagatacaccactgctctaatgttcctgttacgttaacaagagccagagaagcctgaaggtccagctttcctcaagagctccttggctaccatcctccttagttttatgtcaacttgacacaagttagagtcatcagagaggagggagcctcagttgagagaatgcctccatacaccaggctgtaagcaagcctgtagggcatttgcttaattagtgattgaagtgggagggtccagcttgttgtgagtgggactgaccctaggctctggtttctgggtcctataaggaagcaggctgagcaaatcatgggatgcaagctagtaacaggctctatatcagctcctgcttccgggttcctgccctgcttgagttcttgccctcattgaatttgatgataaattgtttcacggaactgttcttggaaaaaaaaaaaaaaaaccaaccaaagaaaaccctcttttctccccaagttgcttttggtcatggtacgtcatcacatcagtaggcaccctgactgtcagtcactgtgcctctgtcacaatggcctgtggacagtgagctggaacatttccttaactaatgattgatgtgggaagctccaactcaatgtggtggtcacacctgggcagatgaacctggactgtataagaaagcatgctgagcaagccctgaagagtaagacagcaagcagctcccttccttgacacctgcgtcagttccatcagtgatgaacagtgacaggaaaatgtaagccaaatagacccttgtcgcttttggtcatgctgctcattacaacaatgtaaggcaactgagcacggcatctttcctggaatgtgactgtccataaagatggcggaatgcagtgaggtccttttcttttgcatgtgaactcttactacattgatgatcgtgaggaaggatgtggagatcctgtgtgtgctcatttccactacagccaagcttctcttcttcgtccattacctttctctgtagctgtgaccctggttacccaagagagcaacttaaggcagggaaggcttaccttggctcactgtttcacaagggtctgctaatcctcactgaacaagagtaaaaaccaaatgctttggtcaaattatgcaagctttatttccggtcacatggggccatctccctgaagcagggcttgagaaaaaggcattgaacatagaaaagagtaggacttctatagcctccaatctgcaaggctaggggtttccaagggatttagattacataggaacttggcggaataacttattagggtggagatcagggtatatagcgtgcggaacatgtcaaattccagaaaataggccacaacatggtcaaatcttaagttttatagaaaatgggaatgaatttattttgacatcataacataatggcttgtaatcttcagatggagtagctcgtccaccagttcagtctgggtctttggggccagtgcacagcttggctttggttgggtgtggcagaggaactgctatacctctcaaaggataggacacatggatgagaacacataaggaacctgggcaaggtatagcccccagagtcacgcccacagtgaggtcttgctccatctaggtccctcatcttgcctttcgacacctccaaacaatgttgtcctattatatatctatcgaggggttaatctgatccttagcgcagagcccctcatgatgtaagcatctcagaagaacccctttgcagacacccctggaggtgtgcttatttcttttctttctttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcccgtgtgggcccttgcgggtgttgggcaagactctgctggcaaggtagcccggggctcgagtcggtgtgcttatttcttaacccaatcaagttagtagccaaattacccatcacaccttgcttcagactaggtcagattctgtcagattctcaactgccttcctttcagctccctggaacacacaatgtagaggttcacagttcttggttatttaattccatttttgacaaacctccccaatgcctttcactttttaaatcaattaccgattcagaatgcctccctaacctatttcattaaaccaccatcttttgatggcctcctctttcaacaacataatttgcctttaataattaatatagaagaattcaaaatgtaatcactgagctcacttgaaggctctttaatcaattaaggacaggtggctttgggacagaggtcttcctcagagcttcacaatccctttgcaacttacttggttctaatagaggccatatttagaatgcatctttgtagaatggcccaggcctgagaagacaaagactggatttcaaatgaacaaggatacacacaattgcttgaaggttcttttacatgaaaataatgccaacatttatggcacagagattaaaatggaaatttttctcaaactaagtccctgtctgagcacggcaaatgaagatgctggtattcagctggctgcccctttcctcttagaattgtcttctgagtcgggggttgggggagcttattaacaaggcttcttggcctgtagtcagtgagagataaggtccaaggtgccccattcacctgcccactccgtgtgggtgacggacacagtgtgaaatttggcaccagaaagatctgagttcaagtcttaaatataacttgatttctacccccaacccttgtgtgtgtgtgtgtgtgtgtgtgtgtgtccatgcactcatgggtgtgtttatgtatgcagatgtggaggccagaaatctactttgagagtcattccttggaatctatccaacctttcttgtatttgagacagagcctctctctgggacctactatttgctgactaggctggctggccagcaagccccggggatttctctattttggtcttctgggttctgggatttcaagttcagttctctgtactcagctttttcatgggtattggggattgaactcgagtcttcaaacattcagagcaagcattttctcagctcggctatttctccagccctgagcctttagttctttatttataaaatcagggtactcatttgctcataatccactttctcttatgacaggacagggtcttggtagctagttggcagacaatgactatgtaggtgattgttatgcacacatggtggagtacctcttggagttggatcatggtgtttgcttcatttctaggtgatttatcgttggaattatgttttgtgcgagtgctcattaagtctagtctgaatacgggctgactgatgaacaagctgggggttagatgcgtggccagggggaacctgcccaggattcatctctggcctctggtatttctcaaaagagacaaagccagtgtggcggtgttgccagcttgttgtgtgtgcagaatctaatttatagctgaccagggtctctagagaatcacacatgtttatatcattaccaaatggtaattgattacaaagctccgttgtaaaatttacaattattgaattactccatgttctctcataaatttcaaatctttatttctaaaagtcaattgatattcagcccaataaatatttaatttagatgtaataatggcgttagagccaaattaaattctcatttagaacataagaatgacctggagagagccagggaggggaggcgtggcagggcagggcaggagatggttctcacagtgtccattccccttgatgggaagagacgtctcacatggacttctctaactccgttttcttctgaaatttctgttcgtgggaaataagagtcttctctggaaataagagtcctctctgttttttgtggggctttgtatttcattctctgaactgttcaatagtcatggctcttcaaggccttatgaaaaattacagcacactgttttctccttgctttatcgatagatgggggaactgaggttcagagagctgaagtgactcacaagaggcgatgttacaagagaggaaggctagcctttgtctactggctggtctatcagtaggctcacagggtctgttaatagccacagagtaggtggggttatgatcctctacatacaggaagcctcaatataacagttctaaacaagatgggcatggctccctcttcttataaaatttgtcaaaagggagggactccacctgcccccatagggttacaaagttgaaagagtcccagcctcctttcaggtttcttgtctattatttagagtttgtggctctgaactttatggtctgaggcaggtgcttgagtttcaagcattgcatgtgcagtggggagggcgaaagaagccatagagaaggccaccttcctcctccttcaatgtttatttattctgtgtttgcatatgtgcatattccacggtatgcatgtggcggtcagagggcaacccgtaggaattggttctcctaccatgtgggttccgggaatcgaactcaggtcatcaggcttaacagcaagcacctttaccagctgggccctgtatcacccctcttttaggaagatttccattttgtatctctgtatgtcttattgcttagaacataattatgtgtgcatatatcaaactgtaagatccaccaagctgtcttaatctgagaaatagggtctggttaaaaactggaatttttatctttcaggaaaagaaaaatagattcgagagtactgctctctgggttctcaccagcagaggtgccacagggtccccccacccccagccttgcagccttgcagctctctaagatgcagtggtctatgccagcacagaggccaagtgaaaatgggagttgacagcctgtttggtgtctgccagacattgggccaggcaatccctttgcatacagagagaagcaaggcatgttgctctctttcagacagcggcacttaaagtgtagcccttggactagcatcagggacatcgtcacctgggaccttatgagaaatgtaaattctctggctccttctcagcgtcttggatcaggcacttcttttttttttttttttttttttttttgggtatcattttcttgacagggtttctctgtgtaaccctggctaacctggacctcactctgtagaccaggctggcctcaaactcagcacccagcccaagaactgtgttttaataaaaatcccatggtagattctgaagccggtagaagttgcaaattctaatctatggctcttacaataaacgagaagtagtacaaggtttagagcccccgcccccaacttatgtctaaattctgattctctcagttagtagctttgctgggttggtcaagttattcaggttatctgacacctcagtgcagtgtcttcatgttatgaggttgacatgagctgacaggatacttagcacgtagtgctcagtgaatgacgattccattatccttataagcctcaccgtgggtgacatcgccatcaggaaagatcaagggaaataatatccccatatcagtattgtggtggtttgaatgagaacggctcccacaggctcccttatttgaaggcttggtcatcgcggagtggcactacttgagagggattagaaggagtggccttgttggaataagtgtgtcagtgggaataggcttccgggtttcaaaagcccaagctagtccccatgtgtgtgtgtgtctccgcttcgtgcagatccagatgtagaactctcagctatttctccagcacctcgtctgcctgcatgccaccgtgctccctactgtgatgaaaaaggtctaaacctctgaaactatgagcaagcctcagttaaagtgcttccttttgtaacagtagctgtgttcatggtgtcttctcacaacaagaaagcacagctaagacaagcatgcaacagaaatccaaagatatttttaagtgtgtgtgtgtgtgtgtgtgtgtgtgtgtgtgtgtgtgtgtgtgattgtgcatgcacacgctgcaggagatcagagtaccctatgtgttgtgttggtcctggccttctaccttcttgaagacaggttgtttgttgctgtgtacctcatgatagctggcccgtgggattcttctgtctctactgtccatctccttagacaagctagggtgacagatgtacattctataatgcgttctgaattttcagggtccccactcttgtctccataggtaggtgtgtgctttacctactgagccatctcctcagccaccaagaagaaatttatattttgcttcaaaatctctactgtttttttaattcttcctgtgagttcttcctgtcttgctagagataatcaagaactgcctttaaaatgtaaagtgttttaagaatcttaaaaaagcatttaccagagaggacattcagatggatactgtgcatatgcaaatgcgccgaatctcattagtcaccaagaagcagaaattaaagctacaaaaaaattatcccgtgcatccaccagattcattaaatgataagggtaggatgccaaatgttggggcagacatggggcagctgaaattccataagctgcgactgcaagcataaacttagcaagcctaataagctaaatccatgcatcttttatgaagagccacctcttgctttgatgtataggtaagctgaggtggtcaagctccgtttctcatcgccacctgcgtgatgctcgcagcattatttgtaagactgaagcccagaaaccactcagaagttccctgtaggatagttaatttgtgatttactcatgcaaaagacactctccagccaagataatgaatggctcagtataacgaaatgggcttttcttagtcaacttggacgtgagaaggcaggcacaggggacaagatggtatatggtcccacaaatgcatatttcagacacaagcaaaacagtcttcagtgtggaagtcaggatgctcattaccttggggttgggtattgaatgaatatccctacggtgatactgacaatattctattttttttttttgattgggttggagatgatcatagtgtgtttctgaaaatttagtaagcgttttatgtttttatacttttgtgtatgtatgttgatacacatcaatacactatttcagcacaaaagcttacttgaaatatcgatgcaataacatctaaaatgtttatagaaaaatggaaaagcgtgattgagggaagtcagagaattggcaggagctgggagaacatgtcagtcatttacacggatgctgtgactccccgttgctgagcggctgagtaagacaaggatcacatatacagaacaacacacacacacacacacacacacacacacacacacacacacacacacacccctcttttccattacagaagtaaaatgcaacgttcagggcaaccattccttaacatctagtcctggatggaaatgagagggagggaggtacccacgtgtcagttctggaagccaacgtaggcaaaccctttagacaattgggtttgtgattttcattattttctcattaggtcactacgcatctctgatggctgttgagggcacagctactagtcttagctgagggatgaggagggtattaagccagggggagttttctaatgttggttacccttctcaacacggtcttgctggggatgtaagcctggctctcctggtgcctggttttccgatatcgctatttagtctgtggagcatttttgaacttggaagaaacactccactgttccatgtcggatactgggaaaactgtgcaggactcggtggatatcctgtaaatggcatcaccataggatccgtaagagtagaggcaaaggtttttttgtttgtttgcttttgtttttttgttttgttttgttttgtttgttttttcctagtaaaaagccactgaaaagtccgacaatggaaccaggaaccaggagattccttttcattcttcagggcttataaaacaggacagaattcaccatcaccctagttcttggggggatttctcagaacattcagagagcattgctttagctttctaaagggttgtaggggtggcctgtagtcaaggaagataaacagatacttccttggttctagaagatggactgttacttgtatgatactattttgtgagtaaattataaaggacctaggatagaatagtgggagagagagagtagaaaataatttgttaaaaggttgcttttaatgagttagtcagattggaaaagtcaaagatgtatattgaatgatctgggaaacatccaaattgcttgtcatccccaggtcatggggacttcagtttatacacttaatatacctggtaatcagggccccactttcattactatgttgagcccagggttatcaaaaacataatgagtattttctactctcattgcaaatgtatgaacattattttatttgttttacatgttctcatgcatctatgtatatatgcatgctcttatgtaggcacatatgtgtgtgggtgcatgtccacacatgcacacaggtatttgcagtcctgcagtagacatcgggtgtcttccatggtcactctcccctctgttcgttgaggcaaggtctctctctgcgcccagagcttcaggttctggctagtccaggtaggcagcttgcactggagacctcttgtctctgctccctaagtgctggcatggcaggagggtgcggtgcctgcccagcttttacatgggtaccagggaacttaactcctgtttcttgcctgcatggcaaatgttctatccactgatccatctccctagtgccagaacattacttttgatagttgtatctaaatctgttcaaccttccctttaatattgggtgtttaacctgcttctggtatttcatacgatggaccttaacaaacaccatgctcaaaaatttgaattcgtcactaatgatttccttagacacatctgacattttaagaatgaaagctggcatcctctctctctctctctttctttctttcttcccttctctctctttccttcttttcccnnnnnnnnnnnnnnnnnnnntccctccctccctccctcccttctaaccactgcagcctagcttctgttatgaagcttgaaaatgcctgagtcagaatctacatagactcatttgggatcctggtttcaccgtctaccagctgtgtaatcttggatggatgcctctgctcagaaaacctcagtatccctatcagtaaaatgggaactcaattttccagtccattgacctataaagatggttaactgagaaaccgatgaggaagcatcatttaaacccccctttgcccaagaaggtgtgagacatttccttggatttcttggaggtgtgacaggtagtttggacacactggggatctacctttggaacaacttcaggctttgttctaaagcaaggacagcataggtcaagagaatttcaccttctctgaaagtcaacctgagattttagtttttttcttgagcttattcgagagctttagagaaatgcatattcatccctttagataaaggatcaacaaaatatgacccaggggccagatccactttgcctcctgcttttgtgagttacattttattagaattcagccttgtgccactgttgtgaaagcagcaagctaacaaatacttattttatggccttctccagaaaaaaaagtttgctgactcctgcttcagatcaaccataaaatatttatttctgagatcaccagacataaatgcattacacttccaaaaccactcccctcccccaaccctgtgatagaaggcaggaccaagctgagttggctctgtcatgtgtggatgctacatagtgtcataaaaggaggaaggtgtgactctcagaagagggcactccgtttgattgacatattggtctttccagatcttcttggatacaatctgcaggttgcccttccatgagaacaatgcctgccatcatttaggttgaagcttcaatgagaatgtatttgtcatgagagtgcaagcctcagtttctgatcttgatagtaaaacaaacctagtttcttataattggctttggatcagaatgccttggacttggcttagagaatggtgtattgtagtgttcctttggtgtaggggtagaggtgggggtgaggctgactcttgtcttctctcaacacctttccatatatggaacatatctctttagtctatgtcatcctcatttgaaaatgctgcaaacttacgttttgaagattaattttaagtcgtgtatttgtatgtatgtatgtatgtatgtatgtatgttggtccatggtgtgtgtgtgtggggggggtatgtgcacttgagtgcaggtgctcatggaggccagaagagggcaccagatcctgcagaactggagttacatgggttgtgagcgtccctgtccatgggtactgggaactgaattcatgtcctctgcaaaaacactatgtactcttatcactgagccttctctctagctgccaaaattatgtgttggaaaggaaacttgagcaagattcaaagggatagttctgtcttgatttttggatggcagagaacaggagatagtgggtgacctttgtctccagatagccattagattacatagatccctgctatttatttcctgttgggtcattggtgagaatagtgaataagtagtatgtccaggcatagtgctgtatattagaactaaatcatgagagttaaatttggggggtaaacattgtgtaagcatggacttcaaaagtgtatgcaactggcttaaagtctttcatgatagaataggtttaatggtagatggtagtcatcaattcctgtttcctccctctagccatgtgactctgtatttcattccagaggagatggagcacatctctctacccagtgtgttggcatcatccccattacttacctaagccagcaccatgcctatggaggtatctgtacccaacctaggaagcagcatgtgtttctgctggtatcttgtcctttggttactaccttaaaatgatcagactcacctagttcaccccaaggaggactagggtcaagtgagccagatttgaagcccaagcaaagccttgatggaccactactagaccactggcgtctggatatctttgttcagatttataatgtgttctcgtcactgaggtcgggctagtgttttgtgtgacaagttacacgattcaatatgtattaattcacatggagttcatggttgatgggttttctattttgctttgttttctttttcatttattttatatgtatgggcattttgcctgcacgtatatttgtgcaccacatgcatacgtgatgcctgtggagaccaaatgagggtatctgatcctctagaactggagctacagatggttgtgggccactgtgtggtgccaggaattggaccctggtcctctggaagaacagcaagtgctattgaccatttcttcccatgcaggtaggtctggtactcagctggtgggctttggtgcagtcttctattctgtttttaattttgtgacattgatattagtcttgtttaatgaacattgtccaaggaaagaccatgagtgatttactctcctgatctcattccattccttatctgtgtgctctggtttataatccatcttaacacctagtggcctccatcctaccaggggcatctgagagctaatggctttgtagacattgagattcttgattctacagggtctgctctgcgattaacatgctatgattgtatggggccagctgctagatgtactcaaccagaaatgcaactctttggtagctctatttgaccaggtcaatagttgtgtgtgtggcactaattaggccaaagttgtgagttctgtcccttgacaaggaccaattccagtcatggtttggaattcatttcccaaaggcaaaggtttcagccagcacccagagttggtgttaagtgggaaatggagattaaagtggcctcagaactgctttgagaaccaacctgtggttgccacaactgttgagtgtgctgtgctatgttgagggatgtatagatgatgtcctcaagttctgctcttgaagaagagaaaagcaaggttcagtggttcactcaggcagttgcttataatagagcgatgacagtacttgcccagacagacccacaggtcgtcctgttgtcagcctgggttgcttattcttggattacacaggaaatagaattgggatttggggttaggaagctcttcttatgagagcctattctatgctgtgtgggacacttagcagaatgtatgtcttctctctatactccttttctaggtaagaaggcccagcatgtttctagacattgccaagatgagcttgtgccctgaatgagaactatgattaatggtgtaattggtagtccaatgagaggaacctggtccagagtgggaacctccaaaccacaactcatttggagattggttttaagtgccttggtatcttctgaccttgcttaggctatatacacaaggaagaccttggtcctcaattggaccatgtttggttcttctgattttcttggtagcttgtatatcctgccaccttcttagcttatggagggcagtgatgtggtaactgggtatcccctcctagaccacatcctcaggcactggctccatgagagagcaacttaggagggagttgagggaggggagaagtactccagagaggagaaattcaccatcatgggtgttgattcgtcatcaccacacacctacacacacacacacacacacacacacacacacacacacactgacgtgctgttctgcccaaaacccactcaacagagtgcctggcatatgggtaatgcttaataaatgctggctattattactgttattattaatgctatttataaccacaactcttttttgtaaaataaataaataagtagatttgggaataacactccccaaggcttccgcactattagtattcaacttatttaaatttaatttttgcaaggtcctgtgtttaattttaaaaaacccagtgaattattagtattttaatgactaatgacacttaataaataacactggcaagggctcaaatagggtgccatttaatgtaatgttctacctatgttttctcaagaaagggacagggaaaaacaatgcttacagaaagttgcacaccaggaccaaatgttctctataatttgaatttcttgccttgtgattagtgaggtaaatagccttatcgtgtccctgagtctatgtatcttatagggagaatgctcagctaatattaatttcccttagatcttacagagtgtgtattatgtgctgttgtgttataagagttttagagatattaattcattaatccttgtaagaaccatgtaaggcagcaactagtttatttctagaagaggaaactgaggcatagaaaatgtgtctgcttgaggcgcgtgacgagggaatgcacagcaggtggttttagtacgtggctttataacccattgttcaccttacctcttcaggtgacaggtaggacctggactaggaaatggtttccagccttcctgaggtgctagggaacagcagtgacacacatcaagcaggcgtgtctcacattagatcttggaggcaggaaagagtgtcacaccgagagcaatctaatttgttatattacagaggaagaaccaaaatgcccctgtgtacacagtccatcttccatgaggcttggtcatgtgttcaccgagtctctggtttggagcacaaagcccttgacatgactatgtacatacaagcttttgatgtctgtaaaaatgcaaatcataaaaggtatgcatgtacaatatgatgggatagtttcacactttactgtagtatgtctaacaaaacctctatctataaaacaggggttatcacaggcctggaatttgccaattaaggctaggctggaagacccacgagccccacggatctgcctgtctctgcctcgccagctctgggattgcaaatgtccaccaccctgctgggctcttttatgtcagttttgggaatcagcctgaggtcctaacgcatgtctagtaagcattttacccactaagcatcttcgcagcccagtgcatattctttcttaaataagagtttctgaaatgttgattgttgtttcagttatgaaagggacattcctaccgaggctgtgggaatacttccctggttgccaaactttgctccagcagtaattccatgccttccatcctcgatctgaggctttgtatctatctctcagcataggtgagttttccctcagtgggcataatgttgggacacagttcctcttcctctgcctcctgtacctcaccatccgaggcttgtcagagacagcacgaaaccctgtccaggccatgtcactgaccttgatactattttgggcttttctggtggtgacagctctcaaccctgtcagacagagatggtagatgagccaagtacttaggaaaactgttatcaaattaaaacccaagcaggatccaatgtgagctctgtctataaataacttatgaaaagtgaaaagatgtttctgttagcaaatttaaaataatcgttagaatccttcaacagattgctgctaattagattgagaattaaacagctttgtatgagcgtagagttaattaatagctcattacttttttaataagccaaattcatttggaaacagaagagagacggcaaagttcatcatggatgagacgttagattgggattatttctccttcccttgatgagagaaggagtttaattaaagcaggggacacatttgtatcacgaacgagttgcgtgcgatctctagtacttggggctggagaaatcagcgactctcctcatttaaaaagcctccttgggatctacagggttaatataagttatgctcaacatctgttcagctcttgggttcttcaattcactgatcaagccaaaactttttgaagctgggcagattcattcaaactcgtagacatttattgtagtccatactggttttatttccatcccatttttgtccaggtacactagggtctccctttgaaggctaggctccattttcctgactccctcacttccccaattctatctttctacatagtctcaattctcattatttctttatctggtttcctgacccttcagtgccctttatattacaaaacatggggcagaatggaaataacgaattgaatgcctttaggattttgaagccaagtgcattctgggtatgctataggacactctccattccattctttcagagcatcaaggtgccctgtgtctacagtatgttttcttccatcagttattctcgacacacttcagagattaggtatatgaatttgactttcagggtgtgtgtgtttgttgaagtatagtttccacaatttttttttttttttttttttttgcctattcaactcaatgaaagccatcccttgtttttgagtgaagtagataaatagatgttgcctagctataagccacatggataaacaacacttccaacactgagcctagatttttgctaagtctattgagttcctttgcctgcctattggggacttctcaatggcaataggaaggaattggaaagaaaatgcttttgtctagggacatattaaatatctgtctactgaaaagatgaagtctctcttatatctgaaccatgacatgtacatatggttttcattactgttctgctatttatttatttatttgtttgtttgtttgtttgtttgtttatatatatttattaatgctttgcctgcatgtatgtctgtgtgagaatgtcagattccctggaactggaattacagacagttgtgagctaccatgtgggtacggggaattgaaccgaggacatttggaagaacggccaatgctcttcttctctgagccatggttaccttttgattgaaactgtggttgattgctcagcatgcccatctggtaactataacccatttcaaggactgtatagacgttacagagaagagctgctgggctctgatgcagttttatgctgtggtattgaggcatcccaggactaattagaataccctgtttcttaaaaggtgatccaggctcagagggatcaagggtacaaatctcttctgagaaattttcttttcttccctttccaaatcaggacgtaggctctccagttctctgctcttcactagattattaattcacttttgaaaagagctctattgtttacaccagaacccagatttccaggaaagaatcaaaataagtggacacataagttctctaacaggtctttcctggacactcttcctgccaaaggtaagtgtttagtcctaacttgggagccgagttttaaaattatcaactcgttttattcactttcctgatctcctttcaagagcatcccgttgttcatgggctaaaagtgaaatgttttactctcctgtgtcacatcttgcttttgttcacacccacttgctccgtgctcttctgctacctgatttagccctgctggtgtccctgaaaacttctagaacattccaaatttgttttcagccccagaacctttgtaaatgctgggtcctctgtctataagtgttgtttctctaaatctcatcttcattacaggtcttgttcttaatcgtgactgctgaagtgagttctcctatgcttgcctaacctaaacttgacttttctcttggtctcttatatgaaataattcttatttccctcttatattcccctatatatcttctgtattcccctatatatcccctctattcccctgtatattttctcctatataaattcccctgtaattgtctggttttgtaaaaaggggattgtttgtttgtttgttttttttttttctttttcacttgaacatatatacagtgaaagcagggaccacatctgacctgcccaggtccacatcctcagccccaggtacagtagaaggaaagtaagacctaatgaaaaagtaaacactgactgtagatttcaaagccagcaggaccaaaggccagggatgaactcagagcctacaattgatggctcagggccaaggtgaagtcttgtggtctgagactggtggacaccagtggttgctgacccttaggtgttcttctgacccaatatctagcatatctgggacagtatactttccatctgagtcatttacaggaacactaagtcccacatccatgtagatattgagaggcatccaactgcagtctcttcgtctatagtcttcttcccttaggatgaactctggcccctttcctattttgtctggataggataggttgcatgactacattctgctacttgtttctttctcatggatttattgagtactggagtgaagagatacagctaagaaaggaaaagaggggtgagggtttgggtaagggtgtgctctcgccagtccaagtgtagacatggcaggcagcatttatccttttctgggacgtaggtagattgctactggaggcaacactgggccagtgcattccttattactttaaaatagaggctcagagagaatatggctcttcacatcttttaaaaggcgtttttagatttcaggccctggagactcttttatgattgtccaagggcagagctcagagcagtgatttgaacgccctgaaatactggggctgcagagacatttccttagtttctcctactgtagctccagcaccttccgtgcatgggtctccatgcagttccaggaagactgggggctttgagtttgaaatgttcttgtaaacagagaagggaagcttaggtttagaagccccttatggggacagattcctttcctcctcaatcctggttctcaagtctttgggttcattttgctgcatgactatcttctatggctgtataaggagttatctaagatggagtgactctggagcatgcgtggtggttgcctctcatgattttgtgtgctcatttgactgagtggcacaggtccatctccaggtctgttatgagacagtgtcagggcatattaggactggaggcatctgaaggcctgatgggccggaaggtcaaggtggctgctccctacggcagcagtccatgttagacgtgagcttagtgcttagcggtgacagtcgtccgatggatggaggagcattgaggccacactgctgggcaaggcatacacaggacactcttctgtattctgactctggggaggtggaaggtctgaggctagccaggactacacagtgaggccatggctcagacaaacccacacgagtgatgacaaatcacattgtggaagaccctgtggagaaggagctagtgctgtagccatttttgtggagctcactatatatctggttcccatattctccctgacattattattgatgattctctgtgctgaggatttgtccaccatgaaatcattttaacatttaaaaagtgttacagagtccaatatatcagatcaagatgccactcgtttagactgtggtatgtgcacgcgcacgcgcgcgcacacacaccacacacacacacacacacacagagtcacacccacagtcagacacctgtacacacatattcctttccctccccctcctccctccctcccattccccccttctctctctttctctctctcaaatacacacacacacacacacacgcacacacacagacccacaaacatacacataatctcagacacatgtacagacacattccctctccttcccccactccaggtattcttcaacccctatagccaccatccaggtattgaaattttgaggcccctccttcccttcctgtgtttgggaagtcctcatgtgtacacctggtttaattttggctgctgtagcataattataactgctggatcgatccttttggctgagaacaaagtgcccattaacagggctagctccatgtgcctattgagacgttaaccagagagcactgttaaatggctgccgtttttcatcttttgtgacaacatttattctggcattccctccaccctgtggaagatggtgccttgtattttgttttgttcttttaagtggagcgcgtggagtcttggcttgtattacctctttagttttcaggggagattagtcaagtaagttggtagatgcatgtttttcttccatcccttgctgcctttttctttcagcaaacttttctaaaggtgatgaatagcaggcaagatgaaatgtccaccctctgcagactggctgtctcctgcatgcccccagctgcatagcaatccgaggctcttttctcccttattcaacactgcctggaagtttcgcatactttttttgaaatcttcatttcccttgaacattctttgaagaaatcagcatcctgttgtccacgccctcccccccatttaagtcgaaatagaaatgtttacagtattaagtatacttactattcagtttagatttcattgtcccccatatgttatgttccacactggcagaattctgggtgggaaagcattaaccctttacttggattctgaaattttgcacagcagttggacttggaaagcatgagctgcagaggatcttgggaagctcagcctaaaccctgagttttgcagagaagttcagagaaagaaggtggttttctcagagtagaccagcagtttaacggctgtctgaggccagagcagagactcttggatgtcttggttatactgcttggctggtctggtctagattctcactggcttgcctagacccaattgtccacctctttctccctgtatccttgtgaagggaagagcttagggcaccaaacagtgagtgagtccgtggcccccatgacacaaaagggaaaccctgaaagctgactttaactgaaatcttggtgaaagttccatgccctattatttgatacttatattcccctaccctttgcatcctagatgtgcatcttcggggtcattcatcttgtttgcaggagacagcatctctcattggcctggaacttgctgtgtttggctagagtggctgatcacccagccagccatggggatcatccccctgtctctatctccccagggctggaagtatatgtgtgtgccaccatgtctgctctggcttcttctgtgggttctgtgggttctggggactgaggtcggtccctcctgcttgtatggcaagcatcttgcccactgagccatctcagagctcagcccctttgtgttttgtaagggctacaacacggagtacttgttttacgcagggacctctgaggaaaggcagaggaaagaatggagtcaagtcaagactgagcggttgagttggcacagatgttgatcttctggaggggtacagggaccagataaaggaaaagctaaaagcattgagtctcgtctgtagagagcagtgtgtcaactcagcatgtctcagattccatgctggtttgtgagaactgagatggaggcacgcgcgcacgcgtgtgcacacacacacacacacacacacacacacacacacacacacacacacacacggggtgttactgatcagcacatttgaggcaggctggaaatcttcatttctagcatgctctactacagccttgttctccaccctccttttgggcagcctagccaacactggtcactctgctgagtgtgtgggaggccagctgcaccacccttcccatgcctcatttttcttcttggtaagagagcctaggaaagtcgcaccccattggatattttgacctcataatggtcaggtacttgcggacaatatcccacgtgagacaccattgaagaatgacttgaggtaggatgtaattaagtccttagcaaccactgcatccctcattgggcatctgcgggagtgcttatctgttcagtactcacagaagccctgcaaggtagatactgttatgttacccacgtttgcaagcgagggaaataacttggtgagtcatggagctgggattagatacagtctgtctgtctgttgtgacatgacgcaactattttagaagtctgcagagtcaaaatgtctccagcatcagtgacatgggtgataatgggtcttgtgtactgagcacctattctttgcctcaggccacgttaaatattttacatttcacccatattaatgtcctgaggtgaaggtgaaggtagatgtttttgtttgtcacgaactataggagctcaagagttccgttcgctgtctgatgtcatgctcagtaagtggcaatgctgggctatgaacctgagtgggatcagctcaaagcctgtgctccaggctgctctgttacattggctggctggttcacacatctcccaacactgtcacctgacatttcaggtagtattcttgtggttggtgtcactggagacttgggaaacaatggcattttgtgaggagcagagatggatttgatatgaacatggtgcataactctactgactgtaagtatcatttgggcttatctcaaaggctctaggaaacttctgaaaaatctgtcccttacttttgcagggtaaccacacctattaaaatcaatggatcaatgaactaagaaattatctaattagttaattgattagttagaatgtgttgtgtgtatgttggtggcatgagtgtgcccaggcagaagataacttataagaagtagctctcttcttctaccacgtgtgttctgcagatcaaacccaggttgttaggattggcagcaagtaccttcacccctgagccatccctctacctccagcagtgaatagttttgatataagatttgcaccatccaggaactttctcgagagcacagatccctgctgtctgtacagtcttgggttttcctttgtccaaggctgctttctggctccgttgggtgtctaagaatatgggaggtagtgtggcagtgggcttagaggaggacgactatgggctaggctccaccctttgtagagctcatgggtcacattaccattgtggaccacctgctggggaggtgtaggacctgccagcatttgcaggaggacatgaggacttgtgggactagtggttgtctaggctgtcttgggtaggtggtgataagggcttgcctagcccaaagagctggtgttcatttctgtctttgctttcactcagtcctgatggagagctcttcctcctgtcttacttcccagtggtcacggcctgcttttatcttccttctgcttctatatcattttcttgttttcctctgtgttttagttctctgtccccataaccctcagcacaccacaggagaagcatttaggtggggatagtttactcttggggatcccaagcgaggaaaggcctgtggggaatcagggttagtgagtgggcttctaaaaggagcagcattctcctgggaagcttgagacagactgtcaaactcagcccgtaattgcccatcaagggacaaggcagctggggtaaccacccctaaagtcatttctagtctcttctgtcctcatagcaacaggatgctgtcataccaagtaatggaggtcaggagctttctgcaggcgctggcctctaaggagatacgaggggacaaggtggcccctgtgtgctggctatggtgctcagccccctctcctatgacacatctgtctggatgttgacatgagaaagcgttttgttagatttatgaaaaacataccacatttcttagtcccagtgtggaaattaggtcagctgaatattttatttccccaaattaattacacacatttaaaaaattgtctggagtctcataagtgtgtgtgtgtgtgtccttcaatgaaatgctgattttccaagtttgagaacagtaaatgcctaatctttaaaaaaatatttgtttttattttatgtgtatgactatgagtatgaatgttttgctttccacatatgtctggccaccacgtacatgcagaacatgctaaggccagaagaggggtcagatgctctggaactggagtcagacatgactgcgagctaccatgtgggtgctaggaattgagcctgggtcctctggagagcagtcagtgctcttagccactgagccttctctgcagccacgatagaggtataatctgaaacacttagtctataacttgctttttttttgttctggaggtttgcccctaatggccatgagaggaactgatggtccagggtaacttcaccttgcatcagcttgtgtttttttccttgttggatagatccatactgtcttgaacctctgggatgattctacaagattcacatgagatcctaagtctgctctggtagcagtctcttccctcctggggtcaaacaagcaacaaaaactaaaggagttgggattctttagtgacacagtttgtcctgagactttcgtggtgggtggtatgcattgtgatttcctggtggcacagctgcctgggagtcaacttcactcccaataatctcactgggttatcaggctgtacttgggcagatttttttttcctgttgctgtcttctctatctggggtgaataaactactcattacatcttgtcagaagtctcatagcacgttggcatccaaattgagtaatcaggcaaagaattgcaaatctttccctatgtcctctgcccctcctaaagtctatttttgtatggaccacataggtcaggaactcaaggtttagcctgtcttggaacttttctgacaaagtatttgacaataacctaattttgtgggtttcttttttggggtgggagggtggggtttatcacctgcctgggctgaataatttaccacattatcctatttttgacattagagctatacattagaatttccattttacagttcagggagactggggttagaaagtcagtgcagctttgcctcctggagtacagtgaagcgtggagcttcagtctgaagctcccccagagcctccagggccaagggctcagctctaatgcactgccatgtaccctgcactgaagctgaccgccattaggaggtgcccactggcttccatcgggaagtgatctctgcacatttcccctggaactgattcccagaaaaccccaggcagcccacttttcaccccactgttggtgagaaactggggtttagagaatcggagcgctcttatcttgcgtgtcgttcagaggtgatggatagctgactgaattatttgctttgcctgggaatttcagggcaaagcaccttaactaatgcaaatctcatcccaatacatatgaatgcacgtgaatacacacactatcacagtcatatgcatgtgccactttcctgtttagctccccactctgtttctttgtggctgtctggacaggccctattagtgtttttatgtcatctgtccttgtctggtgaggtgtccatcacttcattagctctggcaaggccaggtctggggataagatccctgctggtcctggattttagcacagagtctgctatgaaagagatattctaaggctgggatacaaggatgagactggaagagtatatgggtgcatttccaggcatgggggagacttcagattctatttcacggttcatagttttgaaggaacttaagctcaccccatagtaattgctcttttaatttgcagataaacctgggagttgcctgtgtttattgtagcttttacattgacccagtgcagtgagtttccattctaactgcattgggaaaactgaaggcagtgtccttgcacgtagatacttgtagatcttccttctgaggtcaaagcaaccaatacacattgcgtcccgactgtcgccggctacctgcgatgtctgtgagagcatccaaggcaaatacatcatagcgcatgacctttaggtacctgagggcaagcagaaaagaagcctcatacaggagtagggccctaggaggacgaatgaactactgaggatagcatcttccatgccaacggttgccgagggggatgtgcaggtgggtggagagctgtgtgcgatgtgcctgcggggatggcttcaatgggtgtgagtaatcagggagatttttagaaagaagtagaggcccgtgtgtgctggagacagttgggatttgggacatgctaatatcaatgtgaagattgggcggtagcgttaggatattttctgagttacctgtggatgtcctgggcagacaggactgtctgtgtgaagcaatatacctacccaccttcttacaggacctgagcctggagcaaggaaggggtccttgagagcatcagacgagtgggctagtgtgtattggggcgctcaacctatctccctgcttgatatgtgtgctttataaaactccaacccacactccttccactgaaacacacagctcatcattactgacttgctatcatttcggggtgttgtgtcattcaaagatgctggtcctgaaatgatttcatgaacaacaagattccacacaaggcagggagtcattgttctttttctccggaccctgtccctctactcacgaaacaaaaccttgtcactattatgatggagaaatgtctagatgtgtgagtgaccaaggaaaggcaagcaactgccacactgccttcttgcaggacagacatggcacacatggcttgtggcaatgctgggaccttttgcctggctttgtaaatcctgtctgtgtctccctgtgttgagcactgtgagtgagctacactgtagggctgagtatccctgagtggcagcttgagtggacatgatcagtttacatgtcagacaggtcactgggttaggcaaggctcccccagcatgagactcttgtgggttctgtgagtcacagatgcagttcctggaggtctaatgtactgtttaaccagcaggcagggtgcagacttaaaacatgggctccggagacagtctctgggctctgaggacattctaggattatgtgtttatgcttacatggatagtttggtttggtttgtcttacaacttagagtcaaattctagtgttatccagtctgtcctttgtccctgtgagggaaagcaccatctggtgtgtgagatatgtcaccccttttgtgacttctttgaaggttcttctctgtctcatttggggaaatgagagctcaaaataaccaagtcatctttttaaagagtgggctgatgaccgagggagagctatttaccgtatgcttgttattctgcaaactgctaaaaacaaaacaaaacaaaaacaaacaaacaaaaaacacttggtatactcaaagtgaccctgtaggtgtagttgccttcttgtatatgtagggaaactgaggcagagggtgaggtaacacagccaacggcgtttagccacagccagcgctgtgggacagcttgctctgtatcctgtgcttttagcctctttactgtgcttcgtgtctaaggctttgagtacacaggttcttaagtgcaggctaaagacctggcgtagataactataagtctgtggcaaggtcacgcattgcaatatgcccttgggcctcttgggactggtgtggctcactcagagaggtcggctgctagccctggccttgctggagtgatggagagaataagctccctcacctggagcctgcagccatgtggcctgtggcatctgtggaagcctgggttcactttgcacagccgggtaccatactgcatttgggtgtctgtgcttatgggcaccgactgattttcttggaagaagagacgttgagggctatcagaaccacacagaagacatttaggggtcacacagaggacctggttttggttgtaggggccacaccctcttgctcttcctccttaggtgtctcctacacaatcagtgtggggaaagaatcttcgtgtcccttcggggactcagagtctcagaatcaggatcacatttgctgtcagaaaggacctggctgcccgggcttgattccttcacgagctgtatgaccttggccggttactccatctctctatgccctgatttctacagtaagccagaagccacaaggaattgccacaggacttgaaggagcaaacaatgtctggcagagaacaaatacgtgtgttaactctaattaacaatttgcccattactttcctgcaccatcatcattgtcttaattgttaccatggttaccagtttggtggcacttataggtcaggtccacatggtgactcaatttgactgaacttgtgttttgagtgaagaaagaggcagaaaaggttaggtgaccagccagaggatgcatagcccctaagtgacaacatctggtgtctatctggtccagtggtggtctgactttctgctgcctgcccttgctgctgtccaaggtaccacctccaggcacctagtctaagccatgttcaacaagtggttgcccaggctcttgtgctgttgaaacacacatttacgatgggaggtggcgcccaccagaagcttaaataaactggtttctcctggcgtagatttacagttgcagatgcctcccacggctcagggctttgactttttaatttaatcttccccagattcaccaagggccttcattctggcagtttcctgcctgtgtgccaggctccagggagctagaccaactcaaaccagtgcatttgtgttgtctggaaggggagcctatggcctctagcctcctgcctgccttcctacagaagggctctgatgaactggcccactcctcagtaccctggatggcagcctctccagccagctcctgagattgcctggcacatttggaaggccgtgttgatattctgggcaggcctgccaggcctctgccattatgtgtgggcaaagctgtaagtaggagcaggggagaggacggccctgtgtctctctgtggaaagttcctgagaggaagggacaactcctcccaaggatgactctagggtttccaggattgcaatggagccccccttccataatgtctaactgagaaaggactttgcagacctcggtcagggccggagcataaagcagagaaggcaggggtgaggatatagctctgtcagtgaaatgcttgctgtgtaagcatggggacctgaggttgatatccagaatccagatgggagaagtgaacaaaccaaactgaaattgtggtgtgtacttgtgactctagtacggagaccctgtctcaaaatgttagatggagagtgactggggaagatatccagtgtggtcatttctcctttagactatgcacttagacacacatgcatgcattctcaccccagcacacacacacacataaacacacacacacacacacacacacacacacacacacacacacacacacacaccatggcttccttgtggcaggaggagctttggatggagattatctgtagaatctggtggatttggagcatgagggagggagaggaggaaggagaagggaggaagcaactgtgagaactttaaggtagggactgggagccgtagagcacactgcctcctgtgcatccatcctcctgtctccaatactcagcagtggctcagctgcaggagactgcaagtctggtgtggctcacgatggccaataccgaattctgttccctacatggccaccaaggctagtgagtcagttaagcaccatgctctcgtggtctcagcagtgagaaagagaagcaatcatagtgatttacctctcagtgctggtgggagaaattgctaatggcaggcagcagggtaaaaacacacagtatcattggcctggaaactgcttgatcacaggccagggtacacatggcctgggaaactgggcccggttcttggtgtgaagtgggcccgtcctcccagaacacaagcacacatgtgagcagtatctccaaggtttccaaggggtctgtagggctcatatggctccatctccaaaacaaagggtttgagtggctctgggacgttacatgccttgagtcctctgatcgtagcctctgctgtgtcagaaggccagatatgtgtgctgtgttttccttgactgctatgtcgtgcatggagctcctgattactccccaacactagctcaagcattttcctttagacatctccctaataatgtattcttctatgccaagtgtgtgcttcttcctgccggcctcacagtgggtacccttgtctgtagtcagtcgccagacagtcatttattatggacttggtgtatgtaagatgtaagctagttgctgtaggtgcagctttgacccagatggataatctacttgcagtgcccgtgctaacaggcaaatctgacagtgctttcctaaacaggtgaatacactcaagggataattggtaaagtccgtgttggaaagaggcatgatagtgaggaggaccaaggaacagggacataatctctatgagggtatattgggagagtttccttgaggaagaggcatttaggctgcatcttgaagaatgagaagagatcttgcaaaaaagctccaaggatggcattctaagaagtaggaccagcaagcaaccgtcggtgtgcacaagtgggagggggggctcaggataaaaacccaggggaaagcttactgtgatgggcatggacagagccagggaatggtgcaatgacaccagtttcctggacctcacaggccatggtcaggagttttgttttcatttcctaagtgtgctgggaaacacagaagtgacatggattgactaagctcaccgaggatcactcaggatgctttttggaaaatggagagatgaaggggattggaagagtagttccaggattgacatactgtcctgcctggtgtgtgtgtgtgtgtgtgtgtgtgtgtgtgtgtttgtgcactagtgtgtacacttgtgagtgtgagtacacacctgtggggagtatgaggcttcctgttgagttctaggatatgattttctaacatttcttctccttctttttttttaatgtcgatggatctcatgaaaggagaacaaatttgcaagagacttgagagtagagggtagacactagccagggaatgtgaactttttactgaagatgtgcaagtgaaattaatttctgggtgtttagggccctcttgtcctgatagctgaagatgggcctgcatattttatgagatgggacaggtccaggaattcacagttcataggcaccaagtacaaacagatgggataccatctcccttcttgatatggtcccttacttgacatttgcttcatttgtctctatgtgtggtttgcatgtctgtgtgtatgtgtggaggtcctcagctgatgtctggaatcttccttataagatctctccacctcattcactcaggcagggtttctcacttgtgtcatatagctggtttggtttgcaagcttgtgctcgggaccccatcgctgccctttgtgcactggagttacacgaagctccagcgcctgtctggcatttacctgggtcctggggatacaaactggtccttatgctctcacaccagatactttacctactgatccatcttcctcactctcaatatctaatttttggatgaggcatacatactcattatgcttaagagattaaaatacaaggataagcctcccatttcaattctgttggccaacaacgaatactattagcacagatgcgtgaaactgttactttctccacgtatgttgtgctcataaagtgggcttcaaactttgtaaactggtccctacccacagcaccatcaacgagtaaggaatattcattgtatcagtcaggctgggtttggtaccagttttctggtatcagtgccagaaaatccccagctctgtatggctttagataccaaagggtctatttctcatcactgtcctgtgaattaccacaaactggtgccacaataaggggcctctgtgcttgacaacctatggggacaacacttactgtctgtcgtgttcctgttccttatagcagagggacggtcatgagatcactttcatcatactttattggccaaagggtgtcgcatggtaccattcaaacatgtttggaccagagcgtctgatctcatcatatgctggggcaactgagaggcaaaaaatgttgatgggcagagctaatgatacatcctattcttgttcctcctctatgcagtcagtattatgaattactacatgcaacatagaaaatgcatgtctcagtaggacactgcatactcctttgattgcctgaggcttggtgctgctgtctctgggactctcctgtgtctcagctgtccccagtgatgatctgatagagactgacccctcagattgattttgcctcttgccccctccccagagctcttgtgacccataagggtaaatgtcactccgcatgtcctcatcttgctctgcttcttgggaaacctgagcaaggtgactgagatgtctcaacagtgaggactgtgacagaagtgtctgtgaccagccagatgtgtgtgctccttcctgtctctcggctgccaggggcaaggcatgggttttgagtgaggctagagtctcacctttcatgtagctttgggacttggtttccttgttgtctcaagaaccagatccctcctttgtgagatccagtgtctgccagctgattggcccctggtacccttctgaagtgtcctgataccctgagcccagtcttccgacattttcccaggctccgtctttctgattttctaacatcctgtaacttttctttccttatgctcttttcattttgttttagtatattcccaacaaacgatcagccttaaaaggataggtttttgaacaccttcaggtctttcctttggagatagggtctccttatgtagccacagtcagccttgaatgtgtagttttcctgctttagccccagtgagctgggattacaggcgtgtgtgtcaccatgccccacacgcacacctttagttcttgaggttgtaaaaccatatccatccttgtacttgtgggtgttttgtgtgtgcatagaactccagatatctagagtcaaaacagtttttccttgacatttcaaaatatgtctgcttgtcttctggtagtcagccttgctaattagctcaacacttaaaaagtgtctgctcctttatagtttcattttgtctacacaccgtgactctgactatgcacttgtagtaaatattcctgggagactttagagtgccctccaccactgtgtgtgtgtgtgtgtgtgtgtgtgtgtgtgtatgtacatgtgtgtatgtatgtatatgtgcatgtatgcaacatgcattcttgctggtgttcatgtgtgtcatatgaaggccagaggaagggtataaggtgcattcctctatcctattcctccatattctttcaggacagggtctttcactgaacctgagtcttgctatttctgcaggccggctgaccagtgttcccttagaatccataggtctctaccactcagcagtagtgttacaggtgtgtgcagctctgcctgcattttgtgtgcacactggcgattccaatccaggttctcaggcttatactcttcctcaccaagccggtgccccaatgccaggatgtttctttatggcacttttcacttacccactgtggtgtttcatctagttcatttgatcttctttcttcagttctatgaagcgtacggtccatgttttcataattacccgttatttgatctgttacccatcggctctcagttggcaggtgtttgacttcacgggctggttctccgtatgactcttttcctctaccttttattcacagaatttttttggctttattctgagagcttttcttaatgttttcttctggcttttatatagatttcttttttcccttttgtcttaatttccataaacgtatttcttttcgttcttcgcttaaaaaaaaaccacccagatttctcaacatatattttagagttattaaaaaaaagaaaaacctcaaaaatttctttcttttatggagtcctctggtttgtgcacatgcttctctgtgtgcagggcaacctttggtacttggttcttctcttccacctttacatgggatctagcaatcaaattcagatactgggcattcatgactgttgtgcaggtctgtattttagtgttttgacggttttctggattatttgtgaagtgacaaatattaataattttatttgcttagaaaacaaggatgaatgtctgccatcgttgtaggcgaggtcactgatatactttcctagcctttcatgtctcgcagttccgtgtcatgagcatccaagggaagctgcttcgctcatgggcgttttgcatcgcatgattgtattgttatgccttttatttctattataattttgtggtgccttttgccaaacaccccaagcatcacagatgtaataaattgtagtaataaatgtgtccacagggcactaaaatttccagcaacctatccttgttccgtatgcattgttcttttcgatgtcctcggagacggtaaggaggagtgtctgaaaagcctgtgtgcttctgcattctccctcctgctagagtcacttctatgggcttacttcttctagcattgggttttctcccacaggggttggatgagttcacttaattcatcttaggaaagtagggtgtgtgtgggggaggggggggtggagatgtgcagacagttgattggttttgtgtgtcatgggtaggtcagttgattggcaggttacacttggccattgtgggactggtgttggaagttgtactgtgttaagctgcagagggacatttgtggggggaggggtgatcttccgcactcttaagcctaggaagcatcttgagagattatccagtgtcctttgcagctcgcatgtctcatttcagcccaggaagtggcttttctggccttggagaagtagccctgggaggccagcacttagtcctggtgacctctgtaaaagatggtctgagtggcccccctcctcctcctgccgccacggtagaagcttctctcttctccttccagccctgtcatcccttctctgtgtgctctgggtctatgatccgtgcttcctccacctgctgtctgtgttttacaagctcccagtggtattatgacactgtcttattgtatttacttactgtaatatcagtgggcttggggaggggcagggaggtgaccacatgtcttcagcgggacctcataagtcattcattggaatcatgatttaaaacctctgatttatgttggcgatgcctggtcgcctgatgcttacacctttcttcatttcctcctccctttctccatccctccctccctccctccttccttcccttcctccatccctccctccttccttccctctctccctctcttccttcattccttccttctcttctcattttaatcccttgatcattactttgggtttcatcgccagaagtagaataaagttagatgtaatgataaggagaacaatccgcatctgcaccccagcattggctggctgggggttttgagccgagggcttcgaatccctgagcaattcattgttagctggggatgataatattctttcatcagagggttgggtgcatggattaaaatcaataaagtgaatacacacgcccatgacatttgacattaaatatgctttctgttcataacggctgatattattgttattattcattatgtaagcctcatggcagggaggggttattactgctgttgtatgcacaagaaagacaggtttagaagatttgttgttttctcattgctttttttcccactccccagccactagcaacaagctgagagatggggtcattctagaatcagaagaggtgggtgttttttttgtttttgttttttgtttttgccaagtgcagtggtggtctggatataatctaagacttccagataaactagagcctcagatggtaccatcccctcatacacacaggtgcatgtatgtgtacatgtgtgtatgtgtatgtatacatgtgtatgtgtgtgtatatattacatacctgaagtttaagtcatttggatgccaccatcattaataccaatattgaagctggataatcccaatactgtggtagaataaatgcatctttgaagtatgatttgtttaatatagtcttctgaccgtgagcaacagatactttagaaagcagaactgtgggcattggacttttgtgaggtgggttccagactttattattcagagctgacaaatttgaaaaggaagatgttttatgtatccttctgccctactgacatcagtctctatgtgaagaacaggggaaatgggcctatggatatgcctgtggggtgggttaggcagagtgagtgcctggtttgaacaccctgctcatcagactctattggagtaacccttctgggagtatgtcattaagttaaagagccaaagtaggaatttaacccaacactgtctgctctcagattgtatttctgacttgtgtagaagctgatactcctaacatgttatagaatagccacacagaggagctgagcaaatattcagagagttggcggtgccagagtgaaggtctatgatactggattggaacagtttggatggggggctctctagggtgtgtggtgtggtgagctctcgactgccttgatgcgatgcagaccaagacattgtgtctcatgaagcaaaagcatcccaggcaacactgaacaagaatctgagcagtgctgtgtcctggccgattggatttccaatgcccttctagagcatggcatagacctctaattgctggatcaagaaaagagatgccgtggtcagagcacttttgaaagtctccatccttggaaacccatcgagagccaaattgtaccacagggcacaaaatctttgatgtgtgttttttgagaactttgcccattgaaatattattgaaaagtggcattttccaaattgaccattgaacgtgatgcagctcaggtgagttaagctttgttttgtgtccctactaagacccttctctgtgctggggccagagtcccctgagccatgtactcatgagttagagcttcattcattgcaaagattgatcatctctctaaagatagagatttgtcctgtctttaatagaggaagatatcaggtggctcaaaggacccaacaaaggaacttcacaagtggtgaacgatgacagagtctgatatgagccgaccaggacgcaccaggatgtccaagctctgcattggttaagagagaaaactaatgaagcaatgtggatgactttaaaagaataagaaagtgaaagaagccaactccaaagcatcattatctctgattccatgacgtcatgcaggaagcaaaagtcacagggatggaaattgccagggatgagagggaagaagtggagtccactaatgagagagcattggggaatttgggagagtgctagaaatattctatatctggatagtaatggctatcagttgactacatacctcagtcaagatgcctagaactgcacgcctgtgcagagtggatttgtctgtattcattaaacctgaaatatagcaaatataaaaccagtgacattcatgaatggcgtatctactgtgcccactgctggtggcatttacctcagtttcctactgggagagccattctttctgctaagaacagtaggattagtgagctctaagcttgtggggggtttattgaattattttgtatagatgtgacaactcagagtcatagtccttattcactaatttaaagtgtttccaggcatttctgaatcctcaaaggaagattatgttcagaacggtttaaggttgaatgtgctttattaattttggggtcttttggaaattagtaattcacgcttggtggcatgaataactcgttattactgcaaattattcatcaggccataaaacagagtctcctctagtcaaagattttactttggctccttatgtttaagacatttttgaaataattcagcaaggtacagtctttagcacgaaatagtggctttgatgtacagctaagcacctcttttgtaaaatggaaggggtctagggagggatatgggtttacaactgcaacagattttacagtgcaggatacaggtaatctgggttggggtatgctagcttcttgttttagatgagttgttgggtttggaaacatggctggttgtatttgcatttgaccttgtgtttgcccgaggtatccgttacaactcagtgtctgtcctttatgagaaagatatctaatggtgaccttgaaagactagcagagagggaagtgtttgaagggagcctggggcagtcagagaaggctcttcccttggtctggtctctctgatttttctcagggcctttggataaatcctgacatgaaggtgcttcatccaactgaacaccccaaattccagagcagcctttcctcctagagacctctttcccctctcacatagacaacagaaaacccttccccaaactactacaccctctattgagtatctgtcagctaaggttcccagttgcttgtgccttgtttagtcttagattataaattcaggaggcacaccaaggtactgatgctcagtttcacgttcatgaatatgcctcagtgagagatttccagtatatgtgctgagtagtggttctaacacaaatggggaggaagcctttcccattgccagccaaatggtactaactgaatcctgtatattgttgtgagagccagatgcagggtagagaaaacctggaccagcataggaggcttgtgaagggaggaggttcttgaaccaccttggtggatggtggcaacggctatgcttccagcccccctacctacattgaaagagctctgggagctgtgtacgtcttccctggagcctaattaataacatcagctaccctgtgattccaactggaggctgaagggaaactttacataattgtcactacggggaaatattaaggtggataaaataagctttgtattagctgcaaaataccttatgttatcttgttaagttattaaagttaatttacttctattataaaagtaaacaccagttgcttttctaagaggaaggtacaggaaaggagaaagaaaagattcacataatcctgttacctaggagcagccatatttaccactttgatttccttccaaattttttgctgttttccctccttaagaccacagaatatgtgcatatattccatatacttatctatttctctggtttttaattatagaaataatagctgcattcattaggattaatataatactgagagtgaatgacgtcacatgcattggcagagttgtaaagacactgggaccgtatgcacgcatgcctggtgagtgtgtgccatttatacccactttaaaagaatagtctggcagtttcttggagaagttaaatatcagcgtgccagaggactaggttgtggtacactcggggagctttctgttccaaagcagcacctgcgtccattgcgagtcttgggctttcgtctgctaagaaatggataagccagggtgatatataccgaccacctggcccagtgctgctctgtgcaacagtctggcaagcctcgggactcaccacaagctaagaatttcctgcatatgaaactttcagaaatgtccaaaccgacacaggaagtaaatggtctccgtgctggagtggggaatggaagctgactgcggattgagtatacttcattttaggatgaaggaagtataaagaaattatactgtggtgatggtgtcagctggacaatctcttagcctaataaccactgacttgctcacttagatgatatatcggttataatttgataaagttaccaaaataagtggtcatataagtactagtctttattttctgtttttattatatttcttaaaagtagtaagaggtagtttattctggtggtattttgacttaggttacccaaaattctatgttccagcatggaagcagtttcatgaagttttatagctttacagaacaaagaaagtcacaaaataagggcaagtttaaagttcaccagagaggcagctccagaacaaggtggggacattggggacatcttttctaaggcccaagatgatatctgatggcagtctctgcttttgggttgttggaagctagtggtctgctaagttaatagattcccaaattttaaaaacctattagtcataggatgttagttttgatacagaggtaggcaaggaatggctgttctggagggctagaattggctcaagataggctgattgccctctggacttgcaacatccctatctcttcacagtacagttctagtcagtcagtcagtctctgaagattcaacttattttcagtttataaagagtaatacttatttacatatagacagtttcatacatgtctacgatgcatcttgttcatgtccaccactaactgttcccatgcatctccacaatatgtcccctgcccctcgtcgtgacctctccatttttatatcataaccaatggagtccagtaagttcttcctgctggaatttgactgatcttattggcttgctctcatgcaggtaatcacagagctagtgagttcaagagcgcagtagctgtgttgtgtcgtgtccagaaagcagcatttcccagcatgctgtgattccctgtcccacttctctgattcacaggctttcatgccttcttccaaggcattaccagggccatgggggtgctgatactgatgtcccatgtaggcctgagcatccagccatcacttattcttagtactttgggcagttgtaggtctctgcatttactattttccaagatagaaagaaacttgtatggccagagttgatggcactgctgatgcatgtgaataaacataaaaggcactttgtctattttgcaaaataacagtggtggggtctctcctctccagggctatgtgagtcaggggctttggccagggttacagtagcaggcacgaactcactcctatggagaaacagtattctgaatccaaaataaacactaccaaacaacaacaataacagcaaacctgataatgcataataagggaaactcttgttcttatcatggtgttaaacaagggatgatgtgctggcaacttctgttcagggtcctggagatgtcagggtgggacttaatttctagccagtgagaatgtgtaagctcaagtctatgcacagaatcacagcccaggaaaagtatctgtgtattgtgtcttagtattggggttccataactatgaacagtcttttaccattaagtgagaaaacaagttttagttttgtgccaaagttaggggtaaccacgacaatggtaattcataacttaaaatatttccaaaatgcaacatgaaaaaaataaaattttttctctactcagtaagagaaggaaaacaaaaagaaaattgcataataagtagggaacataaaataagacaaatcaaatctatgagatcagtgattacaggatgagagggttaatctcactgattaagacacaggttcttttagactggcttaccaaaagatccagccaatcttctcattgattttctgagaggcacatacatgcaggagtagagcaaggctgaaaataaagggctaaaagtggcattctaggaaaataactacaataatacaagtctagcaatttcaatatcagacggaggtcaagttgaggcaaagaaagaaagcagtgctttattctggaaatgctccaattgcgtggtgttccgagaagatataatagtcatgagaaaatacaaccaatacagtgcaaactacatagagacacaattgcaagaattacagtaataaatagacaatctatcattttaggtagagatttcaatatatcccccttggaaacctatcacgcagacaaagaagaacaaaaagtcttggataaactggcaagatgttgctgggtaagaacccttgcctccacatctaatgacttcagtttgatctcagggactcacatggtagaaggagatagccaactctctctgacctctacatgttcactatgccatgcaccccacccctcatagaaaataaataaattgatattaaagaagcattcagtaatgtggtcaacagttttatacacagctagttaaatggaaaaaattaaaaagaagaatgtgagtctagaaagtctctgatttctaaaaattgatcccattcagactatagtcttgaactcaaatgaaaggagaactattagtcaggcatagtgaggatcttctggaattctagcccttaagaggcagaggaaggagaatcaggagttcaaggtcattgtgctggtttgtcagcttaacacaagctagaaagagaaacctcaactgagaaaatgttttcatcagattggcccatgggcaagtctattggagctgttcttgactaatggttgatgtggaagagcccagcccagagtgggcagatcttctgggaggtataagaaagcaggctgaagaaggcaagaggagcaagccagtaggtaacattccactatggcctctgctccagttcctgcctccagttccagctttgagttccagtcctggcttcctttcatgtaatccataagatgaaataaatcattttctttccaagaaaacagatttcagaagcattctcttattagtttgttaagaagtaagaacagtcatggtttctcacactatatagagagatgcttttggattaagtaataaaattagtatatagaagttttatggatctaaaggaaagggctaactgtctcatttgtacatggtataatttaagggaaagaattatcaggacaatttttagtaccactaagttcaacaaatatgtcagagtagaatatggaaatcagtagtttacctctgtgtcataataataagttgagaaaatgcattaaatgttattcacagtatcaaacattatgatgtctatagggtttaatttaacccaaaattacatggtatttacctaaagaaatgctgaataccatgaaggaaggcctataggagtggagagttataccatgtttatggatagaaaaaaagtcaataatgtaatgatatcattcatccaaaaattaatgtacaattttaatacaggtacatttacatcagaagaatttatgatgatattggtcaagaagattctaataattatatgcaagaaatatatccactaacaattacttgagtaaagaaatagtacagataaaaactgaagatttaccctatcactcccatcacgggtgccaataagaattggcaggaggcaggctccagattagtgacaaaggaggacagtggtgtgtgtatgtgtgtgtttctgtgtgtttgtgtgtgcatgtgtgtgtatgtgtaaatgtgtgtatgtgtgtgtgtatctgtgtatgcatgtgtatgtgtttgtgtatgtatgtgtgtacctgtgtgtgagagagagagagagagagagagagaaagagagagagagacagacacagagacagagacagacacagagataaaatagacctagaaagcctgagagagatagagaggaaaggacaagcagagaggggaaggggaaggagagagacaagagatagagatagaaggtagaggttataggaggaggacagaagggggaggagtggagagagacagagaaagcacagatggttggctgtgcttaggaaaggactctaagggcagtctgttcaaatgtacaaaattgacaccttgtgagaaatgggcccggaacagaactgcagagcgctctgccatggtggaagtccgatgtgggggaagtgtggtggcacgtgtatttatgtgtctggtgctagcagcaggatggcgagagagcagccagccacaagagcagcctcccttacatcccttgcaactggggtttatctcctggcggttggctctgccttttccctgccactcacactttattgggaaatggattctcttgccaggagagtatgattaatactgcaactggctatgggcttaacaacagattgatggttatatttttaaaggggctgcctgctcatggtttatactgccgtggtctgcagcgtttatcatccctaagtgggaaaggtttgtttgagttagatttttgtgccattccacatggcgtttgttgtttgccagccctgcctgccaccttgcatttgttatttgatttaagacagtgagtgtatgtgaaaacaggaacccctgttccaaatttgtatgtttcgcaatgcctgcaggcaatacagaaaacactgttgcatgcagttatctgactactgtagacaagaaagaagcagcagcccgtcctggcatccaggcctggtctgagctggtcagcaacatctaggcccgattcctcatctttatagaccccgagactcatttacttcagatttcagagagggttagtgtcaaggagactggccatgttccctggccacgttcctaagacagtgttgcccaaaccagatgctaggcttcttaattcctagcaacaaatagaataagtgggaagatgaaaattatggtttactccctcagttgttcagcgaagatattgaccttttactgtgtgctagacactacacagtgcagtaagcacagtctctgctattgtgaagcttacagacaagttagaaacagacattaaataaccacacacacacacacacacacacacacacacacacacacacacacacatggaaaattacagtggtctggagagcctggaagaagaacatgctaggagcaggcagtgggagagggagttcctgaagagttgatgccttatctgaggtaagaaggtagagtgggcattccctacgtcaaatggtgggggctatgatggggaggtgggtatagacccactgcttggcatgctactacctttataggttgcttagttacagacccaagaggaaatgagaattgtcagtggttagtgtgaactcaacagaaaggttgctggatatctttatcatccctctactctacgtaagtccaaggatgatgggcacagcagctggaccagtgtgttttacattccatgtaggggattggtctgggcaactctgacactggacttccagtttcttcctgtgctctggactctcttaagctgaggtcatagtttcagtaaagggcttttagtttttgtggtggtagctatggctgaggctggtgttgtaaacagtgcctagtaggcattttcattcatacctccatactttaggtcacctcaacgatgtatgcttgcatgtgtgtgcgtgtgtttttgatttggctatttctgcctgagttcacatttgcatgtcatctcttgagctatgcagcctatctgcagttgacaaaagacctacctcactgctgttgcaatggctggagacacatgtgcacatgaaaccttaggtgtggccttagccaaagtgtatttctgttgtgatgaatactaggtttgccttggtcttgtacttcaccaccagagtgtgtgtattcaacaagtcttgctgaatttcactatgaattgagtggagttatagtctaaagagagtcaaaggccagagcagtccagccattacagccatgccttgctacctgaacctcatcctttgtgtagatccagcctgtgctttccatgttggggtggacacaaaactacctgttgttcaaaactctgctctgggtgatcagtctcattgggaggctgcctggaagtttagctgaggtatgaaaaggacttgggcgaagaccaaagttcagggaggagaagaggcatgaaatgaggcttgtgtggaggctgggtgctttctcatttgtaggaagtataggacttaaatggttcagcagtcttgatttttgggggaccagttgaatggtgtggtaccaggatgcagtaaaggtaggaaggaaatggatagtggtagctgatgctgtaaatgtctatctctttgtctctgactttaggtacctctggaattctgttcttcagaatgtgcccttttcagtcttttttgagactttttttttttcctttgaagaattggtaatactcataagaatttttttcttgtgcaatcaaggaccacatactcctaataggaggttagcttcagattacaaaaaaaatgaaaagcacattcattagtgttaacctttttaaagggactttggcttgcctttaaaatgaagataaagagatcaaattctatcaaacatataaatatgccactaatcaatgctatcagatatgaccattttatttttgtctcacagaatctgaatcatagaatttaatgctagactctaggaaccttaacacttaactctcaggaccattaagaagtaggaaggcaaaaaagagaatggtatgcatagaactaaaaggtagtgtgggttgacccagtagtgggaggcttcggttatatgtggccattgttagcttgtcactgaaactggaaaaaaaatactaccatctcctgatgataggccaagaaataagttttcaacaggaggtagaagatctatgatagagaagggaggagagggctcactgggcgaggtacttcctgtgcaagtatgaggacctgggatccctagaatccatgtaaaaactgaactccacagtgcttgtctgtagagggcagttctcaggtaggggagggagagtccccagaagtatgtgtgccagctaacctgacctactaaacctgtctcaaacaagttggaaggagaagaccaagaactgagttgtcctctgacttccacatgtgtgccatggcatgtatatcccacatgaacacacacgaacacacacacacacgaacacaacgagcatacatgaacacacatgagcacacatggacacacatgagcacacatgaacacatgtacatgcatatatacatgcatacatacacacatacacacaaagatgagaaagatctatgatatgcatagaaattttgaataagttaggttttattaaacctctggttagaggctctttaactctgtaaaatagtttctggaattctggacaatggaaaagaggtttcaacctcttccttgagacctggtaactggcatttcttattttaaaagggaacacaaagaccctattgacattttacgtaaaggcttgcagaatcctgattgtgtgacacccgttcagttggcaatttggtttccacatatttatttttctgcaatgtgttctccatttcagatcttggttattagttcttctcttggtccacacagatttagcctatgatgtgactgttggtttaatcaaaagaatggcccaagtagggggtatttgttctctgctcacgtctaattgaaggacttcacgttaactaagaatgatgcccagttgggcaacgcatttcacttgggaggttgctagagtgtctcgtgcaggaaccacagctccattctggagatgcagcagcctgtggggtagaagccgatgaaagcttatcagagcatagcctgcttgcataatgaatcgcagtaggaactgtgacctgccatgctgctttggcagtctatgttgcctgcagccttctgcagagctccagatttctgggtctgggtctctgctggagagaaactctttagatagatgaaataatagaaaagaccataggcacttgaaactatgcaatcccatagtaccttcttttttttaaaaaaatgtgtgtgtttttcagcttagggacttttgtactttggtgaggaatcccaagagaaagctagtttttacaactttcttttaattaggcagtggtcttaggctgctgatacatcttcactgtttggtgctaaaaaaaacacaggacaatggccgggaggaaaacaaaacactgctcattaagggctgggtgtttattttctggatccatgcatggatctccccagaggccccatgctggtgatgaggccatggaaaagctctggggagggggcagagtggggtgtgggctttcaaagttggaggcagaacatcagctcactctctctggaagctttggttgtgtagagaggatcttgtgagtgagggcactttcctcctaagtgtggggatttcatgatggagaaagctgctcttctgttttctagtggctctgccaacctgatacttgatttaagaatcgcacttagccacttgctgatatagaatctgggcactgaaagccgcagttagaaacagctcagttggtagaggacagtgtacagaaagccatgggtttgagcctcagcaccacatacactgagaacagtggctcatgcctgtaatctcatcacttccgaggtgaagttcagggtcatccttaaccgcactggcttcaagtctatcctgaatatatgacatataccatgtcaaagtgtcaaataatgaatgaataatttaaaaaaaatcttgttcagcgttcttactttggattctagaaagttctgaaaaagacttctgtcgtgtcctctgggaatggagagagtggactgacagaatgggaccagggttctgcgactgaatagctgcatcacactgagcaagtcacagcttctgtggatacgtgtggggaccaaagcccggggagttctgccaagagttgcatggataataagtattcacataacgctgccttcctgcagagtatagtcagaaacccaactcaggctgccaaatagtagactggcttcagtttcctctgttgaagatttatcttgttagagagccaaactttaagaaaaccacttcttttgtaccaggaacgaacatacggtcattagcaaaggttacacaattttgttttgttgagcttttatttagcaatgcgacaagaagtaataaatgtcctggcaggttttattaaaaggcttgcttaagtcaattatagctctatctattatggagttgctcaacatttccctcttatcgacattcttgaagaacactttaattactactcctttgtaaaatgacgaagccacagaaacactgtttgtatgttagcactggccacatttatatgttcatacaatggcaccgtatacatttgtatgtttctacgctggtactggatgcattgagaacaataagctatcctccagtttttcaatgcagaaggatctagaaggcaccctcacctggacagcataataagaaacagacacatggtagcagttttgaaaatatgggaacatgttacactaaggtgaaataaacgtatatcaaacatgacttagcttacttacatcatgttttcaatactgaaaaacactgaaaataaaagccatcgtctctcagtacctgctttcattttcctctttattttattttgtgtctcatccctggtgtctacagtgtaatttgacaactattaattcagaaagttatttgttttggtcctttctgcggacctgaagcaggcattagttggtagccctggaagccattttgaacacgtaggtggttccagaaatcccttttgacttcttcagatctgctgcttctgcttgctcccatggtgagggacctcaccgtcaccggggcctttttttttttttttttcctatgcttggtggaaacttaaaaggatgtgggcttaagaaattacaaattccagaatgaagtactaatgaagttcccggacacaaatcacttcacacactccacttagaggatttgtttaattgactgaggaaatagtttgaaggggaagggagcatttcttttcattagtgttcaaatgaagtgcaaattatagaactcgggctccatatttcctaaagatagaaactctggagaaggggagaaaaattaggaccggaactcagtttaaaatcagaaacaaatgcagtttgggtagaaaagtttgggcaattttctacatggataatttgagagcaactaactaatgggggctggaaatgactcccccctcaagtgcctggggtttgcagcccagttttattttgtgtttgtttttatgtcacattcagcctgattctttaattaaaaaacaacaacaacatagtatctgggcagagaagacaaggcaagtatttgaaccaagtgtcagacctgaggtgttaagtgactaaagatggtgcctgcaattataggggctggcataaaattacaggccttattaatctgcaagcttcctggcttagctcggctatcaggtggaccagtaaccggtttctgctgcacatctcctcgcccaattaaagccagtgcatagccatcacatagaccatgccattatcataatatgttgtaaggattgtttcttagactcttcatggggtgaatttcacctctgaggctatctgacagacagggttggctctctttagcccaattcaagcctcagcgattgccagctctgtacacagagatgagcatggccattgtcagtcccagggacctcatcatcttaacaactgcgctgtgtgcctggactggtccacataggctaggtcgggatgccagaaatagttataaagcgaatgctatggccaggtgtgtggaatggtcctcaccggtgctccaggctcgtgggagtgagaggcaggtggatctctgtgagttcaaattcaatatgggttacaaagaaagtttcaggctagccagggctacaaagtgaggagagtctatctcaaagacatgacataacaaaaaaccaaccaaacaaaattagcaagagaggcccacccaccaccacaccgctacattgtgcaagtgtgtgagggagagatgagagagaaagaaaagcacaacagtttgagcattaagaagaaaggtggagctggtgacgtaaggttggagatgaagagcctgatgtgagtcgcctgccctgcctgccctgccacttgaagccatggtgatatccaagcccatgttgcccccaagggccaggcctgggtctgtagccatgcagtagcaagggaatgtaatattcggatattggcggcacatatcaccactaaaaactatggggtatgtccctggtttgggctgcctcctggaaccatgttgttgatgttcaaggattgtgcagagctggccctacctcatgctcgctgtggacctctggaaagctggcccctgggcagctcagaagagctggctctggtggcttgggtgtgggcaagctggctctgagggcatgagagggcaagagctgaccccaccccttgccagctggtgtgagtgtgggaggaatggcggaatgttgggagatgatcaactcagccaccatccagggctttgagtgggcccaccccaacatctaccgtatctactgtggagcacacgaaagggcaggtcctgcagatccaaagttgaaggatctccatgacacaggtcaacagcaagatatccaagaggagtcccgtgaggatccaggattgttagcatagcagaaaccagaggccctgagccaggccagtaactcattgccatgatcgtctacaaataaaggtgtgtggacagaaggctgtatggtggggcatgtgacacactacagcttacatgatgagatgtttttatgttttgtttatttttttatttttgtttttatcttcttttgagggggagggtacaaaggtagagtgcagatacaaagagatgggggggttgggatcagggtgaatgatgtaaaacacaaagaatcaataaaaagtaaaaaaaatgctaaaacaatagcaaaataaaataacaaagcaaatgtaatagagataatggggaccatttatatgggtttcaagaggaactgtgggagaagcacagagtcctttgaagggcattatggttgttcttcctattatgagacagactcaagctggcattgggcttaacatccttcctgctggattaaacctgtgcagtagcacacatgactaagatcaggttgtgtgtgtgtgtgtatgtgtgtgtgtgtgtgtgtgtgtgtgtgtgtgtgtgtgtgtgtgtgtggtttctcttcttgggtccaattctgtgggaacagaacttgaggtggaggtccagatggaaagacttccactaaattgcattgtgcattttttgttctttttttcttccaaattccatcaggcaggagagttgtttagagggctggcttgagcacatattactgcacacccctcagaatttgtggtccagcaagcctggacttgcacttgagatttacacacctccaaaactcccaagtgaaatggatgcctttggtatgaggatcacccctgatccgccacgctctcatatggatctccagcctgcagctgtgggcagctggggagagctgtgaatacggcttagagcaaaactataaaacttcttacgacattgagattggggggtggggtgggaaagatgttctatagttcgatagcatgtttttgaatgtgaactttatagaaaatgatgtcatgttacagtgtggaacgttggacttacctgcaaggagaaagatggagaaagatgcagggtggggcagggtggggcagggcagtgcgggggtggggtggagtagactgtaggtaaaggctcatctttggctgtgtcctgctacagtctgagcccatggcaggcctgtaccatgaaccacactgggttcaactttggtcctatcttcctctcccaccatcttggctagtggtgtgtggaagagatgttttggaggagggggcaggaatgaactcttagtggtcgggagcggccacttactagtcaagatattttaggcaatcaagaagcattgctgtgcctcttagggttggaggcatagtttgacataacaacacacgttctatgactaagagctgactgtggacacacgtctttagtgtgatttgcctgtttgtctttggggggtcacaggctcttctatgagagcatattctggggctggtggattgcaagttagcatgaagagcttgccttgtaggagactgcaatgagcctggttctccaaaacacttttccctcctggcaaaaataggatacttttccgattgatattgtataaatcacaagagggctgcccaaagcctcctaaactggagtaaccattatgcaagctgtcatacatgactaacccattattatggcccccgagaagctaagggactcccacctcatttctgggggagcccatttcacacctgaataactcttattttaaaaagtcagcctgatactcattacaaacttgcctttgctaaaagacattctgccgtctctcgtgaagcgctgccctcctccccggcagagctcttttcctgtcataccagaaataattctccctcctccatgctgcttacctctttagttaatattataaaggatagatcaagggtgaataaatataatgtggttatattatttattacagccccctttgaattcccacttaaggtaataatgacaggtaaaattcattctgtttccaaggaatcaatttgctattatcctccaaatgtcatcgttctcaaattaatgtgggggacttgttgctacaaataggcatggttattgctctgtccagtaggtagccaaggatgccagaaggttctgggtaatatggtgtcatgccttggcaatgaaatgcactgactgggttgatggtcactggaggcctggtatacatggatgtgccagggtcagaaatgtccatcaggcatattcaagggggggcagtgaggcatcaggggctatggtttggtctaagcctgtggagggggtcacctgttctgactttctatacctggggcttagtgtcaggggaaaggagggctcacacctttggagtcttatttctgtgtgtgctgattggcatcatggatgtggcttcataaagtatggactcacttatccagaagcctcagatcttacagaacaaaaggaggaaacccaggcagcagaggtcaagctcccctgccatcctgcacacccagggactttcgtccctctccctcctcctctttctgccacttttcaccaacctccactgatttttctactatgtcttcctctctcctcccccctcccctcttccctttcttcttctttctcatctattcccttttctcctctcctacctcctcctctccctctgtacctttgtagcttttattgctacgaactgcttcctagttccacccttactgtatctcttcttcctcttcctcctcctctttctccttttccttttcctcttcatcctccccctcttcatccttctcctgctcctgctcctcttcttcctcctcttcttcctcttccttctcttcctcctcttcttcctccccttcctcctcctgcttctctcctctatttttttcccttccttctctaccccctttgtgtttttatagatttggtcttcctcctcctcttcatgttctcttccttctcctcccactcctgatgctgcttctcctcactttcctcttttgtgtcttttcagctttttctgtcacccacaccctttctatggctcttctctcttggcttctcctgccccggtcctacacctttgatattatttctatatcttctttatatctgtgccctgtaatgacagggattctctaatattatccccagctcttcctctcctactgtgacagcaccatctccctcaggacagcagccatgcctctgtctctgcatttctgtgtgacagcgactactgctaatatttccctgagttgtcccacaggcacagaaactcagcacatcccagactggccccacttctctcccagatttctaatttcttttggtaccaagagccatagaggactgccccattgatagtgctactcagcttgcctgcaagctacctagtctcagcatgccatttttccttcttaaatgtgcagagatgactgcagttttttttttttaaggaaaagctttattttttgagttataaaattgtattgcagtgacactcacataagataaaataaccattttgaacaagcgatgtagtggcatcttgtacattcccagtgtgtgtagctgccatctctgtccccttctcaaaagcctttgcatcacaccacaagggaaccacatgcttggtgcttgttaagcagtcactccttactcccttcacccaggctggttcaacctattgaggagatttcacataaataggataatacacctgtggccctttgtgtctggcttctttcacttagcataaggtttcaaggtccatttgtggcacagaatggatcactgctgcatttatttttatggctgaatagtattccattgcattgcatgcatacatcacaatttgtctgttcatccattgatggacacttgggctgttttcacgttttggctactgtgactagttctgctgtgattgtatgtgtacgtacatttgttcaaagggagtctgcctctttattgccatggaatggaacccagcaaacattcttatatagggtcaaagagtaaatatatcaggctctgagggtcattgaataactgccagaattactgagcagagctgtatcaccgtagcccagagaagccattggaaatgagtgagcaactggcatgtcttttgcaatgttccaacaaagcagcagaaagaggtaataggtctgagctagttcgccagccttgctgatagcccatgaagaaaaggtgccaccatgacacacctggatctccaagtctctgcctgatcccacacttccctaacctttgtcactctgcatctgtcacacaactcaaatggaatggagtggagctggctttcggtgtgagatagaaaggggtcaacatggggaggggagatgcaagtgacgatgggccacagaaggacgcctacccagaagtgaccctggggagacaactctggcctcagctgcaaaggccaggaagcagataagggaattacagtgcttcccttcaggtgtacgtgggcgtccagggttcctcagggtgagagccaacttagggacatccctagcagtggtggagagttcatacgcttctgcagttcttgggctcatctcactctaagggacataaagtgacaagttcattgtctgcagcatactttttcaaagagttgtaactcacagagcgcaagaggagacagaaaggcctctggggacaaataaaaagagtttatggatgcaaacggagtgagtcctttttgcatgagcagggagccatctgggtgacagagacagtgatggggccttgaatgtctttgtccttggatttcacacaggcacctgctgtacacgtacagcttttgtccgagggatgtccctctcagactgttaataacatttttttcaaggcccaaacttttatagatttaggagatgcacagaggagacacaagagtctgggtgtgacagtcagggagaagtgttccagccctggctctccctgcctgctagatgtgggacttacaaattcatttacctctctggacatctgtggttacccatctataaagtgaatgctcaccaaccatgagctcttgggatctgcatgaatccatcagaccacacaacctgcatcctggttgctagcctcttcctggtcaacctcctccatgcgtctctcctttcagatgtcttagttttgacttgtacagtccaccctccagagccacagatggcagacagtcatattcctgagtcggttgctcaggaaacatttctcctacctagactgctgggagattttattttcccaccaagagatctttggatctggtccttacaggccagctcactgctttacggtggacatctttattcttctatattatttgtgctcatcaaaatccacttcatgcttcttttaaatttttttatttattattatgtattattattagtgtgtgtatgtctctgtttaggcatctagatgcaggtgtgtgctcgccacataatacacatgaatgccaaggggcgacttttgggagttgtttttttcttcccaacaaactgtggtcatcagaacttgtgtggcttgtatggcaagaactttgaccactaaatcatttcctgcttccctttaagtcctcatgagagtattttccttgactctattgttgttaaacatcgagcatcctgagtcctagccagtgcaatgcgggtgaaagttaaatgaatacatcactattaggcttggatcataaattcattggcttggaccataaattctagcaatgtccttttcgtcttcttcattcgtctgtggaagactctgaagtcgcaggtttgggtggaactggagctgtgactatgtggtgagttattagagtcatttgaaggaaacatgaaaccatcagaacctggaaagtgctcgaagcctcactcatcctgacaagtaagtctgctgtgtgcttaggatagagatgctggagagaagggggagatcagccttccctttgctgcttccagcctgcagcatggctcttcaggagctcttcaggaggagagctggttttggttctggaccaaaggaccaccttccgctatggggacaagtctggaagtagctctgttttctcagtcgaaggctaggttttctcctggctattgaaacctgacacttcccactgggtttttctttgggagacctggcaaacccactactaagagccccctgattggcagtggaaggtgactgaagcattccctggggtggcctgggacatgtaggcctccccatgtagtttggcacaagtagctcctgtcagctctcagcttccagaagactcacttgaacttgatgtgtgttggggggaggggtagcggcacccatagagagttcagagcttgatgcagcagctctctggctggcttgtgataggatttgattaaatttttttttctttgagtaaatgagctagagtggattgtttttatttctttctctttattttgaactcatccagtggagctttttgggggatgatcccatagaggggtgcgttggtgaagtcattataatgcattgtgggtacacgtattggttaaagtaaaaccttgagtatcatttcttaaaagaatcatttatttattttatgtgtaggagtacactgtagctgtcttcagacacaccagaagagggcatcagatcccattatagatggttgtgatccaccatgtggttgctgggaattgaactcagggcctctggaagagcagtcagttctcttaagcactgagccatctctccagcccccaggtatcaatctttaggagttacctacatggtctctgaatggcttaagcttcaccagttaggtaaggctggcatcatggtgtgcctccaagacctgtctgtgcttgcctcctcagtgcggggaatgaaagcatgcaccattcattatgcctggattcttacgtgggtcctgaggatctaactcagctctccattctggccatccccatagccacaacaggttaactctgtaacaaatgactgcaagattttgttatcactatagtggagattggtttccttcatcatatccagtgtgggttggagctgtgctaaagcttttccatcttgtgattctgccattcttctcatccgtggaattcaaatggtgattagggaaaaagagggtggaagagagtcagaggtttccattagctgtgacattgtaccatcttcttacatatctgggattctgaggaacagcctaccgtgtgtccagtagatgagttagtagaaataggacaggatgagtgtgagtaggtagtagtccactattgaagaaatgatgtttgtggctaaatgtaagaacagacaaatcattaaacagaaccactgtgctattagcaaagtttatttccagagccgtgcagctgggattctgaactggcagtattccctgagacttctgacctttgcatgagtccactgcttttatctggatccagggtcatggcgagtgcctgggaacttacaggacttcctgttaggtagaggggctgtccttcagcagcacctctcaggtaatcagctcagcctcttttctttggcgcctcctgtatgtctttaggagctggtccactttgtagctctcccaagagaataatagcactgggatatttctaccgaaagagagaggtcatgactttgaattgatccgtcctcaggctcagagcacactggggtgaaaccagggtggcatgtggcagggggagttggctccctctcagagtaaatgtgggacaagattgttccccagatgggggacggtttgaggcaattactgacaggtgagctgatgagcctttgtgactccttgctctctgcttcttggaccttttcatccatttcagataccaggcaccgccattgttcaatcttctgcaacttcacaccgaatctcaattctagggagagtctagaaactagaattcacctttgctcttctccggggaaattatttgtaagcctaaacagaaacgaacagttttccgcaaagcaattttctgaatgtggaaggtaggtaccaaaagcgagaagaacttgctggttttagactccaaaatcacctacactagattgctacacctttgaaatttgccctgctgaccgatgcctcatccctagagaaagatgctcttaggaaaaaactaacacaaaggaattagtgagcctgcagttccttttcccactcttaatgaccttattagagaaattgcaccctgggtaacaatatagataaaatccccatggagttacatagactgaaaatctgattccttgggaaggaaatggtaactgtcagcaatgctcaggtttgaattaaatctgagattgcatgggccatattcttacgtaaacatgaatcctctaatctacatacatttgatattcattttgggtcatctcttctagtatcacattataatgtttgcaggccacagtgtggggtctcaggaagctcgtggtgaggtacctttctttagtggcgcccaacgtgagggagagagagagagagagagctgaagctgttattcagattattacttctcattattattaatcagcatcagtgagagaagctgctgtttattgtaggcctgctcctttcccaggtgtgtggtgtgtattatctccaggtctgagatgatcctgaaaccaaggctcagatgtgttcatgggcctacccgaagctacccagtcagaacaagacacagcaagagtccaagctaggatgttgactcaaggaattttctttgcctttgcatcaaaatcgcagctttagtcatatttaggaaatggcgttttgtaagtattcagttttgagttctgagtgaagtgcatctccatgccaccgctcctctgatacacatataggatacatatccttcccctttcccctcagccctctcggcagtccttctccctaggcaaccgggaacctgctttttgcactatagaatgggtttaccttttctagaccttcctaggaatagaattataatatgtaataatgtacttaaaaattttaatttattctttgataatttcatacatgaatacaatgttgttagatcatagctacccacttgttaccctaacttcctccttagtggtcccattctccccccaacttcatgtcatagtcaacatctcccttttggtcccctcctcttcctcctcttcttcttcctccccactcctcctagtcgcctcatccttttctttcttttccttctgtaagcctctttccctcctccttctctaagcctcactctccctcctttcttcctcttcctcctcctcctcctccttgccttcctcttccactgggtccagttagtgtggccatatgagcatggacataggacaccatcttcaggggcaggcttaactaaccatggctagctacatcattggcaataattcactcttcttctcccagtgagccattaattcctagcagctcctcagctagtggcgggacctcacaaacctcttctctctccatggtggagttctgactagcttgatcttatgtagttcttatgctggcaaacacagtggctatgagttctttagcgcaatgaccctatcgtctccagaagatactatttcacagaaatcttccattgcctctgcctcttacaatctatctgcctccgcttctgccatgttacctgagtctctggagttgggggttagggtcagacatgatatagatgccatatttatggctgagcagtcatagttactttttctctgcatgctggccatttgtgagcctctatactaatagctagctggccacatgctgtgtaaggcgtttttctgatgagatgtgagctgtgctaatttttggcccacagtaacatttttgagcttcactcagatactgttttagttattctcccaaaactttagagttgttttatgagtgtatgagtgtttgcctgtgtgtgtatatgcacactacatgcatgcagtgcccatgctggccagaagagagcaccagatccctggaatgagagttacagatggttgtgagccatcatgtgggtgctgggaatgaacctgggtcctctataagagccacacatactcttaatcacagagtcatctagttttttagcctcccagctcccagggtcgggtttaaagtaagcacctgtgttgtggatttagagatgagctgtttagcctgagtatgcagttcctttagaatatttgggtaaggggtacaagagtggaatctgaagagactggccttgaccttttgttaacttgttttcgaaatgggaataaagacacatttccttgtggacttagtgtgaagatcaaatgagttggttggcagagctggctcagtaggtagaagtgtttgctgaacatgtagacctgagtttgcatcttcagtacccttgttaaaagatgggcatggctctgtgtgtgtgtgtgtgtgcgcgcgcgcgcatctgtatgatgcagaaccaatggcagggaagagagaccagcagattctagagctcactggccagtcatcctggcaggaacaaagagcttcccattcagggaaagttctgaaggcatcatggcagaaagtgatagaggaagacacttgagcccttctccagcctccacgtgagcacacagatacaacccttcctcttcccccaaccagaaacacacaggactgagtcaaacacagaggactgagaacggtgctgagcatggaatatgcgctcagtaggatgtggtggacaatggccacgatgagccaggaggcagcaccttatccacacagaatctcccaaaacttctgctttgaagtaccgcatctaaaaaaaccaggaaaatgaaacttctgttatccgtgaaccagccactctatgagaccctgttacagcagcctgactagagtaaggcaacgagaggacgttgaggagcggaggcaatgccgccagaaaataatggaaaacacacaggaggctttggcattgggtaaggaggctagaagggtttgggtgctcagaaaagtttaccttgtctggaacagatctggaaaagcggttctgatgtagactttacaggagagctgtagagagagccgccgtcttctcagagaccaccgaggccctcctgagcagatcccctacagtcatgatattctgatgagatctttaatggtggggaagaatgttactggaaaatcctgcttaactccccagtctgagatagggtctcacagagaacatgtttgccttcaacttcttccctcctgtttctgcctcccaagtgctgggactttacatgtttacagccatccctgggcctggccagttcatcttataaaaaaaaaaaaccaaatttactgagtttcatcatggtttagtgtttggtggaagaaagaattacagtgaggtattttagctgatgctgttccagagcaaagtattgaaagtatggattgactcctgaactgtagtcttacactaaagtagatgaagagagaagtgacttaaagttgtagttgtttttaagtggaaaacatgcagaatctaaaaatctggaaaaatttaagcctgtctacactgcatacaaacagattatatattaaattatagatataaataaatagaaatataaaaaattcctggcttgtctatattataaataaacaatgagcaggcagccagagaactgtttgatgcacacatcagaagggatcaggtgttttagccaaagtcagagctattcccaagaccatttgcagtaagtaacttctggagttacatgctcagagcacaaggctggggtaagatgcaggacaatttcaaatgatgagccattggcacccacaggacttgtcgtctcttcccactgtggggtcagcttcctgcagccttcagcccatgctcctgagttcctcggccacccaaggtgggctctagtgaactgcagtgcagtgctgttccacattttgcccattctccttagccttggtgcatcatgttcccactgaataatgctgtgttgaaaactacagtccgttctcaaaagattcaaggagccgccagccagtctgataattagaatgtcgtgagatgtggatcaaatttcctttgcttgtttctggtgattttttattgttttgcttgaaatatttgttacttagtggctgggcttttcacataacaatgtcattttggagcaacgagggatatttcagaggcctgggtctgccaagggtggccagggagaaactggaatccacttgctccatacagcgctctgagctgggcagattttctttttcctgtcagtcctcccccctcccatctccccattttcaccactgtactggctggttgacacaagctagagttaccatagagaaaggagcctccctttaggaaatgccttcatgagatccagctgtaaggcatttctcaattagtgatcaagggtgggagggtcccttgtgggtgctgccatcctgggctggtagttttgggttctataagaaagcaagctgagcaagctaggggaagcaagccagtaagtaacatccctctatggcctctgcatcagctcctgcttcctgacctgcttgagttccactcctgacttcctttggtgatgaacagcaatgtggtagtgtaagctgaaaaaaccctttcctccccaacttgcttcttggtcatgatgtttgtgaggaatacaaaccctgactgagacacccagtgtcctgggcttcctctcccctccctctcgctctgctctttcatctccattctttcccctctttcttttgtacccatttctttctcaccacatcatgatctcttgtctttctcatcacagtctctgcctttctcatctctcttaggtacccattcttctttaaacctgtcttacatttttacccattcaaagataaaggaagtgccaggtatcgacatcgcttgggtcttatggaaagcctctagaagaatcttgtggctttgccctgttgctacttttccctgctgtgtgcaagggcaggacagggacatccccgtgtatctttgttctgtctatgaagcatgggtgaaggcctctttctgtctcacgcatttgttccatcaacacacatttcctgggtatttattttatgtactaggcagtggctgaggcactgagcagagggaaccaaatcgctctcaaccaaccggggtccttgccatctgcttctttaaactctgtaatgcaggcagacttccgtctaattatttgagatctctctagtagtccctaaaccctccctaggtgtcacccggaggtcacccagtttgtagataacaggcatgttcatttgccgtctctttcctagaaggtccagcaacttgctagtacagtttgaaaaatgtcaatattttgatctgaaataggttttaggtgcaaaggaggttgcagaatccttgcagagaattctttgtaccctttgtttggcttcccctaaagacagtatcctgcatacttagaattcattgtcagaattagaaaattgatgtgtaagtctgagactgcttttattaaacccctcccttgcctacgtttttctcttctcccttcttcccgtctctctcttctcctttgcccttttgttctcttaccttccctgattcctcttttccccttctctttcctcccactttcctttctctctccttttctttctctcctttctttcttccctcttcctcccccctctctccctccatttctctccctagttctaggaagtttaattatgtttatacatttagataattcccctcacagtcaagcagggacagagctgacccaccccgtcaggaagttgtctgggttactgtttaacaaccacacaggtccttgtctctaacccctggacaaccgcggatctgttccccacaaccgtaattatgtcatttcaagaacgttatgtaaatggaaccagacaatctgcagcccttggagattggccttgttccctctgtgcaatgccctggcggctcatcaaagttctcacttgtatcaatagttcattttgctctcactttttaagataaaaggactccagcataggacacttgagcgagaaattcttttgtgaaaatactcattttgttttcaaagttaacctttgcggggaaaacatctctcccggctagggacctccagcaattaatctgagtttgatatgcaagtctgcaaattggtagatgactgttatttttatttgattcgtagatgttgtcctagtgttgaacaactgccccctcccccaaagtgggttcccagttttgctttggattcattataggagtcttccttcacctgtaaaattgtctcttgtattagttaggttagtgccaggggctggaatgaatgggtctctcagatagaaactttataccttgtttaaacagcagagtatgtgaccaggcctcatctttgaaaggctttgctttataaggtgatttggagacacgggtccagattttttttttcattagatattttcttcatttagatttcaaatgttatcccctttcctggtttcccctctgaaaaccccctattccctccccatttgccctgctcactgacccacccactccctcttcctggtcctggcattcccctatctggggcatagaaccttcataggaacaagggcctctcctcccattgatgaccaactaggccatcttctgctacacatgcagctagagccatgagtccaccatgtgttttctttggttggtggtttagtcccagggagctctggggttactggttagtgacaggagcctgatctagctgtttcctgagaggctctgccagtgcctgacaaatacagaagtggatgctcacagccaaccattggacagagcacagggtccccaatgaaggagctagagaaagtacccaaggagctgaaggggtttgcagtcccataagtccagatcttttaggtctttgaatctttatgcagcatcacatggggaagcgtgtggatggggtgggggaggtgcactgggtttgcagtttacacagatcatgtgtagaaggccttccatctcctactgccattccagttttattgttagcactcctaagatatggggaaggaaggacacacttctttgtgggtgaacacacccctctgattgagcctcatacatcggaaggaggaaaccacagtactttggtggatggctatgttgggctccaatctcttcaaaaatccccatttcaacttaacagctttgatggcagttgtaatgggtaccatccgggaagtcacattcttgatctggacctccctgtgacagtgagattcactgttgcccctcgaaatgatctcggctcatttccgtttcctcgcttccccgtattagcgaacaaattagatttcagcactgaacaccgtgctaagtttcctgaccttggacaaatggaaagttctttctgggatcctggctgaaggtgggttccataaatctgggctagcctgttaatccaaccccacacttactgttatccgttcattttgaacctggagactaatgaaaacacaagcagccccgagaccacacagcacaaccgctgtcagggccaggaggcgtttgacagtttagtcctgagagcactaaattcagcccctgataaataatttactttgagaactgggaagctagcctcactgtcttgcctagctcgctgcttgaggaatatagaccattctggtcatgctagagaggagagaagaagaaaatttatcttcctcattccctggctacctatctttcatgtctctacaaccatttcaagaaagccatggatttctgtttgctagtgcaatgaatgcctcatttccagtttgcttgcctcttgcctgggctgtaatcacttgtagctcggcctgtcagggtccctgggaagacttcatatgggctcaccgtgtgctgatggatgctgagtttatatagggtaaaaggggagggggagatagactcaatgtcttcttaccacttcccctgctccttaattgacagggcctggcggaggccacgccagccttgtgagtttccaagtcaggtttcatttcgggttgtacctatcacttcattttgtgtttcgtaggttgcttttgtttctgcggttgcttttctccatgcctgggggacagaatagctcagctatacatttagttctctgttgtggaggtttttcaggggtcggcacaactctgatgctcattaagattaccaagcctcatcatttttaatgttaggcccaaggtaatagttaatgaggctgaaaagtatattaataaaatcgcttgtagtaattagcaagaaattataatggtagggtgatgggccgattttagaaatcagttaggagtgatcaagaccaagctcagatgtcactacttattattttttgctttcaatcatcatgaactacacctttgcatttttatctctgaaaataaagcctttgattgagctcatgcatattgcgatcaactcaatctcttttgttcccatccaaggagcatagagacttgggactagatggggcctctcgaataattcacaaactgtcatgctgccccctagaggcaagtggcttcctagctgagagaagctgggtgagcccacagagtcacataggcttctgatgagaggagacccaggaagcaacatcagtggggctcaccaactcagaagggggggtgtaaaagcaggtgcctgtaaggtcacagatttgggagacgaaaggctggggattgaaggcttttggaacatcccccagtttaatctttctaatcactcttttctaccagcctctgttttgtgtcacacgtgtgtttggatctaaagcttttaagttatcccaggctaaagccaggacttcccggacctgcctagaccttcagctgaagcttcttggagtttttcttgccattgcccctgttagtaactcagtatccttattatttaattattattaatgtgtgtgcccgtgagtgccaacactagggtactccagcacaggcataccccagtgcacaggaggagatcaggagaccacttgtgagagtcagttctctcttccaccctgaattctgagcaccaaactcaggtcatcaggcttggtggcaaacacgttcattcgtcccctaagccatctccctggcccacccatttacttttgttaattcctttgtgcctgcccagattggaggagtatctgaaaaaaatatctaaagaagatcaaagctttagatattcagacagtattgttgttggttcatcgaatagtgatagactcattgaaatccacttactacgtttttctcctctttcccatccctttctccaccacatttactgagaacttgggatattcaagacaggcttgcgtgcaagttcctaaggatatagaagtgagaagacgtagttcttatcttccagaagcagccgctacactgctttacatggggatctcccacatagcttcagctgccaacaagacacagctgaatatcggagagcgtctcacttggggattgcctcaatcagattggactgcaagcacgtctttgggcattttcttgattgctacctgatgtaggagggcctaatccacttcaagctgtactatccccacacatgtgagcctaggctgcataagagctagctgagccgttcagagagcaaaccaatcaacaacctcctctctgtggtttctactttagtttctgcctccagattcctgcctcgagttcctgccccgatatccctctgtggtagactggaacctagcagtgtaatatgaaataaactctgtttctaggttgttttgggccatgatgtgtatgcagtaacggaaaagcagatcaggataggggtacgtagagatgctgaataaagggtggaaggtttgaattatgcgaaagaccgagaaaggcaagggtaggcggtccaggcattagcaggaggcttctgaagcttgtgggacccaaggagcttgcaaagttctatgatactgcattgctaagcatctttagtggggtggggatggtgggctagtctgtctgtgtgtgtttatatgtgtgcgcaagcacgatacaagagcgttactcttatcttgatagtggagcacctatccagggttttagacagcttggctcgatttgtttgtagaaaaaccactacagtagctggtgcttttctagaaagagcccagtggcaagggctgaaggaggaggttgctgccatgctccctgctgccatgctcctggtatgagcactggcacccaggggctataaccttggagagaatgaaattgagtgtgtgctgtttgtacttgttcaaagtggcctctaggattgagaatagctctctttaccttgggctcaagcatgtttattccaagtgtccttcaaagcttctgtcctgggtcaggctgccccctgtggccctgtaacagagagttggggatgggggagaacagcaaacggctgtattaaaaacattgtcccctggggtacagctagagagaaaaaaaaaaccttctcgacagaagctactgtggttaatcacattatatagaaatgcccgtggtaagaagaggagataagagcccatccacagagaagctgtgctgtgacaggaaatggctcagatcagaaccccagttcaactcttctggcaggactttcccagccatttctgatgaatgtgtaagtgttctgtttgataatgatatctatctgctcctggatattggtctcgtttcttttgctggcttggtgcttagtcaacgtatggatttacaaccaaaaggatggctttgttagatcagtctccacacagaacagagagtggtagagaagagggagaaggaatcttggaagagaagttgggacaaaggcggcgatagatagaaatggaatcgtgacatgtagccttggtgatgagtggatgtttccgaagctcatccacatcacagcacccattggcactagctcactccgtcccacactaaattgtattctgcttaaggtgcacagtgtgtgtcttcagaccgagcagctcttgtctgacaaagagtgttcggaatcttgtagactcggacacaggctttatgggttgatcatccctgatctgaaaacctgaaacctagaatgctctctgctcttcagactggggtgatcaattgatgccacattttgtttgctttgttgtccatcgatggacacatgggggaatttccatatttggctgttgtgaatagcgcttttatgattacatcatgtacaaggttttgtttggacacctgtgctcaattctctgcgagtgtagatttagggctccatgtgttgggtcatctggtatttctgtgttgcacgtaatgaggagctaccagaattgacacactatagaaacgtaagtatatcagtgagcgcttaggtttaggggaagtggggggctttggagggtgatagccagagggtataggatttttctttgtaatgaaaatatgctaaaagtaactgtggcgaaggttgtataaatctgtgaatatactacaaaacattggaatataccttttatttaattttataattttttttctgagacagggtataactgtgtagtacaaactacaaatttatgatcctcctgcctctgactctgaagcgctggtattacaggtgtctgccactggactcagctacactgaactgtttaaattggtgaattgtattgtttataagttacatattggcatatcattttttttttttacaatgagcaagcaaatgaccttattttatctgaaggcttattttttattttttaaaattttttggagggcattagtgaacttgtaaatccaaatataaatgtactgttagagctcaaaattatgtatttttgtctacttgtctattgataaaacaacaaggagagctcagagcaaggacgcttttgtctctgtgctgtgtcccagacccttgcaaggaccatgaagtgcactagctgtccctacatctgtggtaagtgagcaatctgcccgcagacttctgggaactgatttatagctcatgataaaggcttgttttacagaatagccatggtcccaagtctcagatttagtggtttttgtgttcatttgggctatattttgagtcattacccttgctgggaggctgtcatgaagccaaaggctttgacatcttctggggaagggaggctagactgccaataagtgggctatcttcaggtacattgaggataacatgttaggagactgagacttctctagtacctgtactgcattcaggccaacttctattcatttgtttctagcatcacattaatccagctatcaagcataggttctagaaatttgattcatttacattgaacctctaaagtataaaataaaaattaccatgaaatgttgagctttaagaaaaagtatgctacatttttaagtagacattgaacctctaaagtataaaatcaaaattaccatgaaatgttgagctttaagaaaaagtatgccacatttttaagtagaaatatttctaatagttttttactcccttgcaaacatatagtttcagctggtaaaaggtgctattaatagagtagaaatattttgtttgctagtatctgtctgtctgtctatctatcatctatttatctaaatatcaagttacctacctatctatcctatctatcctatatatctatctatccattcatccatccatatatctgttcacccatccatgtcatgcatgtatatacatatgtatctatctattctagttttctattacctatctctactgtatgtatgtatgtatgtatgtatgtatatttccatccaatttgtatatcatctatttcttctgttatctatctatctatctatctatctacctatcatctatctacttacttaatttttgcctgcaatgtcattaggacttaatgaaccagccccattaggagttgtgtgtaactcctctttttttgcctatatgtacaactttggatattcatctctataaaatagttttgagctcattaactcatctttcccattggatcagcttctccagactgggtcttgagtgtctccctaaaaatctcatgcattgaaagactagttctaagctcaaggtggggctaagaaaagaaagttaggacactggaaatgtgctctggaaggggatattggggctctaatcccttcctccttgtctctctctgatttgtagttaccctaggagcagtctctactgtcatgtgttccttccttgatgtactctttcattataggctccaaaccaacaggcccagactgaccatagagtccaacttaacaaactgtgaacccaaataaactttccctcttttaagttgattgctttggacatgtgttacagaaatggaaaactgaataacacagtagccttactttctcattggtaaatgtggcaatcataaaagattgggctgactgtctgacataagctatgcacaatggttagataaggctgatggcccaacaataactcagcaagggttagaaatcactctaatctgcagccactggctcaggagcttccctgactgatctaagattacacacggaaagtgcaaaggaggctttctaagctttcattgagttgggttaacaggctacctgctgctatctcaagcatccttagacagcaaagacgacgcctgttgcccccaagagactgaagcttccttttcagagcaatttctccaggaaatccttaaacagaaatataaaggggcgtgaggattgagggcttcaggacagtggcatcatttggggtttgagctcagacccagtctgccctggtcagtgtgtctgtccctggtagtggtgatcatactgagtggaacctgaggatagcatgccttagttccccatgccttgggtatgtggacacctgatgacaatgaggctgcaaattttatgccacggtttatagtcccggtctcaacttccagccacctggggaatacactggaattctaaattgaatgatgggcttgcgttttgaactttaggaatatttctgtctagctgtgtgctaagttttgactggacgtcaacaatttctatagatacagctacggattcttcattctttgctgaatattaatttttccaacagaagactgacaggatatcttgactcttaggaatttcatgttaacttttccctagctgtctgcctggctctcatcagcttggtgcatactgtgaggtgagtggttttctttgcccgtgtttctgggctgagagctgagtggtcgcttccgatgggattcttaacatgttgcattgtctcgttcgcccatcagttgtcagtgttgacagcttagtctgattgtgctgtaggagtcaggccaagtgggtcacaggggcaagtacagattagatgtgccgtcttgatggagggtggctggcggtgctacacaaggaccttagcaaagatcacctgcagaaagacagtggttggttagagcctctgttctcatggcaggtccacacactttgtcagccccggttgcctctcagttgtagaacaggtagaaaacacacgaaagttcatcaacacctgaaaaaagtaaaaataaaatcccaggaaacttttgtaaaatagttcttagattcctccttgggaagccccagcccccgtcgtttgtgtctgtgaacgtctctcagattctgtggtctcctccaatggacactacttgggatcaaactttggtcctttcatggtgttctgacactgagtgagctcctttctagatggtttttaccactccccagtccaaacagtgaacacatggcctcttcagggctgtgttaagatgctgcaccttccatctgatgacaacatccctttctgtctgccatggcctgttagagtctgccgaatgggtctcctcaatggattgactcccactagcttcttgagccaaggaaccatccctggcatcagccttttctatgcactggtttcctaggcatggcctgttctcacatgctaccccactccaccttctttcttctgttttgaacttcctttctctctttttccactctgtctaccaagcctgctcctgtgagagggtggccatcttccttgagcgcaccttcctacaagagatccctgtatccaggcagagcctgagactctcttctgcattcttaggtgttctttcttattgtttttataaatgattagtgccctgattttgtgttttactcacgatccacacaagagtcttgtgggaaaggctctgtcttgtgcgtatttacactccggagacaaggggtcagtgtgtcacagtggccatgagatagttgccggttcaaactatacattgttttgtgtgacttcaggtgatttttgttttgttttttttctcaggctggattttacattagaaacagcacagcatctatttattacctgggcttaaagtggggtccacctaagtaccttttgcacactggtagctagcagggtgggatgcataaatgtcacctgttggcatcgtgattgccattcctcagtggggtctagaaaatgctagaaacccaaattcttgactaatagaatattgtagaattcccattttctctgaaatggagttaataaaacattatttttctcatgtctctctccccagtcctcaaaagtgaatgtctctcagaccttagaaaaacactttgcttgcttaagcgtctcaggaacatttggaagaaagccactttgcccaataagctaatagctaaagtcaggattcacctccctgctggttgattgacaccccatttcctcctcttaaaagaactaaatggcctatatttcttttttaaattaaagtaaatgaaaatgaatttccccactcccctggagatgactggagacacactgggatgtcaaataaaaaagttgggaactgctgagctcaaactcagcactgtgggttcctgggaaagatgaaacatgagaagcacccagcgtggaagaggatggtggagggagaatcggggagacagacagattctgccttatagagatggaggagactagaggggaaggctgtatggaaaaacagctatagaacaaatgatctttaacttcagtaaaaagaagcaaagataacccaagatgcattgaataattacccaagttattcctggccaccccaggcatgcttcctcaccatgcaaaaatattgaaagcagaagggaagtgattggaactcggaggtgtctcagttctctgactttgctaacaagatttgagcccgttattcctgcctcaccatgagccttctcagtagcagaacctcgattcctgagggactgtgatggagttcatctgagtttaacaagtgtttattgaaacccaggatgtgtctggggccaagattggaactatgctgcatgcaagatgcagatgactagatctttagcccagaggaattcctggtgaggtgaggggaaaggctggagagttgtttgttgatgtgtctgcccctagcttctacctcagttcaggaggtgtgcctccttaggtcaaagaggaaacttctcagtagtttgggggttttggatgataccactagtgtgggctcctgagtgcttcagtctgcttcttgccacctctgggtctttcttgccaactacagtaattagcccaaattattcaacagaaccaggcagccttttcactctctgcagttgatggctctcttttgcacctggaaggaaatcaacacaatctaaattcattagcattgctttgcatggtcctggcccctgcctacccctgtctttctctctttgtaatcagatttcgccatccccccaaccctgcagccttctaagagaacacactgcttagtcacagaatctgaacttgcccccaccttccttctccctgtctttgtcatctataattgctattggtaattattatttgtttccttattgtccttcttgttcttcagctacgttgtgagctcacaaaggcagacagagcacatgcctttctgattctctgctttgtgcccagaatgccaaagttgctcaataaacaactgagcggaagtactgtggtactttatctgccctttacaggtggatcaggaacaaatagttcccaggaaagaggcacactccacgaaatgtcccttggatgttcttgtttgtgttgagggctctgtctccagctggtactgctattttgagtgtcagtgagaccttaggacaccgggtgtggctagaggcagttgatcactggagtgtgtgactttgaaggatatttggggactcttgtttcttcctctgtctacttccttattagactactgggccatgatgaggtagacaagttcattcttccacaccctcctctttccatcattctgccttgctgtaggttgatagcagtggggcaagccagtcatgaagtaatccccttgaaaccatgagccagaatatgttttgcctctcttaagtttaattgccactcccccctccccttatctttcatagtggcaaagagcctgactaacacaacgtattagggaaggaaccattctaaatcaggcatctagagcatgttttctggcccattgtttcagggctgcctgattttcaaaagaaggaatctttaaggattctccctcctggatctcaaaattcactgagtgtaagagctcagagacctagcattctgttgattgacagctctttggccctagcctgccccagaaatgttttcctgaagagacagttctgcctgcctgcctgtctcgaggtgatgttttcaggcttaattagaggctgttaccccttcttaagtagtcatataccagacacgccaaataaccttagcatcgagtgcaggggtaagagactggaataacaatttgatttcaagtacttaaaagccaaaggcctctacatcacaatcgctcgcttccttactttaacaagttaaatgagttctatatgaatttttaaatttgttcaataacgttttattgagtctccacattgctcactctgctggcccagaagctgtgggaggcactgtggaaaaagactccctgctactgagagcaattgaggatgctgctcagagccttctgctcaccttcctgtgtttaatccttgtagcagctcccaggagctggagctggagacagagtactaatggggagctgccttggctgccaagacttgactctaggcctgcaacgagggtttggttcaagcctgcttcacaggaagctatactaggaggggcaacaagaatgagcaactgcacagttcactctgtgctttgtctgtctgtctgtctgtctttctaaagactgtagctatccctagctaatcttcatggcaggcaatatcctctccaacctgcagggctaccctggcattgaagcattcaggtggcctccctggatgacaggtttctaatgagactgttacttgagttttagggcaaatgctctgaattaaggtaccctaaccaactggctagggattggtcccccatcccatatgtcaatcgaagacatgagtggtggcaaaagccgatggaaaagactggagaaaggaaatccagtcagtgtagtatattgggaagaggcccaaccagataacgtgggccaatgcctccaagcccatcttggatattaacacgattgtagacttcaatagaagtagaaagggcaagtcaagggtcaaggtcaagggcaagaagcatgttgtgactgagcagtcttggtcatgctgtgatcatttctgcttctgaaaggtggtttcaggggcttcttcttgcttaagaggacatgctgatctcttgcctcatttgtacactcattctctgtatccctgttcctctcattgtcctacttgatctcactgtgtagtccagactgaccccccaattgttaaccaaggctgtccctgcgctgcttctaccccctaagggcatgagtctgttggggaacagtccacattcaaactgtaactccatgggaagaaatgcggttgctaggagcttggtgtggggctggccatgtatcaactatacttttgattttaagtcttaccagtttcgattgttccacttgacaaatagagtccacactgtaactgtggttatttatttgttaagactgagtaggagggtttaaacaaattacttacccatgcctactgctcagtcacacacagtggagtatcagctaagccctagttaggacttgcttttggtatttggtactttgtttcatagctgagacaaagtatttgacagaggcaaaagaaaggaggaaggatttcttttggctcatggtgtgatggtgtgatgggatgcagtacatcatagtagggtaggggagggatgggatggagtttgtggcagtagagcctgtggctgaggctcctcccatcccaggggaccagagaacagacagctgaggtcagaagcaggggtggtctgtaactttgaaagcttgtccctttgtcactcatagcttccaatttggccctacttccttaaatggcttacagccccccaaccagtaccacaggctgaggaccaaagtacccagacacatgagcctgttgggggacattgtatacttaaaccccagtactgtttttccctctttcctctctcatgccattccttatgtcctttatgggtttctctggatatagagccctttgatattttttttttctgccttcggtactgaaatgaatcagtccctcatattggcccaatcagtgcatcccatcaggaagagaagtgtccattagtggcctcagactcctgccaggattggtgggttacagttagtattgataactggtagcacagctggctgttaaaaaacgttccttatcattgatgactatggacctggagatcaagggaccattgggtttttcctcaaccctagtttcatggctgtctttattccatccattgtttcaatggtcacagggaggagctacttagggccactacccaggacacctgtgcacaggacaataagcactgaaattcatgacctcgtctggatggttgtatgattagagtaaagacagggtagaaggagaccctaggacagaatcctttattatgaagagctaacaggctaaaagcagaatctagagggagggagggagggagggagggagggagannnnnnnnnnnnnnnnnnnnggagggagggagggaacagcttagaatgcaggagtctgtgatactggaaatacagggattgggtagatgagggtgggtagatgtggggagggcagaggggggaaggcagagggggggacaggtggatgtaggggtagaagatactttctcactctcttggcccgaggcacctctccttgtgaggtctttcttgtgcttgactgagaagacaggcagatttaacatcaactgcgggttatcagacctctgtgtgagaaggattctaaggtcaccagggggagtgcttcctgaggcagagatttgtgggattggagtattactgcagtcaaggctgtgcttctgtctctcctgcatccaggatctgttgttcccgggagcccgtttttcatttccagggcagagctgactgttggctctcggcaggacaagtttgcctttggacgatgatgtacagtatctgagcatactgcctgcttagtaaattatccgtggatcactgaaggatggcacactttaaatttgcagctcatgaactttgtggagcatctacagtcctgaatttgcaaagggaatcagctccgaataagcaggaaatgggcctactatgtgccgaggccatggcaccgaaggtcttgaagaatgtctgtacttgacaagaggtaggggctaccttttatgagcacctactgtgtgccaggcctttggcacactgtgataatccttacacagttctatgggaaatctttaataaaagtaggaagactgaggcccaagaaggtgcagggacttgatgtaggatagacacttgtaagtgacagcctagatctgatccaggcatgattgacagcataaatctctcgtttctgttgagtgacaaacgtttagactaaggaaacatttttcagcaaagggctgggtggtaaacattttaggctttggggggacagtacgtttttggggacattacctgtgttcagctttgttacgttagcaccaaagtagccagccattgatactgcgtaaacaagcgagttcagttactgtgcagtaaaactttatgtagtaaaacagatactgggccagactggggctgtcggccagtttgccaagctttgatttagagagtctggccagataatggatgcttggttggcccagatcaacacggacagcgagatttaccctctcactgtaaatggttctcggaagaaatagatctgcacagtggcctaagccgagagatcagtggcctgtgcctgccatccctccactgtcaggaccctgccgggtatttctcccaagcagatgctgcctttgagggcacagggtaggcttctctgtgctcaacacatgagacctgtgatgtaggtaaaagtaagtgaaagaggggtaggaacagcacagtttctgctctctcatccccttcatagaaatttcaattctgaaactaatcatcaatataagaacaccagtgtgtgtatgtgtgtgtgcgggtgtgtgtgtgtgtgtgtgtgtgtgtgtgtgtgcacgggcaaatgtgtgtatgtttgtgaatgagtgtggtgtgtatgtgtgtgtgtgtgtgtgtgtgcacgggcaaatgtgtgtatgtttgtgaatgagtgtggtgtgtgtgtgtgtgtgtgtgtgtgtgtgtgcctgggcttttgtgtgagtgaatgtggtgtgtgtgtgcacgtgcatgtacctgtgtgtgcctatgcttatatgtgaatgaatgtgtggtgttgtgtgtgtgtgtgtgtggatgaatgtgtgttacatgtgtgtacacctatgtgtgtatgcctgtgtttgtgtgtgtatgcgaggaggacatgctcacctgtaatccaaaggctggtgatgtccaatgtcagtgtttctccatcatctggaatgcactgatgtgtctttgctgtcgcccagcaggctccagggatccacctgtctctctgtctccccagtgctggggctgtagacatgtgtcacctagcttttgatgtggctgttggtgaactgagcttgtgtccttacttgttcatggcaagccccttgtcaactaagccacctccttggtccctcttttgtttgtttgtttgtttgttttttctgcttccaataatacattccccttaattttggagtctttctgtttatccggcaataactctcttggcttcctgctggagctagtacaggctttcacaccagaaaagattgttcctctattattataaaaatttaaatttcccaataattctcacacatatattcttccagaaaaaaaaaatatttagcacaattcagccaagtggtgtgttccttcagaatcctgcctggactttgattagatctgcattggacttgaagattactttagagaccacgggcatctttagaatgttgagacatataaataagtcgtgcttcattttgagacagggtttcgtgtagtccggtctgggttttgaacttactggggatgaccctgaacttctgaccaaatgctgtccccagtgctgccacacctgttttttgcaggatggaaacccaagctccatgtcttgctaggcacacacttcaggctttcaatacatccctgtcgtagcacgagaccgtatgtttgcctttgctcacatcccttgtgtgatgtctcggcaagttcgagtgtcttctcttagcttttgcgcacctcgtgtttgtttctcttgtatggggaactaactgtttctagtatgttttctagtcggctcttgctgatttaaaactatgtgctctaaggggcccagtgggcacagtgcttgctctgcacattcgcatgagtttctagcatccatacagaaagggtaacacggtaatagatagtatgtacctttaatcccagcactggggagctggagacagagcaacagccaaactgataagctccagactcatcgagcgatcctgcctaaaaaatatggatgtatggatgggaagtggttgagttggacacctcatgttggcctctagactcaaatgtgcacctgtacattgattcatacctgcatacacatgtacacacatacacagtacacacacatgcataccccccccacatgcacacacatacaaacaaacataacattttaagcatctattttatatctggatccagcactaagattcttttattaatcatgctcttgaacactaagataaatgattaacgtcctctgtaaaaagcaacttgccttttcctttaaaaaaagttacagtaatttggttttgattatttagcttcttttagaaattccaggataaggttaagtaatagtgataatagcagacaattttttctgattcaattacagtacttcttgaattacattaattataacggctatttcttcaatatacacaatgtgtaccatgtagtgagcgggcattccaattacttttattgttatttattttttaattatgggactaaatgttgagatcatcatgtagttttacccccactgacatattttacttttacagatgtgtaagtaaattttcaaatattaagccatcattgtaatcaacttaaattggctttttatttcttcaatacagtagttgatttgatttgctagcattgggcacagcttctcaatccgtcatcagaaccatgtttatgattggggctccatttgaatcttgggaaggtgctgtgatgaattcattgtgtgtattatgtaataaccatatgggagtctgctaacattcccccttccttaaatatgctagtatctatgcaaccagatacacaaatgcaaagtgaaatcagagcatagacaccatgaacaggctcaaagtggggatggccacagaggcttacgtcagactttctagtttctagtttgtagtggtgggctccctcccagaggctcttaaaataagaggtcatgctgactaattcagaactgtgcccaggagaagtggaccaacggctagaagaatccaggagaataagagttcaagaattgtcccagggagtgagtctagcttaggtgcatgaatgaggtaggtggctcttcatagctgcctgctctggacaaggaagctggactatttataccccagcccctcagcagtcaatgtgcccagtagcagtgagggctgtgtggggaggcgggttacactgatagtataggccactcccacagtgtgagttgtggaaagagcagagcgcagaacctttgggcattcagaatctggataagagcttatattttttttttgctctgaaactctccaaatgaagagagactgttgctttcttctgttccctgctgttcggcaactggcctttgccagcaccttgagatgtcagggttctctttctctgtcgctctcttggttggggagtggctcagagcacctcagaattgactttacttatttctgtaaaacaagcaagcaaacaaacaaacaaacaaacaccaaaacacaaacaagccctgcttttcattaggacctggtatattccttacagattttcataaaatttgagtaacacataagagatggagttacatattttttctccttttcagcgattcaaaggaaagctattgcttaattagtggctgctttactagttcctggtccacaatagatgctcaaacactggctgaatggaaggatgaatgggtgttgctggtttattgctccagttttatgaaattgatttttttctcctttgcaagagggttagttctatggttttatttttaaagaatcatctatcacatttatctgtactattttgatttaaaatttctaattaattaaacacttcctgaatgttattcattttcttctgatatatatacatatacatacatatatatacacatacacacacacacacatatatatatatatatatatatacatacatacatacacacacacacacgtgtgtgtgtgtgtgtgtgtatactttctagcttgtatttttaaggatttatttgaagtctgtcaccatgtggttatgtgcacactagtgcaggtacccatggaggccagcagagggcagcagatcccacggagatgtagctatggggcattctgagctctctcaatccctttatatatgttataaacctacaggttgattagtaagttttttttttacttttcttttggtttaaaaaaaaaaaaccctcaatatatattcagctttggttgcatctctaaagtctgaaatggtagtctggttcccccccccccttctaattattctatagtttgtttgtttatttcctcctcaatgcaccaagccagtgcattgttttctagttcttgagtggtgtgagttttaaaacctcgacctttcatacgcaatgtcaaatttattacattgtgatcatagactatgacctgtatgatttaattaggaggatttatttttgtttagttcttataaattctaaaaaataaaaagcaggatttttttcttcctttcctctctggcttttaccccatacctcatacagtttaatgagagatttgagaacttggccttctcaccagcattcagtagaggatttaattatttcatgggtcaggtccttcttagagtgtgaccctataaaaataacatgtgatcgatatgaccagctcaggcaatttcataacacagattagaacattaaatgtagtgtgtagtctttgactctgttgactcgggaggaatcatcccacaaggaactgttcttacgagcccctttcatctacccacttaggatccgtccccttactggcagggccagtctttggttctcagacagtagtagctattacttttgtagactgccaatttagaggtagatcaattgcatatttaccaagacagacccttccattttccatacaggagcatacatattaaatcattgcattatggttatggtgtgagactgagtttcaatataggtggtttttctggacttttccgaaactgggctgcatcctgcagtcactgtggaagagagacttgacagggatagtaattaaccttgtgcaaggttaaactgatctgagatgctttgcatttgatctccagacttccatagcccaggcacacctaaaactgcctcagccctcagctgttatctttgatcatcgggcgtttgaacagcacccctgtctcttatttctaccagcttacaacattgctgcgaagaaaagatgagagtggattgaataaacccattgtcctctacaacagaggccagaaaagagcatcctggtaggtaaatagcacagcagcatgtccaaattgccaacatttttataaataaagttttattgagtactgccacacccatgtttttgctccacacctgcatcttgtgctagaaaggcaacattgagcagtttctcgggaggccacagggccacacattttgcaatatttattctcttatcttctatggaaacagcttgtgactcctgatgcagaaaggcagcatcaagacagaaagttaacacaaacccagctgttctgtgctagcccagagatccatgtgttcttagtacagtaagtccttttcctggatagattttaggccttatgtgttcttgctgaccctgtcagctcacaggttcacaggtttgcctgcgagctgactgcagtgatctgtactgctgggccccagtacctaagaactcttgaggagtgagttggtgttaggcacaccgacgacaagctggaagggcagcaaccaagaggacatgtggggaggaaggatcataaataagtacagatgagctttgggtctgtagagcggaggtggggaaactgagtttgggcaaacatgagaaggggaacacgagtgtcttggtctctcacattcctctaaatatttacagcatcaaacatcttcattcaactgttttgggatttcagccgtagggggttctgtctcctttgggtctctgaaccctgaggcagtttctaaagtcttcgtttaacttaagatctttttgtaattagggaagctataacatctaagctttatataatctcagcttctggaaaacccctttgtgcttggaggacggtgtgggtagcgatgggagggcaagctctcccgttgtctttgacagcccacaccaggcctttctgtgctccctggtctgcctggagccccccaggacacatctagaaagtactgtcatggcaatcctgagctgggctcagttcctagtttgccatccgtccccatctcttcaacgtgtgcctgatgggggccactgcttttctccccattgccccaactgttgtgtggcccaagctgcatgctaaaagtctgtatactctagccctgaaattctgtggtcatgtgactgtttactgggacaatatccactgtcagctgagtttgctagaaacatgggtttcttttaaaatggggacacagccaaggatgtggcctccaggacagagaccattgctcggattctctttatctagccctttggctggagcaattgaattaccgactgagccccagtctccccttctgtaaaaggagcagaggtgctcttttccacattgccgaaaggatgtgaagacagcatagggagaacctacaggtgctcccatgcagaggctcctgggtcagctgtcgatttcaaccctggctgcctcaggtgctaaatgacccctagactgcttaatctttgcttcgttgttttctgtagcctttgatgccctggccccttcttgctagcatctaactccattttcttttcttatgtgtacttcatctgttggactccttgtaagtttgggggtgataaaattaccttattaatcattcctttgtaaatactactgtgaaacaaggggatattgcttccactcatcttttcattattatggtaataactttcaatttataactaattaacgttgctcctttctaacccggccttcattacaggcagccagtgaggaacccagaagttgatgcacagcaagcaggagtcctgctgctccctgcactgagggataatctctcgaaggccttcatttttagattacaggtggtgagagacttctttccatctgcttatgtctggggctcaggggtggttgtccatctcctgccatgggactggctggtgtgactgagtctgcggagagagaaggcagccggcaggagataatcagagactacaccttgggaagagcaggagatgcccagagatattctaaaaacaaatactcaaaggagcatagatactgtcttgagaatgatgctcccaggacctggatttgttctcttgagtccccagggagagatccaggagatatgggcaggagtctgaaggaggcagtgtaagggatgtgcttgctcctgtgacagtcacagctcctggagtagagcaatccttctaaggaggtctcaatcgctattcccccctcccttgagatacattcaagttccttcaggtttaaacccctgcggcttggtgtcgtttatagataggaagtcattcagcagaacttctaggccccctgaaattctgtgttgcacaccgtgtgtttccattgtggagaaactggctagaacgggtgttagacgtttagcctagctaccctgtgatgtcaggtagtgttactagatagaccaacagcatcgttctgctgcaggctgatgtagaccaccgaactgagaagacttggcaaataaagggtggggtggggtggggtggggtgggaggagaggccttaatgacatgcacagatcctctttgatctcaggcatgaagcagagagtaccaaccccctcctgctccacccggggctgagataagagactccagttcccctgtggacttttctggaatgagactcattagctttcctctgtttatgaagtgaacataaacacatacaaaaatggtttcctttctcccttctggattaattatgtgtatttactcctcttggattaattaggtttatttgctacttttttttttttcaataagaagatttgggacagtgggtgaagggcacagagaaagtggatattgttgaagctttgatacccttcccagggtccctaagcagcccttccttcgtaccctgtccaatagaattggctccggtgatcgaggtagtccacatcggatctgcacaataggcaggcactgcagccactgagctcatgagatcacggagcgcgtgccagtgcggtggagcgggtcgactttttagttgtatttcactcggcattgaagggattcagagagaaagaacagaagttgagtcaaaccattcccaagcacagaggagaagaattacattgggaaggaagcatctggaggggcttggacgtagccagcgctcataccatgtgcctgggggtaactggcccatcgtgccgcaactctcaggtcacatcctgtcaggtcttcaccaagtttgcccccaagatgatcctacccatggtcagtggctggtgtcggcttgcttgttcagaggcaggtcttcagaacgcagaggcatagttttctgagaacgcatgaatagccactcgggagtcttttcttcaaggagaaaaggggtcttttggttgggccgtcttacaatggggccccggtactgggatatttaggccttttgaagttacacagcaatgcatgagggggaaactattcattattcttttgactgtctggcaaaatgtctgaaagaagcaacttaaaaacagaaagatttatcatcccgtagttttagggcatttcagcctatcgagggagacatggaagcaggggtagctccgtccgtggtgtgaatgaggtggctggtcacacatggtggcttgtgtggaactagagagcattagctccgagtcagggctggacatcacctccccccccccatttctgtcaggcaggctccaccctctgaaagccccatccataaccttcccaaactccaccacctagcagctaagtgttcaaacacaagggtgcgtgcgtgtgtgtgtgtgtgtgtgtgtgtgtgtgtgtgtgtgtgtgtgtgtttatttgtgtgtgtgtctgtgtatgtgtgtatctgtgtgtggacatttcacatcagaccatatcagacactactgaggccaaggtcattctgcccctttggtcacataatggacgttagtcgagcatccattttctcatcaacaactgtagaacctagaccaatggactgtgtacatgaattagttagctgggaggctggaacaaagtactgtagacccgacatttataaacaatgaacacgtactggtcacagtcctggaagctgagaaatccaaaaggaaggctcccacagacagcgtctggtaaggtggctgctgtctgcttcaaagatcgcactgcttcactgtgacctccggtggcgggagggcgagggagtgtacctgagtttgttgggagcagagctcttgtgcctcatgcctactagatcatactggtaattggctgttacatatagcctttcttctttccttttttgaggacgctggagttttcactacagttacatgtagtgaaaaagaggatcaaataatgggaagttatttagcacacagtgtgacttgcaataaatattcatcaagtgctatatactgttgtcccctgtgcaagtgtgtgttgaatggctattgtcacctctttctcagatccacattcctgcccactcctctgcacagaagccaccatttcctcttcatagtcaccgagtaaagagagtctcttggatatgacttttcaggctctttctaaccaacccttatggaactttcgggaacaattctatcactgtctctatcctaagctttatcaatgatgaatagagctgtgctcctgttattgattatgctgtgcatgtacgtgtgtttatttgtgtatgtgcttatagggtgtgtgtgtgtgtgtgtgtgtgtgtgtgtgtgtgtgtgtgtgtatgtatgtatgtatgtatgtatatatgtaggtattgtatatgtgtaccctatgctggcttcttgtcgtagtctcctgagtgttgagattataagcatttattaccacacctgacaggttttgtgtttttttttttttttgtctttctttttttaaacccagatgtcttttctccccttttaacgactggaacacccactcctgtctttatgctgaatgatccccacccccaaccctggtattcctttcaaatccagctctcatgttaaccttatttatttatggaattttgtaactgattggcaactcttatacaatcagttcctcctctgttagaggtagtagagagtttgtcttcccccaagcacctggcccctgttatacttgaacttgctacagggtatcaaagtgaatgcaagccacacggctgtcctttagcatgtgtttctctgatctgtatctccactcatcttactggctgtcacagagtaaatactcagctctcaataggttcttaattcttagcagtaggctcatgataaatattagaggaagaggagaaagacaaaagggtaaattgctttagcaggatatattagattatgtatcccttataaatgatcttcattaagcaagctcccatatctcagtaagttaccacagaaccccatgtcccaactacacatcacataaagctgtggctttactctgtgcagctgtcaatctagtactcagacccgccatgggagatggagaatctgtgataggcaggtgctggatctccagacctctcgtctggaaatgacaacggtctattcagtggtctaaaacgagtcacatagccactgctaagctcggagtgttaggtcatattcttctcatcaggaaggctgtcagaacccacgaggcctgagcttctacttcctcaacaaggagtctttctccatggactaccctaaatcaaaaggtcaaacatgttgttagtacgtcttagatgggtataaacccttataattacaatgccttgagaaacaatgaacaataccacaaacttaaagattatagatgagtggccccagtctaaccacccagggaattttgcagggcagttttcaggaaatacatccatttaaggaggagcatccctagccactgggtttctggatactgctgttcttcactgtgaggcagactctgtgctgctgatgctggtgatgaaaaccaaagcatttccaaccatgacggccccttggtggcctgtacgcaggacttctctgtatcccacaagcagccagtagaccatggagacacttgatggacggcttactcccttgtaatttctgggcctgtaactgtttggagctgtcagggccagacagcatgactactataccatcatggctgtgaaaaatgtnnnnnnnnnnnnnnnnnnnnacttgttccagtcagtcactagatggaataaatcatgggggtagggagggggacagagaatccgggtggcaagacagatcttgtgatttggagatgctatgcaaaggttgagacactgcggtcactgaggagattctgacagaatcatgtcttttcaatccttcccaggcgggacctgaagaggtgtgtgtgtgtgtgtgtgtgtgtgtgtgtgtgtgtgtgagagagagagagagagagagagagaaagagatatgactgagaagtctgatccaatattcccatatgtgcaggccagttttatgttagactttgacataagctaaagttatctgagggggcggcaattaagaaaatatctctataagatcaggctgttagcaaacctatagggcatttccttaatcagtgatttatgtgggaggacccagcccattgtgggtgacactactcctgggctggtggtcctgggttctataagaaagcagactgagaaatccatgaggagtaagccagtaagcagccctcctgcatgggctctgcatcagctcctgcctccaggttccttccctgtttgagttcctctcctgacttcctttgttgataaacagtgatgtggaagtctagttagtccctttcctccacaagttgctttttggctgtggtgtagccctgactgggattccatgacatcctgacctatgccatcccagtcttatggcttccagacccatgttgtctggagcatctctccttccatcctctgcctctttcttgttctgtcttgctcatggtgttagctttgtctctcagcccatttctcatcctgctcccacattaagcacttgctactccttaggcactgggatcagatctgagtcactctgacattagtctctccgatctatcctgggctgcaggctgtaggatgctcaggacaaaggaaggaaatcatgttgtctctctgggtactgtagttctgctcattggtgctcttggggaagacttgtgaccccagatggtctcctctgaaatagggccctgaagactaattctaatatgctaatgtcatactaaaattgggtcactgctgtagcattcaattctttcttgaaaaattagggtaacttggggtaaatatcatgcaagacattgggggtttctagaaccaagttgaatgaaagggatacttttatctatgacatttcagggaagttggaggcagggaaggaaccttgttcattaacaaggaaatgttgctgtgaaccaatttcaaagggcaaagcaagaccaaaggtaaactcttagaagggatgctcctgtcttacaaagtaggaggggcctagtgtcaaccatggattggagatagcagctcataactcagaatagaattaaggctaatgtaaattgtcaacaaaagtatgtcacatatccctctacaagggaacaaggtttcaggatctctgttaggattttattgctatgaggagacaccttgaccatggcagctcttaaaaaggaaaacattttggggctggtttacagtttaggggctcagtccattatcatcacagcaggaaacatggtggcatgcagagagacagggtgctgaggaggtacctgagagttctacatctggatctacaggctgcagtcagggaaagtcactttagcctggttggaacatcggagtcctcaaggtctgcccccagaggcacatttcctccaacaaggccataccttcttcaacaaggccacacctcctatgggcctatagggaccattttcttccaaaccaccacagtgtcccagggtgcacagggcaggctactatcactgaccagatgagggagggcactagtgagaagaaacagaaaaaaacaaaacaaaacaaaacaacaacaaaaagacaactttttatttatgaaactgctctatttcaaagcatttttgttgatatttttaagttataaaataccttttttttaaaattaagaatcaaactcacttgaggagagaggtggttattctgtgagtccccagccaactggacagtgtacgcctacattgagggtcatcttctcctctaagtcctcttgttcaaacacccatctactctagaaactccctcaatcatatacctgaggcagccagatattctacctgatgccaagccacctgggttttgttttcagaggaaaagacagacccagtcctattgagcccccataataattctttgactgcctcccttcctccctctctctctccctgctttcttctcttccccctttctttcccatcctccctccctccattctccctctctctcttcctccctccctctctccctccttccttccctcccccctccctccctcctttcctttctgacaaggtttcatgtagcccaggctggctttgcccttgctgtgtagctaaggatggcctttggctcccagtcctcctgtctgcatgccctgggtactgagactataaatcctggccataatctaagtttctaacaaacacctttgatacagcccacttcattttttttaattgacagtgttgtattctgttacctttgttcagtgatgtttgatcaggactagctgtagcatagtgagaatacgtctagtgtatctatctctcttagcaatgtcattttgaataactccatgcctctgtttttttttttttttttttgtatttctgcagagcacattcctaataagagactcaatgtttcaagaagattgtgcatttagaattgtaataaatatcagcatatttctctgttgagggataaagccacttccattctaatttttaagttcttgtgctcttggaagaaaacaatgggtatatttacctttgccagcctatatcttggaaatatgctaagttttttaatgtaaaattatgaggtttgttctcacagttattgttaatttgttttgaatagaaacatttctgtaattttcttcaagtcctttgtctatattttctcttggcttgctttagtttttgttgatttatagatactctttacattttaaggatactcattcatgttttgtcatacaaattgcccattttagccatttgtcttttagaattattgatgacatatttagtaatacaagaattccattttgttttgtgaaatcaacttttccctgcatgaattttgtgccatattctgaatggttccccatcattttcctttgcactctgttagaggtgttattttttcttttcacatttaattactcaatctgtttgtagctggttctgagtgtggtgtaacttatgggccttacttagacctgaatcatttcaccactgtaaatgttttcttctgaagaaggatgaacgtggagcccctgacttgtctttatctcgtacttcccagggtatgtgagaattatttcactctttacatttgtaaaatagtagaaggaaagaacttgggcagcttctttagatccatttgtgtcttacatgttccataggtggatcaggctatgagctcttgggcagatctgccaactctcctgttccttcattaggaaggatgtatgtatagaggccagaagttgttattggcattttcctctattgatcttcatctactgagacagggtatctcattgaatccagaacttgccactttggccagtaagtccctaggatctgtccatctcggttcccagtgctggctttacagattcttgctgccccacatgactctcttacgttggttctgggaacctgaacccacatcctcatccttaatcagcaggcactttacccacggagccatctttcaaccctcttttgtttttggagcatttttgtgtgtacattttgtcaacctttctgattttggtctagtcttcaggcgtgttctcctaatcatgtgtctccacagaaatgtgctggcagctgtgacatgtgagttgcatatctagaggggtctggtgcaatatagtcccacttattggtgagaaagcctagcactgggaagggataccacttgccagaggtgcttacctgtggcagagcctggagtctggcccaggaactctgactgtacagtttacactcacttctttaaggttgggggttggctagaccatagcccgtggcatagagacaagccagagtgcttactgagtgtatctgctcacaccccaagtgctcccattcaggtccttctgatttgggtctttttcttgttatagacatgtaccacaggaaattgagtattcattatcgtcaccccaaggaccaacagaaagaatagacataggacatctgaacacccatgttctatcaactgtatctccagctgtgaaaagtgaggcactgtgagctgcgtaccttgcagcccctgaggcagagctgaggtgtgaccttggctctgtctgattttgaatctttttgttcctctgtctgctaagaagcaagtactctgggttttagtggacacattgacaaacgtgtctcatagggtaccaagttcctttgtgacggcgtcagagcaggccagccagaggaaaggcctgcaggcttcagaagaggattctgtggtcacagtggcgattgtaagggattcaatgaaacatgcataccatgagagtctacgattaaaatatacgaatgggtcctttccctttaaagtattgcatgccctctgatttataggaaaatgcttcaaaatgcttatctggaccccccaatcccacattccttataccatttgacatgcaaagtgtcatattcaaaagcaaattagtctgaaatgaatcctcttttaccctttttaaaaaaattttttcaaaatccagatttagaatttaggctcattaatatgcacaaacactactcgattaagccagttttaatttctctgtgtgctttgtaaacagggattacaaagatgtttgaattttcatggcagattttggagtagtgtatacatttgggccattatcacataataaataaataaccccctcgaatcagggagttggtgatgtcatcctcggaatgttgatttttcctctcctcatctggtcctatgaatatgtgtctttggtctcagaaagcacttttctgaatctggctgcaatacagcctcctgtccctgggtcctcacttggtgcgcttgcatcctccagccttagctcgtggggattgaagcctccacttggctttgtgaaactggacttggaaaaacaccccgtttattaaatctcgcactaaacgctgacagttgtaggcattagttcttcctggtgtctgccaagtgagctggaagagtaggcttatcttgttatatgcagatcgcacagtgacagattctcagagcttgattccagccatcagagcgaatggccaagactcatgtcagagaagtgccctggggaagcacggccctccaggggagctcagtttccaaacatggagacaagatgcacttttcccatgatgcaccctggcactggctttttaattgttatctatgcatggggattcttgagagaaacaagtgtgtcaagttggtaggagagaaaaatgatacatggggtgctaaaaaataagttcggcattcgccttctttaatctccacaacaaccccttgagatgctgtgccattttcttgcctgtgccatcgataagaacaagaaccattggggacttaccaaaggttgcaaggccacagagagctccaacctagttttgtctgccctgatttcatcttcccatcttctctcttgctcttgcattcccaatatttgttgagtgactgactgactgaaccccaagtgaaatcagttgactcccctccctttcttatgacacctgtgcggccatgagtttttggtgtctgggagactccctacaggttgtacaggtagcacaaaattctctaactaggtgcccccttcccagatttgtcccctccaccctgcttttgccttagttcttctattttctcttcttgcttatttattttttactcccccaaaggcagactccaagtttgatctgtcccactgtttgagctatctcttgggtctagcacagcctctgggcacgttgaaggtggtaagttttgttttcttggacttgctcattagcaggttgctcacggtgagtcacacaagtccattccaccagagatcatttcaaagggctcttcactttgaggtaaaaaatgcagccccaatacatcatgatgttaggtgtccccactaggctagggtgcatcctcttgaccaggtcccacctcagggtgtgtgtgtgtgtgtgggggggtatcatctctgagtggggaaaggtggagatttcaggggtcaaggatgattgtaccttgtgtccagatcatctgtagcaacacatgccctgggagtgagttaggaaagaatgaagaagtcttctttggatggcaatagtggaagaaagactaacactgcctgatgcagcctcatgggacgactcctcagaaggtgactcatggaaggcagtgctctgggatgaggaaagtgggggcagggaggggcagaaagtgaagcaagaatgtggcctcggctggagacagtgacctccagcttgcccctgaaatccctggtgtatgaattccagaacagagctgctgcttcctaaaagtgagaagccgtttgccctcagagtcactgaaccattagctcttagatatctccatggagaagggtttgtgggagcttccaagtggttgatgctttgggttggctgagggcagttctctggttcttgtggccactctgagccccagcacccagagctgaggtggaacacaacagaccagtacagggatcaggcaagtcctccctaacatcacatctacctctatggttttggataagtttgctgagtagtgcctccccttcatcccacccctcatctcttcttctcttcctcctccccctcttcttcctcctctgcctcctcctttcctcctcctcctctttttcctctttgacaaaatgtatataataatattgacactttacctttcaaattttatttatttttattttatatgtgtggaagttttgcttgtgtgtatgtctgtctacatgtgtgcagtgccacacgtggaggccagaaaagaagacatgccagctctaagaactggagttagagggagttgtgaaccaccatgttgagtgctagaattcaagttcagattctcctcaagagcagccagagctcttgagtgctgagctgtctccccagcacctactcatttttaagtgttcaataggtggcataagggacactctcattgttgtgaatccatctgcaacacctatttactgaccatttttctcgtcttaaaactaaatctctccaccaaatgaaaattctaattcctggttccttctgcaccaactaccattctccatcaatttgatgttctagctacatcatcaaaatggaactttctgctacttgtccttttgtaattgcttccttctctttttaatgtcttcaggatatatcctattgtagactacatgaaatttcccttctttgtgtgtttcactttgcttactgaaccatccgtggacatttggattgcttccaacttgggctattatgaataacactatccacagggatatacaaatacccatagttgtctcttgtttcatgctgaggtgcacagaagtcttggggtttcaatatggaagattctgggtcatttgagcatccttattgaaagcactaacttcactttgttatcactgtctaacgcggtggcttcagcagaggtgggaggggctttgcatttcatgaaggaagactgctggttgggggaaatcatcatctttgggaagtatttatagaaattgagttgaatttaaattttttttcatttaaaatacataaagggaagaaatttatggtctttgaggttgcaaaagcgctgtctaccctctgcttcagcgggctcattgcttagggcactttctaggtgactatgctttcctatccagtcaatgtcactctctgtagcctgcccgatgcttagtagtgtgaccgagactgtcgttgagttggccagctgattctgaataaatgaattggtaagtcaatgaatgagtacagggggagacagaggccatataccttgagcttgagccagtgtaatacagcttactgatttgccttcaagaataagtaaaggacatttccctaaggaagggagccatgcttcctcagtttctcagtactggggagaaggcacctcaaggtgtcaggacagcaaatttgtttcttgtctctctgccttgatacacaaggacaacagaaacgcaattcttactttctctccctggggacttttgaagctgcttcgaatggaatattccgagctctttaatctcttaggaagaaaggagttttatgaggataatcacacactgtccttgggacatcagcacctgcacggtacccatggctagtgggggcattggttttgaagagtgctttttgctgttgtccttttttatttaccaggcaagtgttgcatttgtgcagatctgtattcctagctggaacaaggtatttataaacaaagttctctaacaccatcatgactggggtgatagtgatggtggttcatagtcagagcagcagccaaaatgcattcctattactaaatttcagattctatgctcagtgctttcccccaccccacccccagctctcatgacaccataaggctggtgttatcaaagagtcaactgtaaagacgggacactgaggtccagagaggtcacatgattgcagctacatcatttagtggataaaaagcagagctttacagaaatgattgccttgtggtacctgaggataatattctccctaataaaagtgtaagttgagttctaatcaactatcagaaaaaggggtgggtttccagtggatcgtatttaagagggagctttagtgaagggaagcattggttgaccttgaagggttagaggactgtggattgatggggagatggtaagctgtgagtggcagtatcctttcaagattcatatgtaactgggtagagtgaagggcaaatagtgggtaacaaaggacagcatgtgcagaaagagagggtgggactaaataatggagaatgtaagtgctacttttctgccaccaccgatggccaaagggcacatttggaaaatggtgactggaattaggagctaagcccatagacagaaagtatgacagtgactcttcttaaaggagaagaccccgatgcttccctctagttctctgttatcaaaggaacaaatgaagaaacccatcagtcaccatttggtaataacagatgacagaatgtgaattcctgactttggaatgtgcatccccagagccctggatcggctcagatatgattgaagactctatcagaggaatgagagaggatcatggcttcctgtaggcagatagagggtttggctgtccactaaaggtctgattgatggatgggacagagggattaccaaggaacaatctaggtagtgtgtacaaggagcctgaagtcaaattatcagcatagtagttttcttcaggaagttctttggaatgttcttttttgtgcctccacctttgcccatggtgcttgatggagatctttcttgatactcgtctcatagatacatttctccaattttcttcttcaccatgcatctctggctattccttgagggtctgtggatttgtgtaaggtccacctcaatctagtctgaccttattttcactaaaataacaacacgtgcaaaattctttccaaataatacagcattctaagattctaggtggtgaattgttttcattctgggatgctcgctgacttagtccacactatataagcaagagccagaggaagacgtgtgggtacaaggtcttagagatggtttggatgatttgctcagcagagagaactcagctgggtgagtgtgaacacggggctcttgctcaagagcctgctggagacctaaccatctgggatctgaatgatgtatctgagttttaccccctgaggaatctggagtctgtggcagagagtgactgacaatgggggctaagacaatggggggaggggtaagggggagtagtgatagcctaggtcagttggaaagagctcatgacttaggtgactatggtctgagttagggtggaacagttgttctggggaagagaaggggacattttaaaaatttgtatttgcttttattttatgtgtatgaatgtttggcctgcatgcatgtatgtgtatgtgccctgtgtacatgtctgatgtccacagaagtcaggagacactgttggatcccatggaagtagagctatggacagttgtgagctgccctgtgggtgctgggaaccaaacctgggccctttgccagagcagcaaatgcttttaaccacttatctcatcaggccggatggatgtattttaagagaaagacagtagcagacctggtgagagatgggttgtggcaataagggagaatgaacttttgaacttgggtgaatctaatgctgaaaggggaagagaaacatttatggagaacaacagttcttcctcggacaggatgagctggggctgtttctgggaaggcaaactgtagacatccatcagcctgctggaaactcactgctgcagcttgctggctccttcgggtgctgttgcaggaaatctgaagcaatggatactgaagtgtgagtagtccctgcttttttgagggggtcagattctcaagagtttgtgtaaatgtcgccatagtctagattccttgtggttgtcatgtgtcataccagaagccaacatagcagaaggatctttctggaacacaaacctgaggatatctcagggtacactgtcctatgatgtgccctcagggagtggtcttcactgatctcatggtagaatgctgctcaattgagcttcctgacaaggttgctcaaaacccagaacatgtcttagattatactcacttcaacttctctgatccttctacagtatgaagaacatgcctgcatgcctgaacatgcaccccccccccacacacacatgtgcacatgcatgcatgtactcatacatgtgtacctacacacacacacacatgagtgcagactcacaatctaccccctcaatgtgaagaatgggcccaatgtcccctctcatgtttataatttgtacctgacacttctctttcctggaatcatatttataatttgtacctgacacttctctttcctggaatctcttctttgcttccatttccctagtctttcaacttcccagttcaacaccaaatgatctgtaacactccaagtaaaatgtgtttattgagaagccatttccccaaacctgtttcctctccaagaactggggcatccatataccactatcttctcctagaaagctggccatgtgataggtataaaggagccatccacttcccaagactgcatgggaaggagatgaagaaagagaaatggatggctgggtggtgctatgtacaccgtgagaattcagctgcaagaccacacttccagcaggagaggtgtcacaatgcctgctcacccttcctcaacttctctgatctctcaacaacaaaccaacttaggcttctaccagagtttgtcccagggaaccaatgagttttggtcttacttccagagcatgaggggccctaaaatagctgtactgtctgaggccagcatgaatgacgaatggacggcaggttcccagtggctgcatagatggagactccttcagttaaccttccccagttgagggattctctgcaggtgtcaacacagccagtgatccacaaagaggggagacttgaacagacatctttttactccaggtaggcatcagtgacagaccagagcagagattccactcaaatctgtcctggtgaatctactagtgattcggaagcagggatgactgagagagccctacctcttaccacagaaaggcgcaactgaagctggttggtttaatcaccagcaatcatttactgctttaaaagcttggaaaagggacttgtgaatcttgacactcgtatgaacattttaatcctttcaggattcaggaggctcattgtcttatgagctgccctccgggagagaccatttgaacacaggaaataatattgccatgaccattgaggaaagagaaacaaactggactgtaatttggccaagacctcagagctccacagcatagatgacagctcaggtaacagctctcatgctaagtacatctttgagctgaggcaaccaagggtttgaaacggggtcacagtctgacttctcctatatttgagataggaagtgtggtcatggttgggagcctgataggtgatatgcccatgataacaagcactgtggtaacacttatgggagatgatctctgggtagtggggtttggttttaagaggtccccgaagtctatagaattctgtctagacattttccaaacaggggtccaatcaggcagttctgtggtattcagttggataagcaaacgtcttaacgagaaatattagtgtttctagatctttatctcgatcataacatttgctacagtggctttaatttacatatcaaagtcactgaaagtaaaatgataaataacgcatgaaggcaaaaatggctaaagatagtaaaataataaaatgtgatgctgcttgcatttaaatgcagaagtcaggatttctttccagagaaccattgaaatcaaatatgtgtttctaaggtaaaaaatcagaatcaacaaaattctgtactttctgtgatcttacagttcccttgaaagccttcaccttgccaaaggaaagaatagaactgtgtagctaacagacagctttcctatcttctctgctgggtacttagtttttaattaagtgttgacgatcttgcagatctactctaaccccttgattggcttggccatctctggagttttcatccatgttctctccctctctttcttgactcctctttcccccatttttgatttcagattgcttcgattgtcctggtaagatttacccggagtccaattcacactggttttgctggtagtcttgaattagaatgagatactattctggtgaccccttggtagcttcatacttcccgtggtctagcgatttctccgtagaatccaaatgacaccaccagcccctgcttcacagcttttctcgggagataagtttaaatcagcttatcatatccgcttatgcaccgaggcgcgagacatctcagcaagcctgcgtttctgcttcggggccccacgggctactgcagatcagtgacctacaggaaccacatgacttcagttccctttgagagaagtgacaacaggtgacttcacgcaccagattttgcattcgtgaagagagacaaagatttaataaatgctttccgtagcatttcatagtatagcctgctgaagtggcccaatggggcttgatggtgcggtcacattcaaggggaagttgaatgggagacacagaagcaaaggggtagagagggaagcgcacagggctgggcggaggacagtggtcctggagagtgtgaggcgaagcacccctattgatgattttaccttaggttttgggaatcagaataaattatcatatgctattactatgcaggatgaaatgatctcattttgactagagcaatcttccttgattaggttcagccactctgcttcatttccagatgtattgggaaataaaagttttctttctcctgagacataaaagcttatgctctcgggaaacagtaatctgatttttccttaatttaaaaaaatggtatgtattctgtatttccattttataactgtatcttttttatcaatgtcaaaattagaaaaaatatgttattggaaaacgtagggaatatgtaggaaaaaaatcatgactcctatccttagagtatttctattttgcatatggaattaaaatgtcattttaataaattggggtctaagtatgcattaagtttctacccctcttttaaaaattgaccacgttatcatatacatttttatttgacgattccattctcgttattaacttgtttaaatgtctccctctgattgtgtataaaggtcatttgtcacttttgctattggaagaatgttataatgctaagtttaggaaatgaatctctgcatttttctgtgattaattttgtaggtcagagtcccatagatagactaagaatatttctttaattatgttttatggttcctattgcacatataaaaatgactatgaatatttctttaatgatgttttatggttcctcttgcactggttcacacttttatccatttgtaggttttttgttattgttgttgttttgttttttgcttttttgtattgagcaacatttatatgtactaggcagggctggatcagagttagatttgagcaagccctgcagaggaggatacagagagtgggcatgtaaacaaatgattccaattggaatgtcagcccaacctttcattgctgaactgtttgctgtgtatagattcagggactgagtaagtcactgctttcagttgtgtacccaccaaggaggccaccaagctccagggcacacttccaaggtggtgatgacacaggtggtactgcttgtactaatggggtcacaaaacaaaagtcatgagccttggaaaaaggggtggtggtggtagggaggggaaggcgataagagagagtgttggagagagtaatcgatatattttatacaataacagtaatttttaaaatggggagtggaggtgggggatgggaagggtatagcctgttcctttccttattgtaacgagtcctgcagaagataagtgacagtcagtaatatctaccagggccagttagtggagcctcactgagggagagattgtgaagctgagattttaaggatgaaaggcttgctctatatgaaatgaggaaaagaacattccaaagagagaagagcagcaaggggagtgcagaggcactgggggcggggcagagcttggattgttctaggaactgtgggtgtgtagggaaaaagagtgaagcaggaactgtgcatcgccatgcacgactgtgtgagaggtgtgtgtgcatgtgtgagcatgtgtgcacatgtactgtgactgtgtacatgtgtgtgtgtgcctgcatgcattcgtgtatgtgtgtttgtgtgtgtgtgtgtgtgtgtgtgtgtgtgtgtgtggtgtgctcatctacatgtagaggctaaagattaaccttgggggtggttcctcaggaatcctctacttgttttctgagacaaggtctcttgtttggtccataagtaaactagtttggctggtcatggagccactgggatccaactgtctctcatttcctagcactgggattatagggtcatgatgccatgcctggcttttggagtagattctggggactgaactcaggtcctgttgcttgcatggctgagactttacggataggcacatctgcagcttagggggctgggcatgttttaggttagtgcaataagaatccaatggagaaccaggatttaaatctcatgcttaagaaggttagcccagtgggggtgttagatatggagatataattattaggaggcttataagcatcaaagtctctatgaacagccaccatgtgcttgggtgttggctaaagaccattgacatcagctgccacttgggcagcactgatgcttagttgtagaaagccttgagggatatttatatccctaaatatgtaatatatatatatatatacatatatatatatattatatatatgcacatatatatatacatacatagacacacacacacacacacacatatatatattacatggaagttatttcgtttatcattatttaaaatatattagccatgtattacatttaaaatattctagccttagatctgaaggaatttgaactaaatagaccagagtagcattttattctatcgagatgataagagcaatatgtatataatacacaaacaagtaataagcaatcaagatgtgtttcttggcatggttatacccaaacttatattgactgacctttacgttgtcttcactattctaagtaatataggaaggaagctccagctatctaggttttgtggatctattctgatagaaaggatggctttccaagaattggttaccaaaccaaactcagcatagtggtgtaccaaatgaaacactcaccacgaatgtacacaggctacccactgtctttgttaacccaggctattatcctgctctagatcttggtctagccactacttgaatatgtgttcattggcatctctttgtttacttgggcattacatgtctctattggttaagaattcaccttttgtcccctgctgctgctgctgcaatagcaaaatctagaacagtgcctggagattggtgctcattgtccatttgctttttattaaaaacatccactttttactaatcatttctttcaagactgggttagtaccatggattgccagagtgattggcttttctggacatgtattgatagttcattattttttataataaccttctctttgaaacttcaagtatagtttctttggcagtttttcattacatctcattcatgattaacattttcttttgcattgcagattctttaaaaacttatttaaaatatttcagtcattttttatgatttctggcttggaattggatgcttaaaaatcttccttagctaaataaatgtacccatagtttttttgtctcttaataaatttagcaataaactgttgtcacacactcagaatgggctctgcttcctgtctgttcaagattgggattcctatctgttgcaagtgtctgtttgaaattgtgtgtgtgtgtgtgtgtgtgtgcatggctatgggctatggcacagttgaggagggtaagaaagacagccttggatgttggtccttgcctttcatcttggagacaggttctcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccaatgtgggagcctgctctggtactagaggtgtgtgctaacagctttgtatgtgtgctgggaatctgaacccaggaccgtattgctagccatctttccagccctcattttgggattttgaatctattataagtaaaatactttattgtagtttcttaaagggattttgtagttttcaaattttctctggatctaaaagggtttgcctgaggattttttgaaaatgaagttgatgattgagtagggccaggaggtttgggttggaaagctagtcacactctgtgtgtgtgtgtgtgtgtgtgtgtgtgtgtgtatactgacaagttctctaacatcaaacttccactccagtcctaagtgttagccttcccagtgagccatcagctcgggcttcattgctggcatatagggagcgcctgttttgagaggtgtgggtgtgcatgatgcactgtgcaaacagtcttatacgagttctcagatgattgacagatgcggtactttctagtgactgtatccttgcatatttttcctgtatctcatccccatgtttgcctgtgtctttgtttttctctttgattagattaattcatggcttatctcctttattgtcttttcctcaaagaaccagcctttagatttatttattaattctgatgtttccatgctcattaatgagctgatttcctctttgatttttattttgccctccattctgcctcattctcctctacattttcttctaagtttacatactcatttcttgactttatttagttcttgctcggtgactcaaacatttaaggctctgaaatttcggttgggtgtgtgttggccaatcttcatgtatttgatgggtgttgctctcagtagtgcagttctctaaaattctgtaattgctattttggttttattttattttatttttttgactggagaactatttccaagctgctggaataattattttgttctacttttgaaattaatttctagtttcttatagtgtgagaggaggctgtaatctatattattaatttcctttttttggaaatttaatgggcttttcttggtggttgcatattggctgattatataactgtttagtgggcatttgtaacggcactcatgtatttatttgcagcatgtaaagcatggataaagctttcacatcgttttttaataatattaatcacattcgctaattcttcttataatagtgaacagtctttgctattatttctttcattcccatatcttgaatttacaatagattcaatcatgccctctctattctttgctttcttcagatagattatacccaggcttgacccaactctgttctcctgcctctacttcccaagcgctggaatcgcagatagaaactatcacacttagtttgcaacagtttcttctttataataatgatgctgtataactctgactatgaatattttgatatttatacatttctccttgattttgccatttgtcaatttgaaagagacctccttaaaaatacaacttactgtacttgtgtttatagaatcccatttattaacccagagactcatttctgccttcatattatgtgataattttctgctttgggttttgtctttatctctctttcatctttgggtgtgctcatgtttgggtgtggagagagatgcacatgccctcaggtgagcacgctcacgggagccagaggctggtgttgtatgtcttccttagtgactctccatcttaatttttgggagaacatctttcagggaacctggagctcaccaattcagctaatttggctggccagcaagccctagggatcccttggtttctacatcttaaccctaggattacagatgcacactgccgaaaacagctggtgagctggtgtgtgtgcgtgcttgcgtgcgtgcgtgcgtgtgcgtgcgtgcttgcgtgcgtgcgtgcgtgtgcgtgcgtgcgtgcgtgcgtgcgtgcgtgcgtgcgtgtgtgtgtgtgtgtgtgtgtgtgtgtgcgcgtgcttgcgtgcgtgcgtgcgtgcgtgtgtgtgtgtgtgtgcgtgcgcgcgcgcgtgtacatggtttacaggggtttgaacttggctctcatgctgcagtgagcactttgctgatggagccaccttgtcagccttgttttacatcttggagttggagttcagatcctcttcttggtaaacattatgcatgtttttttttcattagcctggagttcattttgaaatttttttcctgttgagtttatagtatctatatgtgatgattaatctacatttggctggattcggaagactcagtgagggtgtaaccagggaagtgtaactgagttagaagatccactatgagtacaaatggtaccagcaatgggctgggctcctggatgcaataaaaaagggagaaaaatgatgattttggctatcttcctctatctctttccactttactatttttgaaccaggctctcccatccaacttgtatctcattctttcccaggctggttgggtagtgaagcactaggatcctcctgtctccaccctgtagcagtggagtgatggatatgcacatccgttcctggcttattatggaggtgctgggatctgagtttagttcctcacagatgctgtgtaacttgtacagtgagctctccatcactgagccgtggagccttactgagagtgtcctatgtaagtctatcaacaaccatccttcattgaagaccgtggacatttcctcttgagatatcactgactgtagtttgtacaattctctattttttaattcgtttttggaggacaggctatacactgcaaatttctgattgattgattgattgactgataaattgatttttacctctaacattactgaggtttttatccagctaccaaacacttccaaattcctttagaattccaggcttgctttccttctctattgttagctttggtcctcatgcattctgcaaagactcatttctttctctcgctttcttcattctgttattccattttctcatcatactttagatttttatttaatgttttctgactttcttgtttctttgagagttcagatgactgctgtcacacacatcccttcctgattttctggagttcgtcttcatgaaacctacaatatcagaaatgcaaacctacaatctatttttaaacatcatggtttttgtttttgttgtttgttttttcttttagttgttttttttgtttttgttccagagatgtcatatgagcataattttgcattttcagcttgtttttttttaaattgcctttttaactcattgtaaaatggaacttcatatttcagatctgttacgtattgtaagctcctgtggttgattttcctttgatacacagctttctttcttggtgccatcaaatctcctataaaaccagagatgagggccagctttgaggtttgccttcagttttgagttttctattcctttgagaggctagggaagaagaaagagttggctcattgccacaaaaatgttctgttttagtaggctctacaatattttctgttccctctccctctccctctccctctctctgtatgtgtgtgtcttctctctgtctctctttgtttctctctgtctctgtctctctctcttctctgcaatgatttcatcctgtcttaaaaaccagtgatgtgagcatgtaccatgtctcaggatgagatgaagtatccaaattgtatcccatccacactgtcttaaaaacccaccatatgggtaagtaatcctcttttatacaaaataaagcaaagcccactgagacatgcatggcttctattagggatgccaggagcatccttagtcccttcctgactccgatttgctgttgttttcggaataactagttccatcacaaaagtaaaagattctgattgtaaaaaatctctgaaagtgagtttaaaatacccagagatggaagcaaaaagcacatgatcatctcaccacatagaaataacagctgtttaccttcagacactggtgtatgtgtctctgtgtgtgtgtgtatgtgtatattaatatgacgtggtttggaaattttatttgcttttgtttagcaacataccttagcaaatttcccatgtccaaatcttattattttcatcatcagttttaatacttttcttcccctgtgcttacctatgtttctcagttacatgcaaagaaatattatttataataactgaacaaaaggccaagctaggggacaaacaggacgcatcaaactatacacttaaaataaatggagcatttggtaatcatagggaattgtgaggaagtagtgggtggtcctagcaggcacatgtatacccttacatggacacatgtgtgtctgtctctgacagcagcagacaggatagagcaggtctcaagaatctatgcttatctgagtggtggtggcacatgccttaaaggcacatcccagcactgagaaggcagaggcaagcaaatctctgtgagttggaggccagcctggtctacagagcaagttccaggacagccaggactatacagaagaaaacctgtcttacaaaacaaacaaacaaagtctctcatttccatccccagtgtgtgatgggatggggccattgattaccactctagactttcatatctcaactataaagcaggaggtgtcacatctttccctccatgtcttccagaggaacttgatttctaaaatgctagtgcaattgtttaccttatgacaaacgtcatgtaccacctagggataatgagggatagtgagggtgatgaaagtccattctactaagtttataagcaccgaccctgcagaagccaggatggacaaaccactgcaggaaccctgccctctgcaggatccctgccccctgcaggaaccccaccttctacaggaaccccaccctctgcaggaacataaccctctgcagaagagacttgttaggcaagtttctttcttttttttttttttttttatcaatgatcttctgggtgacagtgcatgcctcctctcatcactctgatatgattaattcattcatcatgttagactgatttaattatttatcatgtcgttttgtttatttaatttgcatatcaatggccagggcacagcatagctctgcttcctgcagaatcatattaagaaacctgatgcaggttccaggtgtgggggttgggggcactttctctgtaattgaatacttaggtgcttccatacaacagctaaaattttttttttctaacttggtggccatccagctcattcttgatcattctagggagacagtgagctgtaaattatgtgttttcatctatgctctggtcagtgttggcacattttaccttcccatagagagggaagctgtttccttaaggcacagctatctcaaactcttagtccttgatttcaaggagaaacaacaccagtctcattgtctgactccttgtctctggattccccattttaaatacaccgaccctagtaagatgggggggctccaaagagacattgttcatgtttccgtctctagatcccagtttggagcagtaggaggaaggaaatacttttttccccctaattggccatcagcatctatgaagtggactgaatgaagacctaggagtgagcctgaacaagacggttattcatgtaacttttgtgaaccactgagagtaactcacaccttccagacatttttattatcattttgtggtctccctctgtgtgcctgctatggtcactactgctgtataacaggccacctagacatttggtagatcaagatattagctgttggtgttgtgtcttttgggttgtatttggtagaaagcttgcctctgctctgcagtatctcctgggacagctggggagtaaggaatgcctttctaatctgtctaccaagtaaacactgtagctcagctgagctgagggatgaaagatattagtgtttttttttccccctcttgggctgcccaagcttcttcacagcacggagtcattttgggaatgtgttatctggcttttgtagccttgctttggaagttatacaccacacccattctgtatgtgtgtgttcagtctcaaccagggttaaggggaggtaaataagacgtcactatcattgcannnnnnnnnnnnnnnnnnnngtttatagtatctatatgtgatgattaatctacatttggctggattcggaagactcaggattgggattaccagtgagggtgtaaccagggaagtgtaactgagttagaagatccactatgagtacaaatggtaccagcaatgggctgggctcctggatgcaataaaaaggagaaaaatgacgattttggttatcttcctctatctctttccactttactatttttgaaccaggctctcccatccaacttgtatctcattctttcccaggctggttgggtagtgaagcactaggatcctcctgtctccaccctgtagcagtggagtgatggatatgcacatccgttcctggcttattatggaggtgctgagatctgagttcagttcctcacagatgctgtgcaacttgtacagtgagctctccatcactgagccgtgaagccttactgagagtgtcctatgtaagtccatcaacaaccatccttcattgaagaccatggaaatttcctcttgagatatcactgactgtagtttgtacaattctctattttttggaggacaggctatacactgcaaatttctgattgattgattgattgattgattgacggatagattgatttttacctctaacattactgaggtttttatccagctaccaaacacttccaaattcctctagaattccaggcttgctttccttctctattgttagctttggtcctcatgcattctgcaaagactcatttctttctctcgctttcttcattctgttattccactttttcatcatactttagatttttatttaacgttttctgactttcttgtttctttgagagttcagatgactgctgtcacacacatcccttcctgattttctggagttcgtcttcatgaaacctacaatatcagaaatgcaaacctacaatctatttttaaacatcatggtttttgtttttgttgtttgtttgttttttcttttagttgttttttttttttttttgttccagagatgtcatatgagcatcattttgcattttcagcttgttttttttaattgcctttttaactcattgtaaaatggaacttcatatttcagatctgttacttattgtaagctcctgtggttgattttcctttgatacacagcttgctttcttggtgccatcaaatctcctataaaaccagagatgagggccagctttgaggtttgccttcagttttgagttttctattcctttgagaggctagggaagaagaaagagttggctcattgccacaaaaatgttctgttttagtaggctctacaatattttctgttccctctccctctccctctccctctccctctccctctccctctctctgtatgtgtgtgtcttctctctgtctctctttgtttctctctgtctctgtctctctctcttctctgcaatgatttcatcctgtcttaaaaaccagtgatgtgagcatgtaccatgtctcaggatgagatgaagtatccaaattgtatcccatccacactgtcttaaaaacccaccatatgggtaagtaatcctcttttatacaaaataaagcaaagccnnnnnnnnnnnnnnnnnnnnctgttggtgttgtgtcttttgggttgtatttggtagaaagcttgcctctgctctgcagtatctcctgggacagctggggagtaaggaatgcctttctaatctgtctaccaagtaaacactgtagctcagctgagctgagggatgaaagatattagtgtttttttttccccctcttgggctgcccaagcttcttcacagcacggagtcattttgggaatgtgttatctggcttttgtagccttgctttggaagttatacaccacacccattctgtatgtgtgtgttcagtctcaaccagggttaaggggaggtaaataagacgtcactatcattgcacatagtgatggggtggtaccagagtaggggagcagaagagtgtgtgggtagaagatactgctgctgtcatctttggaaaatacagcctgcttcaacttgtcagagcttgaatgccttccccttcttttatagctgaggacatggagacctagggaggatgagtgtcatcactgctgtgaagagacccataaccaaggcaactcttataaaggcaaacatttaattggggctggcctacagtttcagaggttcagtccattatcttcatagcgagaggcatggcatcatgcaggcagaattggtgctagaggagccaagagttctacatcttgatcttaaggcagccaggaggagactgtcttctgcaggcagccaggagaagggtctatgtcacacaggcctgatttgagccctcaagcctatgagaccccaaagctctacctccatgtgacacacttcctctaacaaggctcatctcctctaataaagccacacatcctaatagtgccactccccatgggccaagcatattcaaaccaccacaatgaataatacctctatggttacaagctgaggggagtgcttgagttgaacttggctcctggaattgggctctagagaagacaccatgagccatgagttgccatcacagcaaatgcttatggagctatttattactctatggtattgctgtgtagtatctatttatgaagctattgctgttctgtctactaagagctatgaagctcttacctcgcaaaaactctttaacaaaatttaagatagatatcttttgtgacaccaaaacatataattgtttaagggctttgctcatggtcacataggcaagggtcaacgatgagattcagagttagccccggagacaatgcacacaacaatacactgtttcaggttcttaagtaaccatgtaagttggttgtaatggctactcagggctcccattcttctgcattgaaaccaggaattttttccttatagttatcctcccagtatcccatgttatatgtgtacccttagggataccggagttattaaatcaatatcaagaagagcttagatatgcaaaggaatcccaaccttgtggtccatgaagaagaatggtgttctccttataacactggcctcagtctttatttctctgaagcttccttgttcagctttctccttctttcatctctttttcctaatgaatgaatgtggatgtgggtgtatcacagtccaaggacaacttgcaatctttcttcctatcatgtaggttcctgggattaatctcaagttgtcaggcttggctgtaagtactcttgctcagtgagccacattctggtctatctcattctttatctcaacaggatttaacacaaggcactcactccttttctatacagttgctgtatgctcttagctgtggtgcctgtgtagagaaagtctggctgttttaacctgtaacatatggggacctcattgggctactggaaggacttaaagattgaacatgaagaactgagggtagagcttagtgatgaagcatgtgtttagcatatgcaaggtccccaagttcaagtcccagcacccaagtgaaaaaagtatatatgcatggatgcaggcatagtgacattggtcccacagttgctggtttcctgccttccttctttctgttggctctgcctgatatttcctgaaatacccatgattgaatgttatctctgtccttctcatgtttagccatggggcagagccaggctgtgctgtgttaagttggaggtagaaagttagactggaagcagatcatgggagagaagaaaaacatggggctcttgattgaggcattggatttcttctctgggtttagggatatgatcctctcctggagtgtggaatcaaatattcctgcctaggcatcccagagagaccagatgtttgttctcaacactggtcactgacctgtcccagtctctcaaacccaggggaatggccaaagggctcctagagtccattgtcctagaggagccaggtactggggatgacctgagttctcaagtgagttaccaccaggctgagccagttcatcttacaggtttgtgaggcagaaacaaacctggaaccaggctcttctgaatgccctgcacctattcccctctctttccttaattctttcaacacatgccctgacttaaaatagaatcactggttttatttctgttttaaaccatttatccattaaccttgaataatgtcacatgagagactgtatacttgaaccacccagctaagcgacttccaaattctccatcagtagaaactatgagataataagtaatccattattttaagccactaggatctggggtaatttgttatgtagcagtgaataactattacaatatgaaattctcattgttcattgccctttattagctctggtctctaaccacttcagtgtgtcctcctgcatttccatttattcttcttttaggatttatagtaagagattgctaaatactataaaagtaccattgttagcacaatgaagaatcatgtgtgtgtgtgggggggggctatatgtctgtatggacacagatgtgtgcacaccaatgtgtgcatgtgaaagacagaggaggatgtcagtatcctgctctattgatggctgtctgccttatatccttaagacagggcctctctctctgtctctctctctctctctcttttttttttttttgttttgtttttttcgagacagggtttctctgtatagccctggttgtcctggaactcactttttagacatgctgtcctcgaactcagaaattgcctgcctctgcctcctgagtgctctcactgaatctggagttagaccagcagctagcaagccctgctaaacctcctggatccacatgctgtagtgcggggttaataggcagggccatggggcatgagtactggagatttgaactcaaatcctcatccttgcacaacagacatccttgcctacttcctagactctgaagaatcttgctttcagatttttttactttaaacatttatatgtgtgagccaggaagatggctcaattagtaaagtgcttgccatgcaaacatgatgacctgagttgagatccccaacattcacataaaaattccagatgtggggtactagagtgctcgttcagcagttaagagcacttgctgctcctccagagcacctgggttttattgccagcactaacgctactgtttataatcatctgtagcttcagtaccagggaagccaatgctctcttctgaactccaaggtaccaggcatgtgagtggtaaacagacatatatgcagacaaaataaaccacatacatttaaaaatgtagtgccatccacttataatcctagtactggggtgctgggactcactggccatctggtctacctgagtcagtgagctcactacctgagtcaggtagtccactagtctagtttagtgagagaccctgcccaaaataataaatgtggctggccctggatgaatgacaaccaaggttgccctcttgcctccatagacacatccacatatgtatgtatatatacatatgcatatacatacacatatgcacacatgcatacatgacacacataaacacacatagattttttttttttagtttattttaaaattaaatttacaggggctgggaagatggcttgatggttaaaattgattttgcagaagacccatatccaattcctggatcccatatcaggcagcttacaacaccctataatactagttctaggcaccctgaccagcctctgccctccacaggcaccttcactcacatacacacacccaacacacagacacatgcacaaaccctgcccataaacacacttaatttaaaaataaattttttaaatgaaatttgccattcttggcatgtccaggctagtatcacattttatgaacacattgagagttttccctaaagagaaaatgattgcttccgtttgacagactctactgtccttctaacccagatgccccaaatggtaaccagatcttgcaagttcatctcttcccctatcacataacccaaagtctgagagaatggttgtgacttctccagcaatctcaggccaaggataaacagaactgtgcttcatctggctccatagatgtctctgataagcaccctagtgatcttctcagacatctctactggttttcctaagagggtactctaggaattttggagtatagctatgtgacctgctccaagccggtcatttctttaaagtttcatgctttcacttaaaaattcatgtggatttttaattctgcttataaatatattcatgttgggtcttagtatcatatttgttagtcaggctagtcttagttatatcttaataagaaataaacccccaacttttagtggcttgttggattgggaaatgtgcatagctcttgtcccttcaagagctgaggcattctgaatggtgcaaaattgtattgtcttacattccaatatgtctcaataaatgttttttaaattttggtgctcactttgaaggaaggacataacaatcttaatagcttaatcacacacacttttgcacacatgtgttgtttgattaagtcacacttttgcatgtgtattctgtggctctaccaattgatgactctggaatacttttgtaacactgacatctgttctctgaaattcacaagggtggaggagggagaggatataggaggcattgtataaaatttcctggtcaggcttgtaagtggtaatgcaactcattgaaagccaagccacaaggtcccaacagacctgcaagagaggcttagaggccaagtcttttgtgtttaggaagaggccagtgaaatgggatctgatatgtacatagtctcagttgcttgcaatcatgatccaaagaatagaatcaggttttctcctatcttattacttggtgagtagtgcccacttgccttgagtggtgactcttaccttgagtctgtaatggaggattgtagtttagtctgtaatggtaagaaagttgattctcaggcaaagcctcaagtggagggattgagctaccaacccagccacaaaacttctaacctatcaactgatgggaacagatgcagagacctacagccaaatattaagcaaagcttggggagccctgcagagaagaggaggtaaaattggaagagccagacggatcaaggacagctcaagaacagggcccacagaatcagttgactgggactcaagtgggctcatagagatcaaggagcagacctaggaggtcctctgcatatatgatatggttgtgtattttggtgttcttctgtgattcctgagaatgggagcagggactgtctctgactcttttgcctgcctttgggacccttatcctcctcctgggttgccttatccagccttgatgtgcaaacatgtgcctggccttattgtaccttgtgttattttgttgatgtccctggaaggcctactcttttctgaggggaggtgaaatgggtggtggcctctaccaattgatgactctggaatacttttgtaaagggggaaagaagaggtggaaggagacaannnnnnnnnnnnnnnnnnnntagttggtcacacctggacctgcttggtctagagcctagtgtataggcttcgaaaagaaagacttcatttatcaattgatgggaacagatgcagagacccacagccaaatattaagcaaagcttggggagccctgcagagaagaggagggaaaattggaagagccagacggatcaaggacagctcaagaacagggcccacagaatcagttgactgggactcaagtgggctcatagagatcaaggagcagacctaggaggtcctctgcatatataatatggttgtgtattttggtggtgttctgtgattcctgagaatgggagcagggactgtctctgactcttttgcctgcctttgggacccttatcctcctcctgggttgccttatccagtcttgatgtgcaaacatgtgcctggccttattgtaccttgtgagtgttatttggttgatgtgtctggaaggcctactcttttctgaggggaggtgaaataggtggtaccctcagggggaaagaggaggtggaaggagacaacaggagaggggagggaggggaaactgcagtcaagatgtaatagatgtaagggaaaaaaagctggttctatgcttggaggttctctttgtcactatgtctcatataaatggcttcttttactgtgtgacacgtggcatcagggtaatcacaaagcagagaggttctgagttctcctagcagtggcgccatacagctgtggcgccatatatacagctgtggcgtttggtgatgagaggttcccttatgtgtagagggagtttgtttaatgcacagaaacgtttaacactttcattctgatctcacccttccaccccgtcctccaaaacctcatccttagtgcctcactgcaaccctgccctggacttctctctgaaggtcactgccgcagggacagcagtcttccacctgcaactatgctggacaatctgtgcttttaattactgaattctgtctgtctcaccaacgctatattatatattttaacaggccctcaaggggcatttgtgcaaccgaggttatactgcgtttctgtttaggaaacaaagaaagagtaacgtgctccctattggtgctcctacatgaacacaaaattgtgagggtaaaaggtttgttggccctgtctggaagtgtaaacttggaacaagcataagcagacatagttagtaggtgggcgtagtttgaatctgggtttagagccatcatttgggtcttcttgcccactaagtgatacttctgccagtctactggtgagacacacatttttaacaaagaaacatactgataacttttttcacatgtgtgtttgtgtgtgcgtatgtctctctctgtgcgagatgtgtgtgtgtgtgtgtgtgtgtgtgtgtagtgatgtgtttgcatgcatgtggcctccatgtgtgtgcatgtttatggcagatgatgggaatggtctttggttattctcacacctgtttcattgaggcagcatctctcactcaatctcactgcttggtaaccctgttagtcttcccagttaccttgctctggggtcccttctgtctacattctgtaattatagatgggctgccacacatatccagcatttatgtggggtctgaggatctgaactcctgtcctcaggctttagccactgagccgtctttccagcagctctcaacggtaaacataaggcacagctcaccatcttaaccatgttaagtggctgtaactatgtttacagtattgtgcagccatcaccactgtccatttccagagcattctcaatcgctctcgaagaaacggtagccaggaaacaatacttcttcatttcccacctgccagcccctgtcaactcctattctgtgtcctgactccatggccctgcctactttagccactttgtgtaagctgagtcagacataatgctctcttggagcgaggccctgcttgctgtgttttgcctggctgcttttacaccgcattgcagaggtgagtagctgtgatccacgctaaatgtcccagggacctgaaaacatttgcggggaatgctctgaagaacaaagtttgcagactcccgaatgtgaccgcgggtggctgacctcgatgattatttcattagtgtgggagaggagcctcatttccagactgtcagggatagacttttgcagcataaatgaaaccaagacctttaactctatctgctcaaattcctagtggtttcagcctccctcagttttctagctaaaaggatgaaaaccatttggaaactatagttaacatatatttcaaaatagctaaaaatttttaaaaacatgttttccttaaaaaagagagagaaatatttgaggtgatcggtgtgctagttaataagaattaaaaacttcatcaactctgcatgccttgaaaccacattgatatgcagatatgttcataatatggagagataattatcaattagaaataaaacaaaaaacctttgggtcagtaagatggttcagagggtaaagatgcttgctgccaagcctgaagacctgagtttgatccctggaatccacatggtagaaggaaagaattgagtcctacaagttgactctgtcttttacttgctcgctgtgacatacaggtgcccatgtacactataaataataaataaatgcaactttttcaattaaaaaaaagagcaagaatatgagacattctgtcctggcttattcattttccttcctctgtaacaaaaaacatttaaaacataataacttattatagaacaatctagagagaatttcatataacatgtcttcatcatttgccactccccctcaaatccttccagaaccaaccccctacttcctgtctgtgttttagaggagcctggctcacagcaggtaccccagtccactgcctcgtatagtctttctctccactattctgcaacattccctgagctttacgtgcagatgttttgttgtaaaagtattaactgggaaaggcaccccatgctcacttggcctctacattttgaccaattgtaatgatctccatttgctgtgaaagaagtttccttgaggaggggcgacagctacatgcatttgtaggtaaaaggggagagtaaagattgtgaatgcagggtgatagataggggtctatttgttctcttctacatgcagacatacagttagaccagcaccatttgcttttttttttccattgtatggttctgccttccttgtccaaaatcaagtgtccataggtgcgtgggtttatttttaggtcttcgcttctatttcattgatcagcctgtctgttttaatgccagttttatgcagcttttattgctattgctctggagtgcagcttgaaatcagggatagcgaaggctccaaaagttcttttattgtacaagattgttttagctagcttaggccttttgttttttcatatgatgttgaggattgctcttttgaggtctgtaaagaattgtgttggaattttgatgggaattggatcaaatctgtagattgctttcagtaagatggccatttttactatattaactactgatccatgagcttgggagatctttccattttctgatatcttcagttcaagattacaagtggtttaggaaagtggtagtaagtagcatgctctcctctcggcccgtggcctcaccagccatgggttgttggctaggtttaccttgcaaagcttaaattccttcctgttgagtatgccttacttctaatgaggtcactgatggttacccctggatatatgtgccatcattgtatctttcaggatatcttcctttgctggccattgttgtccttcattcgcctgatagctggacagaactattgagtacctttcccttttgccatcttgcatggccctttcaaaacctatgaggaatggccgtccacgaggaggcttccaggtcaaatctagatcgattcctccgaattccgtgttcaaagtgtgtggtggcttcaagaataagctcttatcttctattgtggaaggcaccaagggcaatggcaagagcctgtattgtctggggaagggtctcttggactcctctgaccaacaactggaaaggactttccccatgcctgccactgaggatactgttggttagtctatagttttggggggaattattgtctccccaatttttgatataacttcaactagaaatctgtgtatatatatatatatatatatatatatgtatgtgtgtgtgtgtgtgtgtgtgtgtgtatgtatatatagatagatagatagatagatagatttatatgttttatgtaattttaagtggaaataaaatgatacaactatttatggtttttcaaaacacccttagtgctatttatcttttccccttccttctccttctgtggtgcctttatccccagcccccagagaagtcttcccagtcttatttctcccactgtatggtaactgtgtcctcctctttctccccagactccctctggtcagcattgaccatgccacacatttttttttcctaattgtgaaatgatactggataaatcagctaactcttcaggctccctttccattagtttgagcgatgaatttgtttttcctacttagattttgacctttctttgttttatgatcttatctcctccatgaagaaaaatagagtctgtcttagagttctaaagtcacagcagcccctgtcctcaaactcatttcttagcttactgtatgcttcaaaatacaagtcatgtgatcatgatttcttaccttccaagacccttcacttttactgtcccaatgagcacactgtatgatgggagatggtgtcttgtgcagagctacctggtacctgtcatgtgacaagacaacattttcataaatatctgcactataatgatacttggcaaaacttcaacaaaatgatacatatcagagtttggcaacatatctctaaagatctagatagtcaatacctgcatcacagaatatgcatgtgtgtgtgtttgtgtgtgcatatgtgtgtgcacgcatgcaatgggtgttcacatttatgtgtctatgtatgtgatgttgtatgtgtgttccaatgtatcttagggttttcattgctgtgaacagacactctgaccatggcaagtcttataaaggacatttccttggcttactggttttgagattcagtccattatcataatagtgggaagcatggcagtacccaggcaggcatggtgctggaggagctgagagttctacatcttgttccaaaggcaaaaaggagaagactgatttccagacagctaggaggagggtctcaaagcccatcccccacagtgacacacttactccagcaaggccacacctaatagtgccactccctgggccaagcatatttaaaccaccacaccatatatacatacatacatacacacatacatacatacacacacatacatatgcacattctcatatttgtgcatgcagaggccagatatatatgtatatgtatatgtatatgtatatgtatatgtatatgtatatgtatatgtatatgtatatacacacatacatatgcacattctcatatttgtgcatgcagaggccagagcaggacattggctgtcttcctcctttgctctctgaattactaccttgagacagggtctctcactgaaatggaaattctcttttttttttgctaggctggatttccattaagttctctgaatctgattgtttctattcccctatgtttgtaccagagacatacacagccaagtctgttttttcatatgggttctggggatccagactaatatattgataccttgcaggacaagtgctcttaaccatcagtcacctgtctatctctgtttgttttaaagacaatgtctcactctctagtcaacgctggccttaaactatggatagtcctcctgcttcagccttcctggtactaagacgataggcagaaatgatcacacagcttacttctaaagtatctttattccaataaaactttattggcaaaaatagataataggtcacactctcttctaaatgatcccattctttctcttaaccttgtctcttaaccttgtctattttttaaccttgtctatgtttatgtgttattttttaatctctctttacaaaccagatggcttcatggggttatagtagataacccacacatgagtgccaccatacttagacacattctccttgtttctacaataaccagtaacccatgtgcggaagccagagcaccaagtatgacctgttctgcattcttcttcctgctttcccaccttctggtcaatactgtccacttaacacaattcaacagctccttagtcctgcgtgttattgtaggaagcctgaaggacagcatgcctgtggtgtgaccttttgcaaattgagatttctcttatgttcctcttgtcttctttcaaattctttgtgaattcaagtatatttccaaattctagttttagttaccagttttccccctttgaaaccatataggaatataaatggaaaacaagggggaaaatcataaaatgcagtaatgttctcatttctctgccaagaggaaggtagagcgagtgttgggaaatagaaccaagtattttgtgaattgacttcttggtaagaactggagttgatgggtggtggggacaggtggggaggcagttttctgtaattaaaatgtctttttcccctagggcagcacattctctagttctccagttctagctagagggccctcttccatttcataaaaagagcccacctcctagcttgccttcctgtctcagaaagtgaccacatgcatcgaggcggattccaagtaccctgacaaactcctgagctttaaccctgggtctccccagccacagcagtgccaggaccctcatctccccatctgtgagcatttcccagtcttggtgtttaatgaaggatcatgctactgcatggaaattggcagaatttttacaattctgctggcatccacttgtaaaatatttatgggtttttaaacttcacactatagaattgaaagttcaaatctgcctttcttctcaagtacaacccttggtacatagacctctgttttctatttggtaaaatggttatactagtatccatcttatggtattgttttgttcattcggtaattcacttaagcaatggttcttgactatttcgtgtgttccatacactatatgatatctctgtgagacccaacaaatgatatatgccaagcagatattgcaaggattaaggataaaatatgaaatgtatcttagatataattaactggtacttcataatctaggagatgtgttgctatccaatgatcacactgttcatggttgttaggtgtcccatgtcacagcaaaaattgttgtctttattcctaacacatcttatcttttttttttgactttttattcatgtgttaagttgtggtgttcatttatgttacaaatgactggccagatcacatatatgaccaggtctgctcttcctgtagccctgtctttccccagttaatttcctgggaaaacacacaaccacacatttgtcagttccaagagagggaaacatatttatttatcaccttacccaagaccttgtgtttggaagagcaacctcatggagcatagacccatacctttaaagattattattggcttaagacatgtctctctcattctgtagtccatgctgccttggagctcaccatgtagcctgagctagccttgaatccatgaagctccttcctcagactcataggtgctaagattatatatgtatgttatcatgtcttgaccacatctcttcactagataacactgctttagttaagatcaagacacttggagaatttaccattgaaaccattgaaaagacaaggtagatggaaaggggttttatagcttgggaccagctaagatatccaaccattctttatttcattaatatatacagaaggccttatgctcatgttctggggacacagaaacaagtgggatccataatctgctggagcaagccccaagttggtcttagaaatctcacctccttagtttgatggacttcctccagtgtggccccagatggctgttggtaaacattgggattggacagacattgggatttttaatttccagtagtaggtcataatatgataacatagcttctacctgtaacttttctgtgtgggatccttccctttgggggaatccagtagtcccagcataagcaatcttctaaagggacccatgtgacctccagacaatagccatgggtatgagttctcattggcctgtggctggtaggtgttacagagctagcaagttccatgaaaagtcaatggcgacataacaaaggatgacaggacctacagcaaatgagacttgcagtgatgttgaatggtaaagaggagttggccagagacatggtggaaagtagaaaggcatatatgtggctgctccaattgggtggtattgactagtttgtcaagactgaggggtgggtctggattataagccatggaactagggtttccaccagggggaactggcaccgtgagcatgggccagatcatatgagcagtgcaggctgtgaaagctctgtattggatggcatttcatgtggcaatggtcattctctatctgtatgatccaataaggtggaccagccacaggtagctattaaagactagaaagactagaattgcagctagtacaaggggggaattgagcgaaacatttgattacatgtcagtgagattgaatttaaatttatctgtgacactggtggttaccatagcggggactggattcaagctggtctgtggagatctggattataggccgtccttcctagaatttggaagaattcattgatggctccaaaggatgggtggaggatgacagaaagatgttgggagcagagttcaggagaaggatgatggctttcctattacctgcattctatggcctcttgtgctgtccaggagcaccaggagcacatgagaactggatctatgggagctaagtagctccattcctgccaagtcactcctgaatgaagcaatgaaacccccataatgccaatttctcaatggcaaaaggatacatatgattaccacctttacagaggaggcttgtccacagcctctggcactcacagaagtatctctccacagtagaattctatctggacaccttctgtgtatctggatctctaaataggaaggctacttactatctatgcattgacatttgtacctgcagaatggaatctaagcactatctaccttatactaatttcatgagcctcaagtgagccaaattcatataaaccacttatgagagcgaatggcacattttagaattaaggactgcttggggataggtagatggctcagtcagctaagtgtttgctgtgctagcatgtggaccccagcacccatgtaaaaagctaggtatagtagtgtgtgcctgtgaactcaaaattagacggagttgtggggtaggagggtaaaggcaggtggatcctcgtagatcattggtcagccagcccagccaatcaatgagctctgagttcaatgagagatcctcaaaatagaatacaactttacttctgaccacacacacagagggggggggggagggagagagggaggaagagagagagattctcatttgcatgggctcttatgcaaacacaaacatgctcaggaacacactacaccaaataaacaggctcacacaggagaattgaggactgcttactgccagttattttgttgttgttctcagaaccatctctgagttaggaatctctactccatacattgacttcttctcacctcatctgatgtccaggactcatttagaaactatccctcagctactaccaaggggaattctggggtagtccaacaggatgttgcagagggaaagccaggccttgggttgaacaaattggaggaagatgctagaataatctagcccatttcatcacatgtcagttgtcttgaaatgggaggatagatggccagaagctgatggctttggctcaagtgtgacacagcagatgtgggagcaccctgggcctgtgtcccacctactggcactggtaggggagcttctctttgagaagcaatctagatggagctcccccgttctttcttccctgtggcctttggaaggcagagcacacgtgcaatgaaatgttaattggcaaagcttcagaatatggcatcaatgccaagcactggttaatatcgtgttgatgcacaatcttccttccttttgttcagctcacagaatgactgacttagagagatgaatgaacgctcttcctgtgagcctggccttactctgtgatcatgctcacctgacttctctccactctcacctttcctggcacccgtgattcacagggggtaaatttactgtgacctatttctcacctctgtcgttcacttgattgtgcccagactgactactgggctgtccctttcgcaaggagacacacttgcctcttggcttttgtactggctggccttcctttgcaccgaagcctttgtaccccacctctgccctctgcagcgccactccctcacaccctccaagtctccccatgtgccaggttctgacccctctacgtaaggtgatgtcatcctcccgtacacttgctccgccttcattatgcttccccacattgttcactacatttatgtaatttaacttttttttttaatcacttttttgggttttgatgcctgacaccacaaattagcagcctcttcaagaagtgcagtttcagccctgtgcagttcattctgatctcatttcctgttttactgcctgccataggttgttgtgtgaccctcaggcatggactgtatgagcctccaggctcccatgctgctgttcaaggctctgacccccaatctctctttcattccactgtctcaaggttctttccacttgcctgtcacatctgtgttgcttttgacaaaatctcaaatgttaaattttaccaataaggactggggaaccagttgctggggtgaaagcctgctaactcaggcagagaaagcacccagctgacctcctcctcagccaaaatccccaaaggaaaagtctcctccacaccatctcaaaaaacctcaaactgaatgtccctccccctacactcttagtgtctctctatccatcttcttgaccgtctcttactttctatggcttttttttccctcttatgttcactccctgtcaactggttgcttatttcgcttctggacctatggttgactttgtttaatattgtttttctataaacagaaagtttttagactgaaggcatatgctagggctgagctataccacaactagaaacaggttttttttttccccagtaaacaacacaatcttggggttcacggtgtgatcaaatatccttactttccgaatctactgatgtctcagtcaactgtctttggccagcagatgttcaccgcctcctgcctctaaagactctctactgggtacatccaacctttctaccctgtcacatgacattgtcgtctacacagttcactgaggactggacttgtaatcaagtggcataaacaatatctcataatgttttaagttagtttaaggttttatgttgagccttagttatcatgagtcttggtcacatacacatgtggcctcacgtggaccatgagcttcaggctggggaggcctgggacccatcttgtcatcctccgtcatagtcgctcactgtcttggcttgccttgtggtaggcagtcattcctatgggcagctcttgggtctttagtctttctttaatcttcatccttctgttagttctttttcgtgtggctttaagaaaatacccgatgaaagcagtttaatgaaggaaaggtttagtctgattcacaatatagggcagcaggagcaggaggtggctggacacgttgtatccgtagtcaggaaacagagggacttgatttcttgtgctcagctcacttctttttatccactcctagacccctgcccatgagatcctgcgaccttaataaacttaattcagacaatgctgagacttatcttctaggtcatgctaggtcctggcaagctgatatgttagccatcacaaatgcccatgcatcaacttgccttggctttgagttaggacaatggccattggtgtcaggcatacctgggtttttctttcactgctcagaatatttggtcaagttaaagtagaagtgatgatacctatctgagaagttgtcaggagaatcaaggaaaatgacatgcatgaggccacatagcaagtgcttgagaaaagtaatgaggggctgtgaaggggagtcctgcatgggaggggggatcagtcatgttaattaaagatatgttatttccatgtgctgaatttggaatgggagattgtttttgttccacattagaataatgagcacactcttatctttattgaaatccttctgcagaaagaggcgagctgtatttgtgtcagagataatgctggctttttataagctccgtgcggtagacaatagcagggccttttaactgatgtgcttaggatttttctgtctgtccctttataaggtctgtcaattccagtcttgccttggctttcaggtgacttttgtgacacttgtaaagtcacttatttgtgaattatggagggtatttgtctacacacacacacacacacacacacacacacacacacatctatctatctatctatctatatatctatctatctatctatatatatatacgtagtcttgcatacatggacatacacagtatacctggggagctgtttgcttacgaacacatagatgaatgcatattagtaaatatgcatgaattcagtattgtggatgctcctgtccatttacatgcatatgaacatgttatactcctgcaggtaaatcctacagatatagtagatcttcctagtcagctctagcccctgggactgagagctaagtggagttggctggttgaggtaaaggaacaaaggaaaaactggggtccgtggaaactactgtgtagttgctgctgtgccatgagaaatgctacctacattaagcagggcaaatggaaaattaggctgccagaagcaaaaccagaaatggaccatagacaggtcgtcaggtgtgacaatggtggctgtcagcatccgctgcaaaaggtttgaaatcactatcctattctagaaggctatgggcagaggctctggccacctaccctgaaggatttactctccttgggagggaatgtgatgtgagtattccaagatctcaggaagaggcctggacccagcaaacagctcctgagttgatgttcttagaggtatatgtccctgtgacagggggcttggcttgggaggggagcagatcacctgctcttatctgaactcccattgtagctatgaccttgggtagatgctcagcccccaggactaatgaggggattcaatagcatgatgatatagatggagtattcagaagcttaattctggagagcagagagacattcaggcaatacagggtcttccttctttgcctagctgcatggtcatttccccatctccgagttagcaagatccttgtgggcaacagagaggcataaaggagacataaaatgatgtgcttagcaaccatggggattaaacacccaacagtgtatgcaaaggacacaggacatgtgagtttaaaataaacaagagcagaagaaacaaagcttgaggcgagagacacaggagccaacccggagtctccccacaagcaaagcctagctgtgtacggactctgggtgcctgtgcgatcttggacaggtcaccttatctcttcggggtgtgagggaggtgatgattatacctactttgtacgtcataggatattcggatctcttcatggtagggacagtggtaataacccaggacagtttctcaggaggcatgtgtgggagaggtgggcaggatgacttgcggctcttgagaaagtgcagtggaggggtcatgggtggtggggttgtgggtggagcagtcgtgagtgtgaccaatcttgtgacttccacttataccactttccccattgagctctctctacacaggctacctctcattcctcagagactcttgctgcctcagagcccatgaccagttctctttgcctgagacttttccagtgttttgaacaatgggctccttctcactcttgggtccagtttcaaatttcatcttcaatcttgagaccttccctgcccatcctggccaagaacacactcatggttcctaggtcaactacccaattccaagctctgtccttcttttctaacctcacagtattagttacattcttgttgtctggcccactgcagtctacacataccacaaagagctccatgaggattaagaggctgagggcctcttaatctctgctgtctccatctctttagcccagcactgggaggtgatgccgagtgattatggatatctaatgatctgagagtgacatctctgagtccatttaaggaagtaatttgatactttaaagactgagtcccctcccccagaggtgtgtgagctcagacagcggccccatatattgctgatgccgtagacagctggtatatctgccttcagcagaagtttagggccttaatgacacatagcttcttcctatgcatctaactctggctgggagtagaaacagctgcagcgtgatgccctgtctgattggcttggtgactcagttgctaatattcagctgtgctagccatgaccaaaatccatcctaagaaatgggtcagatggacatggatttctgatctgaggtcgtcagatagcttttgccttgcctcaaactatcccacaacttaatggcttaaataactggcattttcacttcccttgtgcctggtggtgctctgtggaggtcttatttagaggctcttgggctctgttatgtctaagatacctctctcatatctgtgttgtttggcaggctatcacctcagaaaccttgggtcttctctgaatggactcccagccaccagtgtagtaggccaggttcatgcttcatgatgctttcaagcttctgagtgtagccagaaggaatttcctatgtccatgctatctgtgtgtttatagtgtgtgtgtgtgtgtgtgtgtgtgtgtgtgtgtgtgtgcgcgtgcatacatgtgtgtgggtatacatgtaaaaaggataggacaaccttgtcctcccctagacaccccagacactgtttcttaagagagagtcccttgagtttgcaaaatgggccatgctggctgcctagtgaccctctaggggtctgcttaccgctgccttcctagtgttgggcttatgatttcacatcaccgtgcctaacagtttttatgtgggttctaggcatcaaactcggatcctcataatattttatcaattcagccatcccctctgctgcacaagcttttcaaagcctctgtcctggcgtgtttgttgatttctttgtgaggaaacttattgtcagtgtgagaagtagaggcacaaaggtgtggtcatgaggaattagtgagacattgctaacagtatatcctttgtgcagggaactccacgcactgtaagccatccctttgatttcattccccttttaaagtaaggacttttattgcttcatagtcatagacagggaccccaagattcagggaagctaaagggggtgtgttcacacagttgggattgactctgagaaaactgcatggagatgaatttaaatatcaaggctgacttggcaggagagaggccaagctggtcctggtgaaacagagggctgggcctggagggttggaggtctggagaggggagcacacaagtgttctttgttcactaattggcctttgcaaaggaaaagtaaatgttcttataatttaagaacagcagagcattttaagagttcaatcaaggcaccctgagttagactttaaccttcccacggaggcattgcccctcgcctcccagctagcatcttgctatatagcctgggatcctgccttagcctcatgggtgctgagtgccaggaacatgtcaccatgcctggttggctggctggctttctctctctctctctctctctctctctctctctctctctccctgccttcctctctgcttcctttcttctctctctccctacccctctctccctccctccctttctcccccctcctctctgtctctctgtctctctctccaaggtttgactcatcctaggctgtccttaacctcactcaccttactctatatctgaggatgaccttgctgtgaccctccagatcctgctccctagtattgcgcagtgtgtaccacccaccgggttcatgtgtcattggctggggtcagatgcaggatttcctacatgctaagtaagtactctaccagctgacctgcatgaagcttctgtttcaatgagatcttatccaggtccccagagaaggacatttctagtctatatctattctatattcattggggttcactaaaggaataagtctgatagaataaaaattatctatatttatgtatctatatacatatctatctatctatctatctatctatctatctatctatctatctatctatctacgtgtgtgtgtatgttttcttaagaatgacctacagactgtggtccggctagtccacagtagctgttacccagtggaaagggcaaggtctgatagttgtttagtttatgagattctgtgtctcagctggtcttcagtctatgcaggaatccctaagaggtggattctaaaactggtgaaggactgcctcagcagcaggatgaatgacctcgccagcctgagtgagggcaagcaggcaagaagcaaagcttccttcttccgtgttctttatgagggctgggctaccagaaggtatggcccagatttaggatgggtcttcccacctcaaatggtggaatagagaaatccctcatgggagatcagctgcttgggttttaattgattccaaatgtggtcaaattaacaccaaacattagcagtcacagagcaggcaattgtcgtacatgttaaatgggcagagaaagcatttgcatttataagtatcctacactaaagttctctaagaaagtggggagcacagcagtgaggaagaagtttgtgtgaaggttcattagttgagtggatcaatgtggccatcttaaaacagtaattgagacccaggacctacctgatgcaccaacgcacacttctgctctgatttctagtggcttcctgcagatctggctgcgtttgggagagatggggctgtcactcaccactcaccatttagcagtagcttctagaaagtctgccccatttgaataacacgatatttaacatgcctatgggtcttacaaagctgcagatgcagcatatagttaaaaacagatcttaaaatacgctgtggaattctgagtctgcaatgtcagggctgggagggcccaagagtccgcattcgtctagtcccttggctgagcaagtgagaactaaggtcttgtccaaggtcacacagactgggctggatcggaggctgtaccccggactcccaactcctgtttccagtgccaagttcttcccaccccatctccaaggcttcaaggcagtggttgctcctgttttcctttcttttctcctcctttcctttctttttaaaggctcagtagcagctactgctctaaggcagaaaatgtattcatttaaatgacttcgtttggaaatagaagcttgaataatgatgttaccatttataattgctctgattaaccacaccaccgttttgcagtttagaataaaaaaagcctcatttcctttgtgatgtgaattttaattgctttctctcaggaagaccccttcaggcagaattgtatgcttctcagtttccagaacatcagaaagacccctctgtgtcttggcctgtgtcagacctgtgtgcttggccaaggctgagcataggcatagggagatgttcatgaaatacccagtgggtggagattctgggagagatgctgttgagtctcacctttcaacctacgcgtgatacttcccagggggatcatagcatcagggggtcccacaaagcccagactagagacctgggataaggggatttgagacttttctaagggtgtttaaagctcctgtagatgtcatccttaagattatatacagggcaagatcatccataattcatctgccagtgaacccgtctatgtcttctcatgtggctttttctgttcttttctttttaatctttaagacatttcagttgttgtttgacatttcacccatacaaaatcagaattagcccaatgcagtgaggaaagacaaaggtttaagaaaatataggtgcatatttatttgatcttgggtagaagcaagggatttctgactataaaagccaggaaataaattacaaggttatatagggtgatggatttcgtgacacagaagtcagaaatatttgtaagtaaaaatgcagtcacacaaaagttaaaaagagagcaaccccaggaaaatatttataacacagaagattcacaatagttaaccgtttttagtatataaagaacagtaataaatagctgagagtctagtgtggagaagagtgtgaactgacaacccatgtgagaaagattgccagtcagtaaaaacctggggaataaaaaccaacaacccagctttacaactgggatgtaaacttaaaaagacagaacgggcctgaagagacggctcagcctatagagtgcaggccttgcaagcacagagacccgagttcaatccccagaacccacgatcaaagcggctgatcatcttaccttgcatttactattctgatgctggggaagtagagttaggtagagcccaggggctctctggctagtcagggtagctaaatggaagcgctccaggccaagccaatgagatatcttgtctacaaaaacataatagcacctgaggttgtcttctggcctccatgcggttgtgcatccacatatgtatgtgaaccaacacacatgtgaacctacgcatagacataagcacatagagagacagacagacacacacagaattattttctctatttacagtgttaataacttaaacagtgatatggttgggactgaggtgatgtggttgtcagcattgtaagcgcccatgatgcttctggagtgcagtatcatagttatatagtcttaacaatagggcacatccaagggatgtgtgacaaggatggtcactgcgggcacatcccagtcctcaagcatgtagtcagtataggtcaatgacttctgtggggcttcttgatgcaactattcttgagaaataggaggactggtgtgactctgctgggggagagtgtgtcctgctagttcccaaggtattatattatattatatcaatatagtccactgctgtgcttctatgatcattatcaactatgctgctatgtttctatgatcataactgtgtatactgtgctgtcatgtgattggcgccaaaatctgcaccaccaccactacacacgaggataccgtattatgcctcggtgtaacaggtgcccacgttgtacctgtgggatagtctcaggtgcagtgtaagctttggtgcatctgctatggagtgtgttgttaactggactgtcacatgaccatctggttttagatattaaagggtacatatacactgaccctttaatttcatctccagaaattgattacttctagaaactaattagggacacttatacaaggtaatgtaaaattgttttatgatatcatttatgatggaaaaatgaggaaacaaaattaaaatatctagaaataaagaatgccaaaaatcattctaatggtttcattttatagttgtaaaatgaaagggtcagatcacgtaatattgaataatgtgatcttacaaaaagaaacgtcacactatgcttagttgaaaaattaacaggtcctggggtacagacctataattccactggtttgaggaaccaaggaaagatgatcatgagttcaagccctgcctggacaacttagtgagacctgtctcaatttacaaaagtaaaatatggctaagaatggagctcattgtagtgtatgtacatgcatgtgtgcatgcgcgcacgcacgcacacacacacatacacgcacatgcttagtgaattctcttttagatgcaatatttatgtttttttaaggaaacataagcatatataagttaatagaaggaaagaaagctaagatttatgacttctgttccctggatggtagattatatgtaactgcttggaaggaacttgcaacctattttgcatatttgctaaagcaaatacttttcagttagggagtctaataaaggataaaataaaaacaaatgttagtgaaagtgaaagagtaagcttgggctagacgcatctgcgtggaaagaacccgagacgtcctagacgagcaaagacattgaccttgttggcacttttgaatctatttttgaaatgcttgcaagtacaggttcttgcaagattgttctgaggatgaattcagagtacaagaaaagagtgggactgaaaagactcagtaaatattgctagaatcttctgttcccttcttagtcttgtataaaatgactgatttggatctgctgatcttaaatggccttcaaagttgctcctgcaattttctctttattctatgtgaccacagcctcttgtttgattctcccaaaatgaaggctatcaggctggctgtcaaggctaaatcagttgctatgataaaatgtttgaatgtgtatatttatattacatcatatataaccttctcaaaagctacgtataggtatttcctttctgtctcttctttcttaccattgtgacagagtattctaaaattcccagaggcggtaaagttataatcaaacagttatgtgcataccttgtcagtggacatacaactcatgtagcttttgttaggaaggctggcaaagtagctcagtgagtaaatacacgtgcttccaagcctaaaaacctcacttcaatccctgagacttaactatcacaggaatagaggcatgcgtgtggttacaagaacacatacatacatcaaacataatgtatacatacacacaataaataaatgattattttcaaaaaaaattgaaagcatcttcatgtattttcactcaacaatctcattgaaagtaatattctaagaggtaaagaagatgtgtgtcatagtttctcaacaatgagttctagctctgtcctttctagggttttgggggaataatacagaaacttagttgcttgtattcatgaaacccttgtatttagagcctctttggcaagggacccaagctggtccatccagaggattgcagtgcgatggcttcacatccctgatacagttgtctgtctcctttgtctagatggaagtatccagaggacttcatttatattcataaacttggatttacatctgaacattgacaggaaactgacatgtgaacttgactaatatgtgttccttctttgggcatgcattttctcgtctgtaaaatgggtctgctcacacttcctttgcaaggatttgcatgtggggagataagaatagttgatcaaaccaaatgtccaagtctattcttatgcccttgtacttttttttctcgagtgaattagaatgatagtttagatgcttaagtatccttgtgtacggattcttctggaatctctaggaaacagccaggctgccagagtcctcattcaagtgtaacctccagacagggctggctaaaacctttattagccattggaaccaggggtggctatagggttggtgggaattctccatcatttcttcaagtgtcattaattccaagaaggtagtttaagatatgctctttgcgattattttcattattattttatattttgtgttttgcatgtgtatgtatgtatatgtgagtgtggcctatgtgtgtggtgtatgtacatatatgtgtgtttaagtatgtgagcaaatgtcttttccttattctctgtcttagtcagagttttactgctgtgaacagacgccatgaccaaggcaacattataaggacaacattttcttggggctgtttttcagattcagaggttcagtccattgtcatcaaggcaggaacatggcagcatccaggcaagcatggtgcaggaggagcttagagttctacatcttcatctgaaggctgctagtggaagactggcttacagatagctaggatgagggtcttaaagcccacactcacagtgacacacccattccaacagggccccacacctactctaaaaaggccatacctccaaagagtgccactccctgggcctagcatatagaaattatcacacttccttgagacagggtctgccagtgatagctgagtttgagacagggtttctcactgatcgttgagtttttgacaagatagcccactgatttttgagtttgacacaaggtttcccactgattgtgcagctatgctcgcaacgatcaaacctagcaactcctctatctccatatctcatagccctggaattgtaggtttgttcatagcccccctgtgcagatttttatgtggatgctaggatcatatctccagtcttcctgctagtaagcatgcttaaccatggaatcatatcccagatccccaagatagaaccttttatggaaaatgttttcataattcaaatgtataagttttagatataagaaaaaagtaatagtatattttatgcttactcaaacatccccattggttgtattttttttcatgtgctttttaaggctgcttgctttaacacaactgataccatgctatgtgaatggccatacattctgatttttttcattaataaccatatagtataatattcactcattcatgtttttaaaaactctttgtactctttgtaaaagtatctttacagatatgactcattccatttagtaggtagctgattcataattattcattttgattattttcaaatccataaaacagtgctgttttcatttctaatagttttgtttcttgttcttggtgtcaatattagttattccaaaaattattttcttcttcaggctttctaaatattaagctaagagctacagaattatattttagttcaatgtctgaagtgatatatggtaaaatctttaatacatgctagttatttttttaatgttctattgcccataattttcatcaagaattgaagtggcacagtggttccgatgaaaaagcatgatacaaaagaaagcagactgtgcctccctgactcggagtgactgctgatggcaaatagaaaatgacctttgcaaatgacacatggaatctgtctctatgagtgtttatgtgtgtgaagagtgtgtgtgtatgtgtgtgtgtgtgtgtgtgttggatgtgcatgtgtgtgagcaagagccaaaggaggacactgagcatcttgcttggtatataatagcttttgttttaatttttgttgagaattgggatcagtggggggataaaaagaaggtatgttcctttgaggagataaagaaagggatttttctcttttctgtctccagtcttagtggaacttgtaccaattttctggagtcggtcacccagcactcgcaattgcttttagcaggaaggatcttatttcaggagcctgtgaagaggaaaaggaagtctgcagactgagggacagtgttgaatgacagaggctgacaggagctctgcttgtgtctatggtatggaaggtatgagaaaggctgtgtgtgtgtgtgtgtgttggagtgcaatgtgtggccagagagaatctgggctacaagaagaatggagaggcaatgacaaacttgcccaaattcttacttgctgggatgggcaaacgtagcgccctcctctgggcccctagatttggctgtgatatgacttagttgtagttagggagatggtatgaatggtgtttatgaatggaaggtgctaccagggaaggcagctgacttcactgtgggaaggcctcttgctgagtgcttcctcagccatcttagtctggtgtccagctgctgtggtaaaataatgctgacaataaccaagaaagggataaagggcttatttggctcagtttcaggttacggtccatcactagtgggctagtcaaagcaataggatcttgatgtagctagtcacacaacagccatactcaagatcagagagcaatgaactaatgttcctgcccagctcaacactccttttcatttgctctggggcccagcccatgaaatggcaatacccatattcagagtgtctctttcaaccttggttaatctgatttaagaaaattcctcataggccaacccacaggtcaacttaacctaaacaattcatccttgagacttctatcccagatgcttctatgtgatgtaaagttaacaaaattaacaatcgtgtcctatgatacaaaacctgtttgtgagctcctgactcgccagcaagaaagatgccacaacaggatccttctgcacacgtttattgggagagcttgattgcagaggcgaaaaagaccccgaaccccagtactggcgctgcttatataggcctaggagaggcgtgtctacacccgattggttatgctttcaatacctcatttacatgtccacacccgattggttatgctttcagtacctcatttacatgccccgggccaggcagtgactcggcaaaagactctactgcacatgtgcactttggttgtttacccaaacttatgggtggtggccagcggtagccagcgccaccttgtaatggcgtatgtggcttcccacacctgtttatccaggatcacaagagacagcactcaaagacataatgacagcactttaggggttttcctgccttctgtttacacaccccagctctctttctaatgtctgagaaaagtaaaaccccggtgcctgaagtcatcataccaagtaggatcttgtttttataactatcagatgatgtagctcattacttgggaactgtccaccatttgtagaatgaacagaatcccagtagataattccaaagagaatttattcatttctacccgaggtaggtgtgtgagcctgcttggcttttccctattttatgctgtgtgaaattccaagcaggtatctcctctttgagccttcagtcacattttgcttggcaaggtaaagatgcttatttatatttaattagtttgaagcacataagaggagtagctgctatagaccatgtagcattccattctaagtgatgttagaaacagaataatctccttggccagtataggaacacataagcatatgaaaatggcattgcaaggcagtttctttttgtaaaaaaaagtacgtgccagaatccacaccacacttgcaaacacacttggccaacatggcctctgtcttcctgaagtgtgtggtgactgtgtctcaccctattggtggggactcaactttaccaggagatttgattagctaattgatgcaaaggggaaatttcaggaaatatgaactcttgccaggctatctacctttgatcggaataaaacaaagacaaaaagcaacaggtttctcaccacagagaggctgcatttggggctaaggaatgagcttgctgtgtgaacaggtttactgtttggggaagatagtggtaatacaccagagatcaagtcagacaagtctgggtagaaaaggatggggaatattgagaaagaatgataaagagagagatgaagacagtgataaaaagctgtgacggtccctctgaagaggtgacatttgagctgacatttgaggcccaaatgtcaagagtgaagctgccacatgaaggcttgggcagaatctcaggttcttgtacttgcctttctgtctccttcctgagacttagaatttcttcagccattaccacatcaaaatggcacacagtcatccagttgttgaatcagatacccaggtattagacttacatctatctctcgatatcaaccatattcccggccagaaggccagaagtcatccctccttccatctctgctcctacttctggctaccctcagcttggctgcacaacctcctgataagttttcccatctccactcttgtctttcttttcccacatcccataattaatctccctctagcagttgaattgtgccgatcagtacagtaactgccagccacatgtgagtgtttaaaaggaaagtagttagaggatccaattaagcattcagtttcttagtcacacttgccatgtttcaagtggtcaacaatcatgtggccagtgactaccatttttgacagtatatccataggacatggcatcaatgcaggaaactcatgtggaaatccagaatcagtggtgaaataccaggtggtggttgttgttgttgttgttgttgttgtttcttcttcttcttcttcttcttcttcttcttcttcttcttcttcttcttcttcttcttcttcttcttcttcttctccttctccttctccttctccttctccttctccttctccttctccttctccttctccttctccttctccttctccttctccttctccttctccttcttcttccttttcttcttcttccttccttttttcttctttctttcttcctttctttctttctttctttctttctttctttctttctttctttctttcttcttcttcttcctcttcctcttcctcttcctcttcctctgcctcttcttcttcttcttcttcttcttcttcttcttcttcttcttcttcttcttcttcttcttcttcttctacttctacttctacttctacttctacttctccccccccttctctctctctctctctgctcagacccttttgatagctcccttggactaaactccaaacactcactcctccagagcctcacagtctgcttcttaacagttcagaccagatcaccctcttcccttccttgaccacaagtttgtagtcagacccccatgttctatttctagaatacaggagcttgtatactccttggagggcttttataagaatttacaccttgagttgcctttctacagaatgcccatcttcctttctccagcacatcacaaacctttgtgttgggtactaattaatagcagctgccattttgatctcaaaatacacatggcagcactctgatatacgagtttctaaaaataaaagctttgtctgatatttaatgctgtgacctcggtgcctagaaattttcctggcctatagttgggtcagttactctttattttaagatcaacataagaaagcagaaccgggggagccttttttgcctgaacttaagaaaaggcctttcttttccttggctgacatctgccatgagcatccttcataactgagtcccatagtgggttgatcaattccaggcaggaggaagagcaaatataaaagctgggatgtgtttatgtgtctggggaagaacaaggaaacaagcaacaaaagccaaacgccaagactggagtgtttaatgcacattttatgaaggagaccttgtaaagttttacacacacacacacacacacacacacacacacacacacacacacacacacaaagagaggtgggcaggacacagatcacatgagcccaagaaagccacaaaaaggaaattatattttattccaggttcagtagggagccatgggaggtttttaaattggggtggggagagatatcacatttatgatttattcactctcacagttttatttccttgcctttatgggcaagtctgttttttaacattttttacctcaggtaaaactactacttgggggtagtttttttctctgagactgtctttcccaagggacagtcctgctttcctggacaatgctcttagagtgagcaattaggctccaagcatactttgactctttgaatagccttctgatttgcaccattgcaaagtttgaaggttaaaatccttggcttcctccagaaggtgacaggggcacacactaaaactaattagcaaaaaattcaaagtggtggattgcagccatgtgctagggttttgaaatgcaaataaaaaaaatccttgcctacttcttccctggaaaggggggcagggtgggggtgcacctctgagattcctgcttggtcttagagttcccctgtctgagatcacatggcctccatgtggagacacatatgacatagcttgttcttctctcatcttcttaagaccaaactaggggaaatgtgtccaaattttctaaaatgttccctcagttctaagttgctgtacaggaagcagaagaacctttggatatgttgttgctgtctggaaacggctacaatataaactttatattaaaaatatgtatatctgacaatatccattttagagatattgaaatgtgaaacaagtctgtctgttatctagctgtgcatcgatctttatcagtttatcataaattacttgtgatctgtgttggtttaaatgacccccctaccccgctgctctcagttggtagaactggttggaaggattaggaggcgtggccttgttgaaggaggtgtgtcactgtggccaggctttgaggtttgcaccattcccagtatactctacactctgtctcctcatccttgatgatcaggatgtgtgccctcagctcttcctgctgttatcatagactcactcgaagactctgagactgtcagctcacttaaacattttcttttattactctccattttggtttctaagacaggatctcagtggattagctaaactggttgaccagtaagctactgggatcttcttgtctctgactcttagtgttggattacataatatgtgccactatgttccatttggcaatccaaattcaggccctcatgtttgcatagcaagccaccccaagccctggattgaatgtatgtatgtatgtatgtatgcatgcatgtatgtatgtatgtatgtatgtatgcatgtatgtatatatttatccatccatccattcatctatttatctatccatttatcatatatcctctttcttctgtttataattatccatttgtgtctttttttttaatcacctagctgttgatgaaatatcatggtttgaataaatgtgtctaaaggaccatatgacaaagacttgatttttttatccatggcactgaggcggcggggggggggggtgatagaatctctaagacatgggaactccagcccaagcacagatctagtcattcagggaagtaagttcttgactcagattagtgctgtggatatattccgaatgcaagtttttattgcatgatttagtctcttaaagcattctaaatttttttgccctatgagccgaggatcatcttgcctctcagctgtccaagatgtgtatgtacttactgctcaagaatcaataagattgtattgctgggattgaagcattggatagagatcagccggaagggacacatggaagaaaacttagtgggtagctatgccagctctgtagcaaattcttttctgctactttggagctgggaagtcccaggtgaattccttaacctctctgagtcggcttcctcaaccataaaatgagctaaatgagttctcaacttcatctctatagttgctgtgactgattgtattttttttttaatgtatttctgaattcagatttactgaattctttaaggaaggcaacatacctatcacatccagtaaataacattccagccagggctggatggtgctctcaaatcaagtacacctgtattttgaagcaagaagcgtgaacatgctgcgttgttctacacatgtgtagttcctgcatttaggaggcatttaggaggatggtaaagttgagattaacctgcaggatgacaccctagattagaaaaaatttaaataaataaatatttttaagtagatcatgggtataaatgaaatctttgcagcaaatagatttttatcaaactttaaaaagaaatctttgacgtctaagcccttggggatttggagttcttagaatggggccagacttctgcatctgactcctgggacagcttcatggcttgtgtgtaggtaaaatgctcactgaccacactctgtagctcatggtagaatgctcagtcttatcccaatacaattgtaaatgttttcaaattatccccactgagtggagctgagtggagctttcccagagcctgatggtcttggccagactcttatgtttgcaaccagaactcctagaccctaagtttctcttcccacagccccgtggacctggctgtcctggcacacggctcccacaagccaagcgctatgttttggctggcttttagttgttctagtagagaaggaaggagctaaatcagaaggttgccttcccgtcccacccctaggtgaaatcatcctttctgctgatcttttctttttcatggttgtaaaatagggagaaaattgagaacaatagcaacaaccaaaagagcattttcctcaaggcgagcatatgtgtgacactccattaacgctaagtgacatcttcttccatctcgcaggaatcaacacagtattcacgttaaccagtcatcgacggagccacaagcggatgatgtcctgtcactttccatcctatcagtcattttcgggcaagtgatgtgtctgtgatttccacttggacacagtcagtcagatgtttttagcacctcagtcatttcccaagtgctcagtggatcttctgaggctcagagcagaagccaaacaggatccacagaagcagaacccaagtgcctggctctttaggctttcaatggacataaagggtggggacttgaggcactgggaaggccctatctggggactggcctctaaatcccaggctaggagatctcagcagggctcatatactctctgagccttgacttacttccttgtacataagaagtaacagtgagttgtgtgtcaccaggatgctctagagaatgaagaattggtataagcaatttcccttcactcaacctttgatcaccacaatgggctcatttgtgtaactcacagttatgacatgggagcttcttggttgtcccaaccctccccaggacatgttcatttgtgagttcatttgcaatattgcttgtgttcactcccacattcatgtctccatccatctcttcatccatccttccatgtgtccatctgtctctccgtcagagccctgtgtgatagctctgagattggaattagggatacaaaggcaaagcaaacaaggatcgactttgccccaaaggagctccgagagaaagggacaagaccacaggtgggaatcctcagtcaggagtgggcaccatacagtggggaacctgagaggaaagagcccagttccttcagggttgtccatagatggaagagatgccctaacaccagaacagcaagctgaaagggggagggtagagcaagccaaaggagtagcatgtgccagctttgatgttcaaaaatacacagtccggtagagagcctgaagggacctttgtcttggctgataaagtatataaggaacaaactggggccaggtgtccagcatctatgagcacagcctgagaattgggttttgtcttaatgcctgggattggcttgtcatctactgatggaagggttcagacaggagcttgtaagtcttggtttgaggctttaaagttcttcatgacatctggaagggactggtcttagatgatataagactggaggggttttaaatgacaacctaggaaggagcagggaatacaaatgccataaaggtgtttggaggcctgtgggttagatccccagggttggtcttaacaagtcattacagatttagtggcttaaaacagtgtaaattgttctcttagagctctggaggttaaaatctgaagtcaaggtgtcagctcgtcccttgaaggctctaggagacatctgttccttgtcctctcaggttccggtgactgtcagctaagttcgagccttgtgggtcttgaacttcacatggcctttttatgtcgagatccctgggccttctcttgtgtttctaccctcccctgggggtgggggtggggaaccataaaccaagacaagctaatctcaaaacctttaagttgttatatctacaaaaaccccttttccaagtacagctagattggcagctttgaaatcaggaagagtcctagctttgaggaactatctatctgtggatctatcacaggggtgggcagctccagctctcagtaggtttctaagaagttgtagaggaaaggctagccctctgtacctgtgccactgcagtcccctgtgagcatggcctgctgacgggtgctgtgtcctctccgtaatccttttgcttctctaagaagtgggtgttgcaacaaaacataagatggaagtgaaatcaaaggaaatctttaaggagctttaaaggatggttgcttgtagagaatcccattttctctgatggtgccataggtataccatgatagtagaatatattcctgcaaggtgattcttcagccttaccaccttgccctgctggatgatcaaatgccctgagctgcagtcttgattgcttttgcctggcttccacacagctgctcttagttatattcatagtcagctctatttttatgtggcaaccattatcctgagtgaagatgctccccaaatcgcactgtctcattcactcagtcagagttcagggagcactggatccaagtgggtggtgccttctgcagcagacacagggacaccataaacaaagccccggtgctttgggagtagggagctacattgattgtgatgattacataatgggggtcagagggagcagagaagacaaacattcccagtaaagcacaggtagatatagccagagagaatgagaagtgttagccagcttcactggatggaaactatactggctgtaatctgccattctgacactaaaccagacaaactaaaaaaacggtgcctggttgtgttagtttcctctcttgttgctgtgacaaaatactgcaacttaagggagaaagactttattttagctcatagttcaaagcatgacagagggaacaccaaggtagcagctggtcatctcacagccacaatcagaaatcagagaagggtgagggcaagctagcattcatcttgcttgccccttttatatagcccagtaccctgcacagtaggcaggtgttcatccccaatgatgataaccttcataagcatgcctagaggcccatctcctaggtggctatggatcctgtcaggttgcaaattaacattaccatcacagatacccaatactggtggtgggaatgggaactgtatatatttcaggagtacagttttctataaatagtctgaaaccctccccccaagtaaatttgtattatccataggtcccccacttttttgtagtcttcccaaacatgcattctccttcatactgttgtatatttccatcatgatggttgactcatggattagaatgttgtttgtttgtgatgggggtcttactatgtagccctggctggcttagaactcttgatgtagaccaggttggccttgaatttggggtgaacctctgacctctgctttcaaaattctgagattgtaagtatatgccactgccttctttttattgtttggttgattgtagtatgctaggtcctgctgtacctgcctgctggacttactgtctaagttggagaatgtctataaggtaattcataggagagagaaagagatttcaagagccaggggctgcagaggacagctggaaaacagtatttcctggacatgataaggtatatatataagctcagagcagctgagacagtacacacgcacacacgcgtacacacacacacacacacacacacacacacacaccccatcctgcatccagtcttagggtttcaattgctgtaaagaatcaccatgaccaaggcaactcttataaaggaaaacatttactcggggctggcttacaggttcagaggttcagtccattaccatcaaggcagaaagcatggcagcacacaagcaagcttggtgctggagaaggacccgagggtcctacatcttgttccaaaggcagacagaagaagatggccttccaggcagttaagaggaaggtctctcaaatcccaccctcacagtgacacatttcctccaacaaggccacacctcctaatagtgccactccctgggccaagcatattcaaaccatgacgagggcacaaggtcaaaccagccaagatcctactaagattgtggctgttggggatggtgtgctggaagagttcatttttttcagggattcagacactgtctgggttatccaggctctagaagacatctctacattcactttcatatcttcctaaagtctctctctgtctctgtctctctgtctctgtctctctctccctccaccccctctgtgtgtgtgttaggggttaaaaacataatcaaaccatcgcaaatcaagtaccatctaccatatagctatgctacagatggaaacaactgcatacatacagtgctaagtggactcagtgtgcttgcaaaaattaacacatatgaaattctcaaaaagaaagaagaatgcaccccataaaaaccactaagctgttaaaggctaggctcacaacccaaaataaaaactattaagttcatgtaaaattgtaatttcatttagtttatttatattattatttatataatatgtgtatttattatattttatgtactttatttttaaatcaattttatttttcatttattttactatatttttattcaattgatttgtggctcaggcgattgaatctagggtcatatacgctaagcaagggctctgctgctgagctttatctcatatttgttttgagacagattttcatagctagcccaggctagccataaattcactattctgactctgcctcctggtgttgaaattacaggatcacaccagcatgccctgcttcaaatttgtcttaaagtaaattaataaaaactcaaaaccatggcctgctaatttttgtatgactttttaaaagttaagtgtgctcttgaagttgtttccatctataatatagctatcagatactttatttttggtgatttgactatggctcccacacacacactttatggagataggaaagtgatacgcatccagtaatggctgcacttgaatctttgagttttgatgctttcctggctatcagtgtataaccctgagatactgtctgaggatgctgggcacctgcagtgaacaacgatccatgagagccaggctgccatgaggagaagcacctgatgtgccatacacgctgtgtggcggactggggacttctgtggattagatgtgttcaaaggatttctattttactcttctacctgtggattagagtccagagggcacctgcaggcaggagtgaacacacctcctaggtacattcacgttaaaacaaagccttggactcgggatttgtgggtaaggggaaacatagagacagatcattaaaggaatgcttccaaacgtggatgttggccagaaagctggggaaggtcagaagctcaaaggccttgagctaccagagtcctcaacgagtcatttatatgtcttcttcctcatgtgacgatccaggcttttttttttttcccagaataccctgtcccttacatgtagtctcagtggggaagcttgcctagtctttttggcaactggcttcttttgtatactaatcttgagtctctctctaccctactctgctgcatgttataagagtctcatcttaagaactataaccctactgtaagcgggagagcctctgatgcatggaatcccattgtacaattcttctttgttctaccttcagaagtacggtgctgcccacttgcaacaggcattagtgggctactcaagccaccaacagcatcatgctgttccctggagggatgttcacaggatctcctctgtctgtggagaggtgtccatttgcagtcttggtgtgtgtttatttaaggtgtgaatttgtgtgtgcagttggaatttcagaccagcagcttccccacttgtggattcagctaactgcagatgggagatattttcaacgaatagcacagccgactgaacaagtccgggctcctttctcttaccattgtcccctaaacaatacagtctgacatggtttgcagagcatttgcattgtgtgagaccttttttttctctaggattgatttaaagcaggaggagatatgaattaattcctaaatatccttatatttctgacgtaaaatacacatgaccatgtcctacttttttatatatggtatgacttgattcttagcctttcatgcatggctgtgagtggctatgttcatgagtgcagtacccatggaagccagaagagggcaatgaatcccctggagctggagtcacaggcagttgtgagtcacctgatgtggatgctgggaatggtcttctagcttctctggaatagtagtattcactcctgagccatctttctagcccagtacaaatctttgtaaataaataacactggagttgcaattaacaatttacctttgacctcacgattggacaatataacttatctaactatttaaaattctctgttaaactttatgtgtactgaccttcttactgtcatctaaaaacacactcaagagccgggtgtgttggcactcagggaggacactgagtttaaagccagcctgggttataacataagaacttgtctcaaaaacaaaacgagaggcaaaatacatttaaaccctcaaatcacagaaaaggaaatcctctacaaggatttgacacaaatcagttattgattgcatcaggcctggcttttctcgtttatgtgttcccgttatctgtgctgcagtaggcagtagggaggcgtgttccatcctagcactgtggctggtgctctggatttagttaggttccggcactttgctttgcctatctcagagcagcagagctgtttgctgtagaaaagatcctggtagttaaggtttccttgtgacttttacctgttatcaacatgagatggctttccctacactgctcaatagtctgtctttggattcccctttgatattggatactgagagacctgcttttttggttttttggtttgtttttttttttttttttgttttgttttttgttttgttttgttttttttctggacatttttcttttcaacttgctcatttttttttcccaaacttaacccatttgtaacctaattgcaaaagattgaatctcacggaaaatacctggatacactccaatcttgatttaatttctgtgtctatgtccttcactaggcttcactagggaagtaacctgagggacttacatgagacagcatgactgttctgtgctgactgagggccaccatctttacttcctcctttttattttgtgcctttttttttttttttttttttttttttgtcttaaatttgtcttcatactcactttccttctggttcagtggctggccactgacagtcttttggggggcaacaggctgtcactggctgtcaccatcttaatgattgcaatactaatgagaggagtgattcccagcagtaactacagccaaagctgaaaaggatggccatccgggccttatagaaactcttcttaaccagacatagtttggctattgcatgcttataatcttagtacacaaaaggcagaggcaggaggattgtgagttcaaggccagcctgggctacttgggaagacccaaatgaaaaagaaacaatcgaaaaacaaacaaaataaagcctccaaatgaaataaaggttctgccagtccttgttttctgattatgcaaaatggaaacctgcctttcattttgctcttgagtacatttagtggccttgacacatttaaatttcagctttccctacagcttatttctaattgttatccatgtcttaaggtaatctttcttttctagatttcgatggtgtagttgggaatttttacacacatttctgatttaatcattattagttaacattataagatgagatatcatttttaaagaaccactggttgcgtttagagtctgtttacaactgtctgttaatcacttttaaagaaaattctacacttagctcattgagctcccactttcccaattcttgaaagcataactgcactttatgtctcaaaaatgactccgcttggcattgctttcagtgcttgacagagggagagatgcagggttgcatttgcatctgtaaatatttctcagcatcttccaaacatgagcagaaatgctttaagcctggaggtaattatcactaacccttgtagcctggtgatgtctagaagtctgaggcgagtcatttactcagataaatatcttgtttttcttctttgaatcttggaagaaatgtgatgcagattagtaggaacttcatatagtttattaaaaatattctcccaatttttaaaaaggatttatctgtatccatataccaacttctcatttctgattcttcggtctggtcattctgttatcctgggctttctctcctactagtatctgtagtaataagttttcataatcaaccaaaggttctgtgcattttgcttttgtatgtgtccatgtacatagtaatggacttcataaagacatatgtgtcatggactttggccattatcccccacctcctgtgtccctcccatgattcctgttccttcccctagatagtcctgctaatttctactttcttgtctctcatatatatatatatatatatatgcatatgcatgagtctatatctataagggtttgcaaatgaaagaaaatatggtataattttgtctttctttatggttgaacacagctccattgtgtagatggaccacattatcttggcttctgttctccgacagaagactgattctctaccttggctgttgtgagtagttcagcaatggacacggatgtgtagcatctctgtggtgttgacttagagaccttccagcatacacttaaagatacagctggagctcatgggaggtctacctttagctcgtctgaagaaactccatactggtttccatgatggtgggactaatttacatttctcccatcagtatataagtgttcttctgttttctgtgtaccttcttcactattagttgttatttatgttttaattggatgagatagaatccaatggtattttaatttgcattttcctggatggctaaagttgctgaagttttacatatttatttttgaccattctcattctatcttttgataactgtttattcatttagtttgcctattgatgaattgattgtcctgtttggtttccttgtagtttttaaagttatctatgtattctagatgctagaatctgtagtgttcaagatcaggaactcagctaagcacagaaaagtatcaccctgtaaccaggcatgagatagtgatttagagatctactgtgtcttttcctcttaatgaagcatccatgttagtttcctttgctgctggaacaaagaataacaatttcagtgacccaagcgggcaccaattaattattttgtagcaccagaggcatcagcagctctgagcttcttgtggaatctttcagggagcatctttttcttcctccttttccagctcccagaggatgcctgcatggggtacacagagtatcacatcctgcccactgctgcttccattgaccccatatttactacagggaaccttgtgatgacattgggctcaccaatgtccaggaatatctccttatctcgagagcatccatcgtcccagttgcatattcccctctgtcctgtagggtggcatgttctcaggtttagagattcagatttgggtgtgtctgtcgatccttatttagctgagtacaatgtctaccgtggaaggctcaggatctcctcatctacactctacccatgagagccagtagattttgtccctcctcgttcctcacttctgtcccaaaggcacacatttccaggatttgcttcctcccttatgaagaatcttttgtgtggatggatgttattagctatttattttattctgagacagtcattcctcgttctgactgaatgtaactatgctttccgttcaatggacttacatccatatccacctagcatctgattgcatacactaattaaaatagtcagcactcagagcactgggaccatactatgtagctggactttgaagggtaggtaaaatatgattatatctccctagagaatcatctctacagtgatctctctcaccatcttctttcttttatttctgggaaattttgttcaccaatcattgcttccatagtccatgaatcggctctgaatgaatattaaaaatattagagttctctttttgaccactgaataccaacattttcctttaattgcctatctttggagtctttcttagcttttaaaaccagatcttgttttatctgtttatctgtttttaaaaaagaagtgcctttttcatggaaaccaagtttccttgaatttccgtagaacacaaagcagatcatctgaaatttaatggcgtttcatgcagggaatcattttcttagaaaagtaaatttctctttgttctttttattttcattttttttttttagtttaaaaagtgtatcatcctaggccctgtgtttgataaactttttattttttacgatttataaatggatatggctctctctctctccttgagtgttctctgacaagtaaatggattatttgggtgctttttatcctctgctctcctgttacttttgacatttcttgtcataggtacagctgcagcttattcagtaaagcaggctgtgagtgtgtgcagtgtgtgcagtgtgagcagtgtgtaccaggctgtgagtgtgtgcactgtgtctgaggctgtgagtgggggttgtagtgtgtcccagggtgtgagtgtgtgtagtgtgtccaggctgtgagggtgtacacgcttgtgaatgcatgttacagtgatctaaccctggtgggagaaatgccaacagattcatatgtttattccttctaaaattctagtcccccaaactaagaggtgtggtcataatactatccatggctgtacccacatgaattaattcttttatcaaaggaggggctcaggggactaggtttggtccttctatccctcgtccagcatgtgaggctgcagcaggaagataccacattggaagcggaggacacactctctctagacactgacttgctcactgcctcgatcttggacttgcgagcttcagacctgacagtagtaagtaaaatattatgaatgatgctgatccccattgagcttcaaatgaatgggactcaaactacgatttatttattaggctttgtgcatttactgggggctgatccctaatctcctcctctaaccgtacactggctactcccccaactgtgctccccaaatacttgctgtttgattccttctggattatttctgctccagcagtcaggtgtcctggggaggcatttcacttgggtacatgctgctggcccatcatgactactgnnnnnnnnnnnnnnnnnnnnccgtatccctctccccctccccttcccctccctcctcacttctctcctgggtcctacctgtgacccccatcctggtaactcaacccctacctctctctatctacccactccagtaattggctgttgccagttttatttaacagtagttttaagttggggagtgggtttatatagcatcaattggtatatgtgaggatctgcttgttggtggcaactggatcttggtggccagtatttagcatttgaatacatagcagcaccagaccaaccctcaacagcaatatatttcatattatttataaatcatttaaggtactttgttactgcattaggttgtgtggtagtttgaaagaaaatggcccccataggcccatagggcgtggcactatgaataggtatgtccttattaaaggacgtgtatctcagtctcttcctgctgcctgtggatccagatgtagaactctcacctcattctccagcaccatgtctacctgcatgctatcatgcttctcactatgataataatagactaagcccctataggataagccagcccccaattaaatgctttcctctataatagttgctgtggtcttggtgtctcttcacagcaatagaaaccccaactaagacaggtagtggatcagtctcataaattatccagtgtaaagcacagatgggaaatgtaactgattgtcatcttctaattgaagttcaaatatgcgtacttggagaatgttcaggagctggggacttagccttcttagcattgttagcagtgtgcagtggttcttctagatgaaccctggtccgtgcaaggcagtgcttgcctttctatcatgtctccatgacacacacaattggaaggaggacagatttattttcactcctagtttcgggggttcagtgaatggttacttgggcagaacgtcgtgctgattataagcacatggtagaggagagctgttgatgtcacagcacagaaaggaacaaagaggcagttagggataaaatgaccgattcttggtgacaccttcctctagccaaatgtctatagtgtccctaaatagtactgcccactttggcccaagtatttgtgagggacacagatctaaaacataacagtcagcgaagggagatctgcccctgcgaagggattaggctcttgggagaggaaattcatcagtttcaagccactggaggacagagcttgccctggtggcctgggggtggggatgggaggtgataatatattctcatgtgctggtaacactctgttctgtgtgcattgctcctcggtgtaatcattaataaaagtccttttctatctccagagtgtcccagtgtggatgattcattgtgtgttccttagtaaaggggtgggaggaggtgccagctgcgaggtgcaggcaagacaaatgtttgagcacagtgttcagtgttgttaggaggttactcagctgctgtctgcaggagagcgggctgaggttggaccagacacgttttatgtattggttttcttttctcctcctccttgctctgctctccacctcttcaccaccctaccctctcacgattctcatttggatgccatctcaaaggatgtcatggaatttgtatgtgagacacggagcttgcttgcagctcttaactcttcaactcctttttggccccttgcttgactgaaggcaataaatggggtgtcatttaagagagtgtgatgcacagatcataagtcttaggccaaaagtataaaatatcaattgattaaagagtaattaatgaaaacctaattaaagctgacgttctgtgcatggcactcctggaatcctgggacagtctcaattgctaactttcctcagagatttccatgtataattgagaggtattaggctctaatggatgggattaatatgaaatttaattaatgaaaaaggaaattaagtctgagttttgtttaaagaaatttccagagatggatacgtcacagtggaacagtaggtgctaggggttcattaatgaaaatttttacgagtgacaggatgtcgcttatcgaaatgacacctcctttttcacggcctccttcatcctgcgtcatttgtctccattaggcagtccgtgatgtcaactcaggttgtgagaaattagaaggaatgttagatggagagagtcagaagtttgcctccattcacgaacagagaaaggacgttccaccatccttctcatggaaattcccaggatgggaaaggataatcaaagatttgtcttcttagttcttaaaaagaaattgagcagtgtgaagtcaacatagagtattatattaaaaacaaatttacttttcttacagttgtataagaaatcaacttcattttctttgcaggggccctgatcgtcccagggttgatgagcaaggtagcatctacaaggcttctgatattgtcggctcactggccatatgatcctatggaccacaaatgtgacctttcacagtctttattgttctctttcattgatctgtagttaatcacttctgggtttcgatttcttcccatgaaatgagttggggagtttaggcatgtgtgtttagggaggtcacaatgccattctagatgtctctgaaattcattgttgggaggagacctcattataaatatgcacatttccatagctgactctttctgtggctgtgtcttgagcactgggacgtagacagtcactaaaataatcactgttgtgtgttcggtccacgatcttgggcagtttggaaggtcttggagttaggtgatgcagataaacattgctctaaaacaaacattgttttcatgggtggtttaagcataggtaccttggctattctaaatagatacaaagtcaaatgtctctggctcagaatgaaggaccagtacaccagactcatagaggtaggtatcctgatcatagcttatttgtcattttgccactagctctttgttcaactataaccttagcaataaacatctattttggacatttcttggagaagaagacacgtttctgcagtctctatttgatctgccacagtgggagccacagtctagtgtgaaggtgccgagtacatactgtttggaaatgtgccatcttcaatgtattttccttccttccttaggttgcttctcttcttgtactttctgtgcccctcataataaagccagcaagaatattccggccttggtctctccgccttgtctcccatgctaccactgtggttgtaggccaggaattacaggcatcttattttaggaagccccagcttcaatatttagtagatgagatgataactatatcctttcatcatgggaagaccactaatagaaaagacttgctattagaaaaaggtattagcattaaataatcattgtaatgcatttggtcaagttgggcagtttggaatatcctgggtatgaagttagatggtgcagacaaacattattctaaaaatctactttcatatcttgctttcgagacacccatgacagcaaaaagccaacatcagagacaggtgagggaatccatcccattgcaggcttttaaggaaaagcctctcagggttcaccttgttcaattccctctacgtttatgaacgtgaactaccaagccattcgtcacattgtggcctgtagggctgtggtcaggattaaccacattaatgtagcagagtgcttgaaacagtgtctggtatacagtaagagctcactaagaggcaatgatcatcatcaatatgagtgagaggacagccgctctgtgagtccctaagaagggcatagagttctcactatctcttacatgcacattgtgtacaattgcctttctcctcttctgtattctcatctttttctcctccctgcttctcttctttcttgctatcatttccttccccttcaatccaccctaccttgttattgggacttcatctatcatagtgtatcctcattatccatcattacacctgaaccagtgtatgaacttaagaacagcaggaatgggtaggcagttagttttagaatcatgttctggtgggtaaattgcctatcatctacccatctactattctttatcactgtcttccatttatccatctaccaacctacccgcctatatccatcaaaacatccacttatctgctagtcagtcttccttctccatctacccatagactcacacataattgattctaatacatgtatctgtccatccatgtactcccccacccacccatgcatctacccatttattcatccatacagccatgcatctattcattaagcatttatccatctattcatgaatttatctacctccatttagttattaacacatacataattcataaccatccatccatccatccatccttgtacctatccatccatccccagctatcaatgcatcagtttgttcacacatacatagtttatttccatccatcaatccattcattcattcattcattcattcattcattcatctttcatcccctcatctatccaaccagttatttctcagagcaggaaaaaggcaaatcacatctggtgtcctcaggtcagattcaagtaagtactatgaaagtgatcttacatgtaagaaatacagcattatatctcattttaagagtggatcgagataaaagcagacacttcatatgttaacaagtgtcttaaattttgaacctgcatctaaaatattaagaggcaacctgtgcttttttctcattttctctgtagataatcataaatgcctctggtgatttgtatacaactctttgccttttagaatgctacctgcactttgaggtgcaagccagaagttgcaggcacatcagcattgataagcttggagactgcctccactttaggcggtcctggattactgagtggatttttatagtgttccgctaagggatgctgggtctttccatgtatctgccatcgcaaggccaccctgggacacaggagaccccagctctgcctctgaggttgggatttggtgctactcagcccatgacaagatgtaggggtttccatgttgctcctgtaaactcctgcctgtggtcatagctaacaaagtagctgggctagaagggaggcgattaccagtgcacgaacttcataaatatgagatgagacggctggggtggaaatgaaagttgagatgctcaaaaataaagcgtgaaagagccctgcccccgtctaagaacaggattgatctttgtacgctggcagaatgtacaatttcccttcgcttactacagagtctctgtttctatagaaaccaccaattttatagacagattggctctgtgagaaggcactgtgagttcagtttgaagccaagtgccatcagggcaaggcgctcccaaccccgaggagggggctttcttctgtgctcactaactagctctcgtggggatggttaatgatcaccaggctcggaacctgtcaggattattacaataacacttgcagggctgctttccttccatggacccctgaaaccactggtaggtctagagtccatggagtgctctcacagaggtcagaattagattcatttgttcatcagatacacgcagatgtcttatcatcaaacactatgcagagccctagaggctggaatatagtaatggaggaagacaggcagatgtgcagcttcatttcagctgatggagagatgtctttgtccatggccactttcaagagatagttctgatgtttagtggaggtcaagaatagtttggtaaagataggcaagaacaaagtggttcaggtacttttcgtgcataacaaaggaccccaaacttccttgcataggtagacttggtggcataggcctataatcccagcattcaggatagtgaatcaggaataccaggctagcccaggctattattgaggttatacatcaaaacaaagcaccaaagaaaacaaaaagctaatgacacagaccaacaatgcttttaggtgtttgcagatctggaccttgaagtagacaggcatggtggcaagagacttcactgttctatggttggggtttcagctgtggtgcatcaagggcaaaaaatgatgggcataattaataaacttacatagctaaaaccttggttgttcctatgccatgctggagggaatgagttcaagaacaacccttctatttatctggcagcacgaggttgggaggcctagaacagctggagactaagtgaaattattttctctctacatgacctctttcactgtctaagcttccttacatcctggcttcctctgagaaatctaacttcttccatgacaatgaacgctctgaggcttgtgacctggcttcagtattctagaccaccatggccactctattttatgggagagaactaatcactaaggaaggaatgccagaatgagtgtagggagagaaaatgggtgggtgctgcctctcagctaagaaatggtatacatgaccacaagggaaggaagtgatggcgtatgactttggagagtttccccattgagacatccagacccttttctgtatcagggtgcgactggagtggagaaaatggaatagaggagcatcataatagaattgtcatcaggagactgggcttaggacaacatgggtgatacctggtgctcatctcttcaggccagatacaggttcagagatacagtcccagcaatgtgtctgtgtggtaaataaaagcattcatgcataagtggatatatggtatgatggcagtgttgactcaggcctagtcacatgactggcaatgtcctttcagaggtgactggttatgtaggacacacttgaaactatcacagacaagatattgggttatttaactgaaatctattgagtccttcaagcataaccaaattccagggccctcaggaaataccgatctttggatctctctctcctctactcatttttcacttttgagagctgggttaaccccacaccccccaggtattctttcctgacagggaggcaagatgaacaaatgccctttccttggagctcagtgtgggaaaaggagagctcttctcttcagccaggcaaatcctggaccagatttgctttggcatatatcagatcacttaaagatccctgaataagtctctaggttgaaggcatggggtgggaatgggagagagctcggattgggcagccttcagttactactgtttatccttcaacccaattacctatccagtccagggggttgagaacttatgaacgatcagctttgggttactgtcatgctcaacacaggttggagtaaattctcctgaagatgtcccgggtgttcttagagacaaatgatccatgagatgatgtagagaagaacagacagactgccctgtcagggtgagactatggttaagctgatcaaagaggtgagcagggaagggtattgttgaattagaaaaggaagagatgtgggtagatctcagagagctgctgatgggtgtacaggaaaaggagacacgagaggcgtgtgctgagatagcggtgagcacagctctagctactggaaagtaaagagaagcagaggttggatttggccactgcacactggacaagtgtgtagaagtaacacacggagccccgtggatatgtccaactaatgtgagaataaaaataaataaaagatattgaagtggagttcttgggaaggaaaaccagcagccagaggaaagacgtacttccagctagagtactcgtcaggcatgatcacacttgcatccaatctcagctctcacttgggaggtagaggcagagggatcagaagttttgaggtcatcttcagctagatagcaagtttgaagccagcctaggagacatcagagtgtctcaggaagaaaagaaaaccaggggaggggctgtcagcattggaaatgtctttcagaagtgaagtgagtgaggttcactcatttgctccttcatgttcatgttcagtcagtgttctgagcatctactatgtgccctgggccatgtgctagggatatgagtgaacaacacagggacaatctccctgagttcatgggtttgaatcccagacaaggaagtggcaattagaggcactgacatacaattttagtgggaaaaggttttggaagttaggatgctcttgtgcactgtgtgaggagtgtgtggatggtgaggtggtgggaatggtatgtggattttgcctttgccacaagctctgttgtctcacagggagaagcagccagggctggaggcaaagggagggagactgattttgttttatattttcagttttagaaataagagtgtagcttactctttctgtgcacatgcttttctgtgccctcctgggttgtgatattctgtctagtctgctctccaagaagagatgtggctaagtcttctctgcctgaaggatggacgcacaggctggggcttgcaaggagagacactacatcagaatgttccctcattccctgcctgtagggagcaggaaggagccccatctctctttagtgtctcagcttccagggccaggggagtctgggtagcaaacacacacacacacacacacacatacacacacacacacacacacacacacatacatacacagccagatgcaaggaggatgcatagtctccctgctaaacaaataacccaaccttccagtgggtttgagtgtttgatatgcatcccttcctacctggtgtgccagctccttgtgaatggcaggctgggtggaaggcgggtagtgtgggggtgggggctggggtaatgtagataatcggcccctggataattgagagatgattgtaattaacctaatttaagaagtgaggctcaggatcccatgccttcagctctcaagcaattccaatctgaagtttctcacctgctaccccccaccccctcacctgatcctattagatgtttgaagctagagcccatcgattttgctcctcaggtgacatttggtagagtctggagacatttttgattgttatgataaggacatgtggcatctggtggatgaagatcagagatgctattgaacagggcaaagtccaggacatgagtgacccctctggacacatcagggctgagaagatggcaagaggaccagacttgaccctcagcacccatttgacaacggcaagagttggggctggaacgacggcctataagttaagagagctcatcccgaggaccccagttcagttcctagtaccaatattgggtgactagcagacatctttaattacagactctaggaatccaatgacaccctcttctggattctctggacaagtgtgttcacttacaggcacataaatatgcatagatatacacatacatgttttttaaaagtctttggacaaaatgcatagtaaaaacatgtttaaaagtcttaaaatggaagggcaggtgtgattgtgtgtacctatgaccccagtgctggggaggtagagataggagggtctctgcatcttgctggcttcctagtctagttaagtctgagacttcaaggttcagtaagagccactgccccaaactgtaaagcagagagctatggagaaaaacatctgtcacacacacacacatgtgtgcatgggggcctgcccaggtgtatacacagatgaatacacagactgatatagattaacagcaggggaggtggaacaccacagcagcagtgtgaaaaaagctgagacacaccctgtgaacaaatcctgctctttgaaggatggagggaacttatggtgttgaacaaaggaagatggggaggtttggggctacgtctgtactgtctccggatacacaggaacaaagtgaacagtatattccccctgaaaggtggtaagcattcagtacagggccaggttttttactctgaagccttggttgtattgattatcatatctcagggctcttgactagagagctgataacatttgggccctctgtcatgcctgtatcacccttgtctgatgcctcagagaggtcagaccacaatctgttctacctcaagctgaaatatggtgctattaaaaattttgaaggtgcttggctttggaggatttctaagctggttttcttcagcaaaaagaaccaggccctttaatattaacatctttcctttctctgtgagtactagcctctaagagcctgaagagttgggtactatttactaaggagtctgatgtaaatgagggctggtcactggctctgggcttccccaagtggctcattggctaagaactatccaaggaactgctacctcctacaggcaaagaaagtttgtcaccaaatagaatagagtcctgtggctttcagtgtatctgggtaggttgtccagtctgtcatcaactcaccccagcttagcatctatgaaaggcaagtggcctaaaccgaaatggacccagttaaccctgctggaaggtggaaactctcacagatgtgtccaacctgtggtccactttacagcatgcatcacagagtagctgtgactgtggccccacacatctgtagatgatgtaatggattcttccattatagcatcgtgataccatgattagtagagagaaacagactcaggagctcacacagtgtaggactgtacaggatttataaaatgtccagaaatgccaggtctgggcactgggtggtatgtgggtgatggtgtggggtatcataatggtagctgggagcagggtgtgtgggcagtgactggacggtcttcttaggaggtaatgaactttggaatgccacagaagtggtggccactttgcaaatgtataaagtgccattaaattgctcactattaaaaaaaatgcctattttatgttgtgtgaatgtcaccaccaaggaaaacttccctttggacagaatagtttagctggcctgactccaggttaccagacctagcctggagccttggcatgcagaaaggccactctctgagaagcaagaatgtggccgcctggtgggacatccctgctctgctgggtcctggcatcagggagcttggttagagcttcatccctgccctgtttcattggaagtgggaaatggagctgcacattagttcatgggaaattagtcccaggagacatagcagatcctcagcagatgctccattttcttggaaggagacatcctgtgagatgcccagtggagttgggagaggggagggtcccactagctgccattaagagaacagagtggccaatgtactgacattcaatggaactagacgctgacaggggtaaagaaaatgagcccatttcttgtgctacttccctagatgtctgtcccatgcaaggagcatgtggacactgttaaatcctgcatctgagatcagttctccaccagccttggtttggtggtaacaagcagctgccattcattaactgtatgacagtggaaaacctatttgacctccgtgatggcatatcctcagctgtgacaagctgatgataatgtttatcctataggaaactcagagatcagagtagattaaatctacccaatcatcttttagataggttgtaagtcacatagaagatatagcctgctttctattatacaaataaatgcacacaatatgtatgtatataccttatataaatacaaaatatattgatatttaatatatagctatttaaagtacagtttatatgcaatataaaaatattccatgatcatatatcataccatatgtacacacacacacacacacacacacacacacacatattatatatatatatatatatatatatatatatatattatgtatatatacatacagctcctgttacaacgtccagtaacaaaggtcaccaatggatattcatttcattgtagaatggctttatttgttcattcatgcatccattcgatgagtgagtgagtgagcgagagagatagtcagtcagtcagtgagtttaataagtttctggtaaatgccaggcatgggcaacagtgttctattctgtcacaaggcatatgtgtcagtgcacatcaaagacacatgcaattgtatatgatgactaaaaatgagcaagtgcttaagataaaacattactgagcatgggtagtctatatgggggttggaacaggcttctccaaggagggaggtaaactggaatccaatggaagagaagatgctgaccacatgaatcacagtgaccacatgagtctcagggagctttaccaaaggtgagcaagtccaatacaagagacaagagatgctagcaaaggtggctgtctaggaccagtggataccagcaaggaggagtagaggggtggggtgtgctcttcattggctgtctgaccagttattttgaggtgtttaatatttcattgttttcaaggaaggcaatgtaaggcagtggtgtgatgggattttcttttataggaaaggcaacactgttatgagggagagtggcttggggaccttcacaggtggacaagagagatcagttttcttggctgcctttgttgctatggcagcatcagtacttgatttcttgtctgcttttgaggacaggtgtcccaacagaagctccttgggtctctgcaggtctaagacctcactcacactgtgaaatcttccttcctctctctcacttggttctggtcttcacaacttagtatggggatggtaggtgggcctgtgagaatggatggtgttcctggaggggagaatctgcctcttccctacattcaccagagagtttaccctacgacaggagtgtcagtttatggccacacttctggagtaacatggcttaagtactttgcccagatggttcattcagttggttggtattacctgagtgaaatgttaggtagctgatggcttcagtcaatgtagaagatacagaagaaggaagcaggaaataccagcagacccaacctcgagtgtgtgtgtgtgtgtgtctgtgtgtccatgtgtctgtgtgcctgtgtctgtctgtctgtctgtgcttttcttctctgcaggatatacatgcttccaaagccctaaagccactggaaaggcaggatgctttaggagaggtggaccgcttcccaaggcagggcacctgggggaggttaaggaatggcagcagctcccaagagcagcactttttcaagatggtgtgtcttatatgcagagctccaagtgtttgggtctaagcttcctccagaaggctcagcccatcagcccatgcccatgcccaaagctggctttggatcaatggaggctgttccagtagtcaatggactctgatcttccctctcagagatgatacccacgaggtgtctgagttatcttgggacacctccagaaatgtggtattttcctatcgtcagcctttttggcagctagacaattcagcttcagcctgaatgttcctaagatggaaatcctggaggagagagaagatctgttgaagggcccttttccccttctcattatctaaacagatgattgaaatggatgccaaggaagaagctgtaaatggtaactagtcgggggccattctctgaagagtggaagtgctactcaaatgtgtgtgtgccaaggctctgccgcagtattgaacatgaagttaatgttgacctttcagttattcaacaagtatttatggaaccctgacaaaaatagttaataagccaagcatagtatcccatgcctttaattccagtacccaggaggcaatggcaggcaaatctctgttagtttgaggccaatctgatatacatagagagttccaggccagtcagggctacgtagtgagactttgtttcaaagaaaaaatgttaatagtaagagtttcctaatggacatttcttttatgttgagggattcccaaagaaacaagatgtgttagttatcggaaattatctgttaacttgaagaagttggtatcatcattgtgcctatttgggtataatagtgggttggaagagttggccaccatcctgaagtcatttaggcacagctattggggataaaatttgagtttatagcatctcaattcagaaccagttttcctgtccctcatgggtgctcactgtgatggttaatcctgtcactgaaatttaggatcatctggaagagaaacctaggagtctgcctgtgtgcatgtttctagacaggcttaatctaggatgaacagctgaccatgaaagtgagccatggacatctctttctgcttcttgactgtagacactagtgaacagctaccccacgttcctcctggtgtgcctttgtctccacaatggactgtcccttcatactgtgagtcaaaacagccccttccattgtaaagttgcatttatcagatactcctgcaaagcagggggaaggtaagtgttatactccttcagtgttgagtcctctgctcagtggcagggacatgagagagaatggagtctttgattgtctactctaagtcatacaactgtaaaacttcaaagaccattaaaggggtgtagggatttccatcctgtacttttggatggagaaggattccctagatgaaaattaagcagaatcatatctcatctaaaaatatcactaaatcactaaaaattattgttggttggacatgtccttctctggaagctatagttgtgttagagagatagatgatttgtctctctcgtcttgaccattagatgccccatcctctgcttgaccactgtattccttcctatccagcatgatcctgccatgcccattcccatttgtaaaatgtctttgggccaagacatctttggagtcagaatgtattcatctggtttctcagaatattgcttcctcaagatgatatacttcattttaaccctgatcctcatggtatagggactctacagtctaaatagtcctcctatagaactttgcttttctctctaactcatgcagtgaattgtgtttttctgggtttggtgagaggtgtgattacttggccataaaatgcttaggaattgcctttgatatgacctctctgagaacatatgtgaggctcctggaggtaatgctagttaaacatgtgatgaccagtatcagtaatgtagcttctacaaccattacacacaatgaatgctacacggaatacatgcatcaactttagcatggttttctatttttttttttctctactagttcttctgtaactcaaggagtccatggctgaccaggtcctataagagaaacatgtaaagttcaagtattatctttctccttcagtgtatcatagaggcatcatttaagtgtgttttaggaagaatgactcatggcttagaaggactagagagtttaaacacaaagcatagacacaagctaggaagtcctagtgggtaactgggttaggagtcatgggaacaggagggaggaatagatgtgagtggtttgttgagttagtgagttggctaatactcactagagagagaaagagacacagagagacagagacaggcagtgagagaggggggaggggagtgagttctggataagggaataccttttatacaaaagtaccaaagggagtggaagaagattggtactgatatttgcacctgctgtggagtaggtcctaaatacggagcctttcatctgatgacatctgccattcttaatattgactttaaagtctttggttaaacctcttcatttactgatgaaggagctgaaggtctgagagactatgcttctttcaacagagtgggctatgaagctctttattgaactattggtaagactacagctcatgaacactaatggtatatgccaaagccaaggtggaccctcccaacagaatgtgaatcaggcttcatgggagtatagaagcacatactgacttttcattttctgaccatgtttgtggctttctaaactatcgtctagggggatacaggtgccattgtaattctcttgtatgcttgagccaattctgttctttcactcaagagcaagatgacacacgtctctacacatttcccatgtataatgcactgtggatgctctactatatgaacagtttcctgcccctctgtctgtttcctctctgctttccaagtccatcccatttatatggacccattctacatttttatattgcttttctggttatcccagcccatcagattttatctctcttctttgccttggttatagctatgtgaatacattcatttactcagtgagcttgagatctccttaagaacattaaaggctgctctctgaccattttatagtatctgctgtgtctggaatgatgcttcaggcccatagctggtatgatgaagcacataaaatgtaaactttagagggaaaggaaattggatgccagtcttgatttcaccattgtgtagataggtgatcttgggtaatttcagtgacttatgacatcagtatttttagcaatgagacaagagaaaaataaaggttatctttgggaagattttattttaaagactaagtcagataattacttgttaaaggcctggcaccatggctgatgatgagtagcactggtatatctccctactttgatatgaccttttcccagaacatatgctgggcccttggaggtgatactggttaaacacatgatgcccagtgtcactaatgtagctttcacaaccattacatacagtgaatgctatatagaatacataaactttagaatggttttctattttcatttttgctcccagtccttctgtaatcatcacggactccatggctgaccaggtcctataagtgagacctgtaaagttcaagtacttcctttctcctctgctgtatcatagaggcatcattcaaaggtgttttaggaagagaatgacagagttgtcacattgagaagagacaacttgctttatttacctttctccaccaagccaacgagtgctctatgagagtacaggcagctatgcagagctcatgtgcaataaaactgggtgaaggagggatgacctgaccccgtcccttgccactcaacattttattaacaccccttttccctcaaagccctgtttatacatagatcagattatttattaatgatctcgtttattcaagtatttgtttattacctccctctcttcctaaaattgaagccctttgaaagccaaaaccttgtctgattcattgccatggcctcgctcctagctcgaggacttactgcatggtagggatcaagtaaatgttggatgagtgaatgaaggaggagtcagtggatttcaatttggctaaacaaatattgccttagggctgaggatgggccggccggatatagttccataagacaaacactgatctcaagaagaaagagagaagaggagacagggaggagagacaaacagaaatggcctcaggtgggcaaagtgcacgcccagtaagcgtgaggatcagggtctggatcctagacacttacaggtgtcccacctggaatcccagtgcccagcaggcagagatgggtattccatttgataccttggctcacggaagtggccagctctgggctcaagggagagatactccctcaatatgtaatatgtaatatgtaatatggaatatggaaaatatcattcattatcaacatctggcctctccatgcacaggtatatgcacaccacacatatgcatgtaccaccacacatgtaaacatgcctacacatttgtacatgctcaatactgacatgcaagtgccaaaaaaattggagccttaatccttttggtttgtttgcttgtttctgagtcaaagttggtagccacgtggctgcggtggttggggtgatcagcagcctctgggattaaagcttgagacagagtcatattctgttttgcaattggcttctcccctctgtcactccagattagcctgggaggccactttgcctggcaggagaaattgacatcccattgaaattgatgaaatatttaagcatttctccgtcagagtgtgctgagcattggcatttgaggaaaactcctttaataagaggcctaacccatgcaaatgtgcccgcgtgtctcctttctccatggattgtacagaaaccagggagtacagtgaaggggccaagcgagttgacaaaagtgtctctggagatcaagtactaaatggttttttattgctctcctctccaggaagctcctgtttcagctggcagcagtaagtgcaggttagacctgtgaacttcttataaatgctacttgtaagcttaagaactttagtttttaattggtttcttttctttcctttctgttttttccccctaaactactaatgcaataggaagaacaaaacatttttataatttcttaagacacaggaactattgagagagagaacaaagggactattgaaacactatagacattcagaaaacccacaaacatgcataacccccttgcctcctttcattgcacaatggaaccctctctaatgagctttcgggggaggggaggcaggcttgaaacccccagcacaacccttgtggaatgaaaagtaggctgtaggaggaaaggaagggtttgtaatgacaggggaaatttggggaggcaggacttactgtcctggctgaactctttcttcttctctgaccctctcagattcttctctcatatgctgccagccattgaaagccttgcccaactgtgttactttaacagtcgggtggatagattttggcagagcacactatgacaaagaatcaccttcagtccccagctgtgatggttactgtgatggctacccttgatggttactcttgatggctaactcacttgcaatcaaaagacacaagagggagattggtaaagtacacctctgggtacttctgggagggtgtttccagatcatgaattagatcattagtgtgctgacccaatcaatggtttcattattgatggatctaactttgattggactattaggcaagagcgctgctggagaaagttggcctagctgtaggtagtagtcactgagctgggtctctcagaaggctttctcttggccttacccctttccagttactttttctgcttcctatcagcagtgacaggagcagctttgttctcccagtctcttcctgctgtgatgttcagccttacctcaggctcagaagccagagacgcaaatgcccataaactgacagtcctgacatggacagccaaaataaaccaaggattcaacacagctataaaaacaaaaccaaacaactaaaaccccaaacaaacaaacaagcaaaaaccactggctagtcaggagattgaaaaatgtgtgctttagtggaaaccctggctatctagctgtagactgcaggacactgctctccatttgcagatttttgagcttatgaaatctatttcatacccatatgaattatagttaactgttatgtatggtctgtcccacacacaagaggttcagccaacccatttgatcttctacctaaaaatgttcacctccaattttatatccacttcagtgtttctgatcggtggctatgtctgctcactaggttatattttgagccacttgaaacatcttcctcatcctccattttaaatgatataaaaaagcccttaacatattttagatcattatgagtcatgatcagactctgacttggaaattatgttttgacactcgttacttcaaggtgtttttgaactgggaacttctgcaaggctcactatcttcatgggcacagtgggagtaataaacagggtggaattatcaaaacttcagcaaggggtttgcagctcactgttcagtttggtgctggtagggagataacctttagcgataaatctttagccattgcagatgaccagtgagctaatgtttgtgtaaacacttttaccaagggtgaatcataaaatgtgattcagattttctctattctcttgttcctcctagcaacacatggagcttcaggagcaactctcaactccttgatgcttagaggaaaaagagagggagccaggggatggcagctacaggatcagttttggtgggtggtcatgcgggaggacattctaacaaccagccatgagtggcagcttcatgggatagtaagggcctgtcaatgaacatatgcaggcaatggtaactgtagtactagagttctcgatttaactcctggttatgagaattgtaatgcagagaaacaggcacacagggaaataacttccaggacacacttccaggaagtgtcacagcttcctaattgctagagttcctgggagccccatcccagatatatataaaacacctgaacactgtctgacacaaggcagatgtgtgctatgagctggttttaagtaatttgccttatgatagcagctttcttacttgcccaacaggatactgacttattatacagttgtgcactgtatagaataggaaaagctggtgaccctacttacacagtcagactgttgcttaagtgtgtgacttggcagcaatcatatacatgcgcagccacagcgaggcagcacaagtggaagcatgccaggcaggctgtgcctggcagatcactctgatgcagagcccagacccaagctgtgaggttctgatcctgtgctccggtctcttactttccaagctctgggttcccacacctgtttatcctcttctctcaacctccatttccaccgtgttagctgctgtgtctcaaacctgacatccttcccttatctctttccagtaattacattccatgatccaacccctgagcgaatccctggccatgcctccagaatatatggcgagtctatccatatctcttttccactatcccttgcagatgacgtcatcatcagcccttagctagaacctccaaggagagcccattcttcctacccttgtaccccatgagaatatttccagccaatactcagtggaagcatgacaagctgtaagatggtcgtcatactactcctctgtcacaggcactccagtggctctctgtctcattcagtgtcctgttataaatctctgggttgactattaccaactgcaagaagacgtctgcttaaccacaactgggagcaccacaagtctatagtgattgttcatccataggtgagccttctccaaacccaaggtccagcggtcattgcagaagaggagacagaaagaatgtacgaaccagatgatggggaggagagctgtgaactgctgctctttggacatggcatggctgtgtgtgtgtgtgtgtgtgtgtgtgtgtgtgtgtgtgcatatgaactatgcacagctgtggttacctgcacaaaatcaagccagttaaaaattccagcatgggtggagcaggagcttcctagatttatccttagcccaggagctattggtgggtgatgctgctgagggagggtgagcggtttcctttggggctttggctgctggccagttgtccatgctccagtgtatagcctcacatactatgcattgcatgcagtgggttaatcaagaggagaagaatggacgtgaacctggaaatgcatctatcaaaatagtccatgggtagaaaaggtgatgagattatcacacttacaaagaggcctccaaagactgagacttctgtcctgttagctgtctttcttgaaggcctcttcctcttaccttcagggctactcactgtgtaaagctaattggcatgctatgagatactctaaggcggtctataagtcaagggagccctttgggttattgttcagtatgaaccaaggccaaatcctaccagtctgtatgggctgcaccatgtgaggcaagcagaacctccccctggagagcctttggagaaaagtctgcagccctggttcacatctcagctgtggccttgtgagacactgaaatacaggccttgactatctatgcttatattcctgacagcagaaactctgaggtcataaatgcatattgtcttaactgctacattttgggaataacttgttacacagcagtatgtagctagtacacatctggcttttttctctttacctaatggaagctgttttcttttacgagacgagttaaattcttctgttttctctaattggcacatacattccttctgtcccctcccagcttcctgctctcctccctttcctctctctcctttcctcccacctatgggattctagacacgggtgtttgacatgactttaggatcagcaaactccctgggaccccgttagccatgccgtgctgaggcatgtaaattctcggcaccttctgacacttctcagggccaagccattggtgagacctgtttgattattccaatgcatgtcattgcccagagggccagttggtatttataggaagccgagagtttggcactgggggagaattcgttccagactggtgcacttgcattcagatagaatcatattctctgaaaaatggcacgggatgttgagctgattggaaattcagcacgattgtatggctcactgggcttgcattgtggctgagaaaaaccatcctgttgggttggggagatgacagtcacctctcctcagccggctgttgatagatgtttgaggacaggctgaagacgaggctgcattcttcttccaacttgaaatcaccgagttgcattttaaagtaaatcaacagagaagaagggcgcgctgacagaaacatcaccaaggctcggccccggtggcggcgtaagcaggtagacacaaaacagaaggctttgagataagtgttcagaaattcagagaggcaacttgtctgtcattcgtaatggctaaaatctttgaggaaaatatattcttatgtggatgggtttggaggaggcaagcaagcttaatcaatcattgagtaatcagtcgactggcaactattcaccattcccaccttgttcctggccttatcctaggggtaataaaagcacaatcaaataagatcttatctttctttttaaagagttcatgggaaaataggtttgaggcaaacataaatatacgtaaaattatactatgatatggtgagggggcaggctaggtgggagaacacttgaccccatctgtggagacaagggaagaacaatggagggttccctgagaaaacaaaccatgctggcaggtgccaagatcgagatctaggggagcagaggacgttctgggatggacagttggcttatgcaaaggcccagcagtatgaaccaacctgttggcattgaggaattaaaaatttcattaagattgatgtgtgctagacaagattatatgacgctaagagtattatgaaaggctggtctaagaggccttgtgggtcaggctaaagtgcagagtccatccctggggaagcagggagtacaagacaggcctaaagagcagtagctgatcaggtttgctgtggaggagaggttggaagagaaaagaagagaatgagacccatgaggttaaagaaaggggaaactattcccctcttcccacaccatgtaaactgtgggtcatttctctctctgggtttttaacatggtgcctgtttgcaggtagttagaagcatcccttgggggaggccatgtagctagaggcaatctgtttagaactaacctgagtgttcaggccaggtacctgatgttccttctctaagccacagttagaccccagccagaacatcgactagcagtttgtgagcagcaactgtcctggttggcaaagataaaggatgttctattctaaaaaagagggagttctgaggataccagcaacacattacagtgtccagccaaggttggagataggagttcgtcatataacattgccctctgagtttaacaggagtcattttcctcagaacatctgtgaccacttatttaggatctggcctgtttactgtcgacagtccccatcactgaaggggtatgaggtgactctaataccacctgatctcagccacttcctgccttgaataccccacccagctagccataagacattttgctctagcactgtaaaatgttaactgaaggggaggccccatctaagcagatgaagtctccatcactgttgggaagagaccttccagagtggctgtttggggtcatttgtgctcgtgtggtaaaccccttacccttctctgtaaacaagcctaatctactcgttggttccccaagccggattctggtggaatcctatgttggcttgttattggtgctttataggggtgggggtggggggtagacatttatgtctcactaagaggagagacaccctccatttctttgcatcattcatcccaaccagaccttctgatatcagtccatgccagcatttcaactcctttttctggacttggctccttgtccttctttgtctgagacacaccctggtcactttttgaaggctgagaccttttcctgcagcctccatgggagtcagatcctgactgagcacatgtcttatgagaggttttggctatttgattgcaacagctactcatccaaggctcctaagaggtttcttcccctctgaaacagtgaaccctgtaaagacttgtgcccacttcaagcctgagtctgacagccatggatgaaggagctagcactagccctaagcaggagttcccagacagcatgtggaaatgacaggacatgactaggacttttactctgtcatttcaaagcactgccaacccgataccagcagctcgcctggtaccctcttttcctgctgccaaccagctgtgtgttgtatttgggcatgctagctttctatttagatggaaaacatatcattcccttagcaaacatttgttgcgttcctatgctgggtcctctcatcagattgccagcagtgctctccctctctccgtatctctggctccagaagctgctctaaggagaacagcatctcatcttcattctgagcaggatgcagagtggtcgttttcctcatttgctcccaacaggttcttgtcctcgtctgagcccatgaggtgttcctccagctttcaggaagcagtgatgcccactggttggcattctctggtcttactcagttgcagctgctagagcaatagctgaagggtagctggctggaacaatatacttctgttttctcagactcccatgtccttgttctggctaatgtggtgtctggttttatgatgggctctttccctgttttgtagtcagctaccttctgctggggccccacattgcttttcccaccagtgggcatgtagaagggacatatctcctctacactctccttctcttttcttcctcctcctcttcttccttttcccctccctcttgatctcttccttcttttaacttttgttattgctgatgtacccatccatcctacttttcttcctctccttctatctttcttctcctcttcctctgctttctcacctttcacgttcagccaccactcctatgaagagcctacccttattcactcctcatttaaccttaattaccttctaaaggccaaactccaaatgtgatctcatggagagttacatcctcaacttgaaggcttaggggtagcagtggggagttacaagtcagttcaaaaccctgcttgtctccatgtctgactcctggtttctgattctggcctgagacttggtactctgaagatatcgttaaggatgtggatggtagtggccaaagtggagggcatcaggggaagtcgcttgtctcattcaaacagcttgactataggtatttcttgtcaagcttctatgcttgattgccaggcacaacagttatcctaggctgtcacacttgtttggcaggcgtatcatgcagatttattacaaggtaaattgggttgctattgtgcaagctttgtctcctagtagagaggggaagtcgtgaggggatttgcatcagggcacagagtagacagaggagccttgattggcatcattgtatggtaagagctctaaggagaagatcctcaaaagtactgtagagccaatgttcagagccatgtgctggtcttttcaggcaagatttccttatttatccataaaatgattcctgtcatatgacaaactctgtctcctttggtaagacgtcataaagtaagaaaagagtttagcccattttgttttaaatgcacatctgcattgacagggtgtagcccctcggctgctggtgttggcatcagaggggaaccagcaggcttgtgaggtggttttgatggaggccatgttgcttcctgggatcagatatattggggactataaaaactagggcccatcttcctcactgccaccaagcttctgggcttggtgtctccctctctgcttcattggaagggagtgtagagagatgatacttaaacttttccaagagacttccctgctgcactgagctctcggagcttagaggcaggcttcccaatctggggaccactttttttccagcctgcacaggcactaagctgaggatgctgaactcattatggccatgagttatactgttccaaaaagcacagtcaacagtagaggagaaatttctccatcatgaatcagaccattctaacatgtgtaatcaacattggaggagaaatttcaggtatttaccaaatggtttgctaacacattgtcatggcaactgctaatccttaaggagcctgtcttgagtggtttctttgacatatgcttgctagagctgaggacacttgtattccaacaagcatcaaatcaaatattatttttcagaatttatttaagaggaaaatttgcccatcattttggctctgagggatatcagaatcaggaaaaactttctctgacactggctcttagtcttgtcaggtccaaatgctgtctagctctacctagaataaagaataatttctttattctcctgtgttaggtatctttccatggctgtagtaaaatacctgagataagcatttatagagagaaaagggtcaatttgcctcacagtttttcaggttgcagatcataattgataggccctctttaaggtagtgaaccatgatgataatgaacgatggaaccaagatggttgttttgtggccagtgtggtgccttgaatgagattggcccccattggctcatatatttacatgcttagtacctagttggtaaactatttgagaggattagaaggataaggaggtgtggctttgttatagttagtatggccttattggaggagatgtgtcactagaggtggcctttgaggtttcaaaagcccatagctccctcacgctctctctctctctctctctctctttccctccctccctccctccttcctaccctccctcctgccctccctctctccctctctccctctctctcagcaagcctgcctgcctgtggattagcatgtaaacacattgtcatggcaactgaatgccttcatactccccaccataatgataatggactaagcctctgaaactgtaagcaagtccccagttaaatgcttttctttgtaagagccatggtgtctcttcacagtcatagaatagtgaccaagacagtcagaaaacaaaactagaggtaagaagggttagggtttcatattcccctgtgaaggtgcacccccattgacccaaggatcccccttgatctaagaatatctcatctgtcccacctccttacatttctgccaccttctgctaacactagttggggacacattaaacatctcatgcaggggtgtccagcctttgtatcccgagcatgagtctcaggacagttgtgaggagtgctgcccaacagatttgtagatgacaatgctatgttgaaattccagaagattgctcactgcaaatgtaaagtatggtgcctcttactacttttaactacacatatatttttaatttgagaagtggggaagtttctacataatacatacatttggtacaggaaaataaataagagctccgtgtaagaacattggtgattaatgtgctcgatttcggttttatcctttccttgctcatatttatgtatctgtgtgttttaaacacaattggaataattatttgcatgatagattatttcatatcctgctttattacttaatgtttgattataaacgtgtccccgcacttcagattatttagaagtctaaattattgataacagtatgcacttcaactgcacgtgtatatcacaactgtttagcctgtttcctattgtagttgaatacttttgaatttctttgaatgcttatgaattatgccataccaaatatccttgcatgtaagtggtaaaatatctttttagaagagacttactctgtcaagtgcttgggatgtttaaactgacatgcacatgcccagacttccttctggaaatttttgcagtgacacacacacacacacacacacacacacacacacacacacatatatatatatatatatatatatatatatatatatatcagaagccaaatcattaaccctcttgcctaaaggatgggtgaagatcaaaagagagcagatattctacgggtgttacacaacttaaattcattctctgggagaggtgtaaagagtgtctactcctccccctcaggttttcccaatcttgtctctgagtaaccaatgagtttattgggctggcttatagagcaatgggtgaagggtaatggggaggatcataggtgaccttagagcatccactttggaaggtctgctccaagtatggatgttgatccctatggctgtatagctagagactcttcctccagtccttcacagagaaccccaggctatgcataactagggagcactgcatacaactgattgggaggggtcagatgagggacccatgaccttccttgccacctctttctatgagggaatgtcaacagccaacaggactaactgtgatcatcctttgcacataggcaccagcagaatcctgaagatggtagagggtggcttagaggatcaccctgtacaaatgagtattttgttattttgttacttgtggcaaagccatgcaagcagtaatctgtggacagggtgctcggtgtgagaagaaccaaatggtatgtctgacaaggccagtccttgggggaagagggtgtatattgatggatgttcccattgcagtgacaaaattcctatcagagcaccttaaggaaggaggttgtaatggtcaataataattacccacttgataggaaggaattatttagcgtctggacatgcctgcgagggattatgttagttaactgggtgggaggacccatttggaagtaggtggcacccttccctgggctgagaaggctagctcaacaatagagtcatcacactgatttccagttgtgggtgagacatgaccggatgtttccggttcttgctgccctgacttccccaccatggtgaaccttgtactatgagctaaaacaagccctcctttgctctagttggttttgtgacacatttgtcaatgtaacagagtaagacttgtttattttggctcacagtttggacatgtagtccatcacaacatgaaagttacagagacaagaatctgagacagtttctcataatgactactggtactcagcttgctttttctttttttattcagtctgggatgccagcccaagaaatggtgttaccccattagggtgtgtcttgcaatctcacataatctaacctagatacttcttcatagacagtgttagaggtttggctcctaggtgatgctagatcttttccaattggcaaccagtaccaaccttcataggatgtctcctcctcctgtttggaagcgaaggaggccagggttctatgtggggaggcaccatctgtcctggtatagctgaagatatagaagatgtttctcaccagagaagaaaatctaggcagactgaaaactccaacatgtggaacataagagtcactggcacatgctgtctctcagctggctgaaggccattgctccaacacctccttcttttcctggatgaccctttcttagtcctctagataagtatactgtattctctgccttacacacccaaatcagcacaggagtatcattgcatagtcctgctgtcatctccccatgttgtcactctcacagacgtgtgtgccagatgcatgtggtgtctggcatgaggacagatgtgccccagggagtctgtcctgggcttgcagcatcctggcccattttgtccagcctgtagctcacagctgcaggtgcagggctccccagacagctgcagtcatccgagttctgtctgggctctgtcctctcatcccctccctctgtcctgcactgggcatctccaagggctgccttgctgggagcagctgttgattcggatttttcatcaggacttttataattaaaattcgaagctttcagacatttgcgttccattacactgaaggagcagctgttaaaatttgaggtagggaagcagaggtttcccggtgcgattagggttaggttaattaagtatgtagatgtatttccccttctctcagtctagctacaggattgagaaagcaatccccaccctctctgccctgccctagtttctatatgccaagtaccgtgtcattcagtactccttaggaggcttggaaactaactgtatgtgagggtcagatcctagcactggtctaaactgtctggtgaccttggaatagttacttttgtagaatgaagagagatgccacataaaggtagagtccagtccatgtatagaatagtctgtgttctttaaaggaatacacctgagagaatgaatatatgttaaagggggatttattcaattgacttgcaagacgcatccagccttgagtactccagcaatggctgtcataccggaaagacaaagaatgccatagtggcttagtccccaagtctggatgtcttagcaaacccaatctggtgctgaagctctggaagactcccagagagctactggttttcattctacattagcatccctaagaagttggttctaatattggtgaagggatgccacgggaacaggatgggtgaacttgtcagtgagtgcgaaggcaagcaatcaagaagcaagtttcctccttccatgttattttatatgggctgccagtgcaaagtgtggcccagatttgggatgggttttcctcttcaaatgatctggccaagagcatccctcatgggagtgcccagcggattgggttccagttgatctcagatgcagccaagttgacaaccaagattagccatctccatgtgcctaacttatgtttgcatttattactagaacatcattaatgctctcaacagattagcatcatacctgaattacaggggaggaagggagccctttcaggtcaaatcataggtgtatgtaggtgcttgcagtaggtgacgtgctggatgtggaaccttagtcagtctgcatccatcgctccattgtcccaccatgactggcttcctccttgttttctttccccaccctgatgctgcttccttcacacaggccttgccttttgttcttccccttaagtaggatggtgactttgatgctgggagtcaccaaaccctacgttagttccgtggcaagtgggacatccaaggagagaataaggtttcttatttgttggaccctcagcttttcctgtcttgtcttatcatagacatctaatagcaacgttattaataccctgtctgagcaccgtagtttctagggatactaagacattgaatctctctctctctctctctctctctcatacacacacacacacacacacacacacacacacacacacacacacacacttcatatctactaaatgttagtgtaaatggcactaacatatcacaagaggtccaagagagttttgctcagccagaacttctgcagaaagagttttgcctgctccaacacttcatggctggcagctttaggtttctattttggaaggtctctttgttctgcaaaacatgccacacctcctgtgattcttatgctgtggacatgaaactccagcactggatgtaccttgggggtactctaccagtgtgcatgcttggggcccatccctgaagtacagactcagagtctctagtgccaggcccaggaatctatctgcatgcaacaagttctaaggtaacttatataaccaataaagtgtgaggaccatggatgaagtcttgtgcacacagacttgaccatggatgaagtcttgtgcacacagacttgtcaaccaaagcccttttatgtccaaatctctgtttagtgccacacactcaccagaccttttttgagccaccttctctttgctgtgtcgtgaagttactacagctgttttaggggactgctctaaggctcagccatttccagctgtgatggtctgtgtacatttgagccattctgtgtaacctcagctctctttgccttggcaatgtcaaaatgatttcacttgtacttaagccctcagggcaaagagcttgcatgcttgtgtgggttttagcctactcgggccccattttgtctattttgcttctacatttgtacttttggaatcaagttgtttttgttcccagggggtctcaggtgcagccttggatgctggcaagcattgtattgcctgttcaccagaccgtggctacatctctgcttctattaccagggtagaagactgttttacatacaggtgccatggtcttcctttgctggctgtgtgtagcataatgtccagagatttctggacattcatgatgtagactgtaattggaaggagaaggaggaggaggagggagaggagggagaggaggaaggggagggagagggaaggggagggagtaatattaaaatgcaaatattgaagtggtcaggaaattcttatgtgagtctatatagtttattcagagtacccagtttagctggaagctgatgggatgctgataacatcagatgctctctaccaagacatggtaccctagacatccccacagtgtctgtgggaatgctgggattaattccagaggctcccaggtcttttgaattttatcgagtgaccctgttcagtcatctgactttcctaggctctagattttctcaaaggcagaatagcagtgataatggacctcttggggactattattcaggtgattgggaagatccatatgagaagtgtgttgtcacctaggtggtgccgtatgggcattgtgtcacctggcaagttctgtgcaggcatttcccactgtctggaagccttcggtcagttttcatccctgaggtcttacacatttaagagctttatgtcatttgattcagatattgcaaagccatgggcctcaaatccagctcgaggcacaaaaatgttctgttctgagtatctagtgttctttaaccaccatcacagcatgcctgtgatagggtctgtatttttcattttgttgagaatcctaaccctctgtatttcccagcctgtgactttgttcatttttattgcctatgaacagagatccctagtggtgacctttaatgttcttgatttcacttagcatctccaggtgctgtggtagaacatgctataggtaggaccggcccttccagtcatactttagatacatgagtgatatcagcagctatggttacagggcagaaaagacagttggggggctcccctgacactatggtggagtcctttctgtctacagaaatggactgtttgtcatttcacaaggtaggtaggcactggggattacaggggtggacacagatgcagcttaggatgggagaagtcttcctggagggaagcttgacggctcaactttacttccaagggtgaggattccataaggccagggtagtttgctcccatctacaatggtaagggctgaaggcattaagtgctgtagtgtttgaatggcctcagtgaagctatgcagggctttgatcctggcgtgcacagtggcagccagggagtcatcccgactctcacatgcaggctcctgcaggcaacagtcttctccttcaaggtgtgttactgcagaggactgcatggagcacccactgttgatacaaaggaaggctgagggaaccttccagggagactgagaccgtgagggaaggtacacaggagcaggctgggaagaagggaaaccgttacctttatgtatgaggcaagaagcaaggtgtttgttacacagctgtgtgggtatattagttaggtagagagaccgacctgagcttagtggaggtttataataaagacctgtcggttatggtccttgtatgggtattatcccatgggcttggatgcagtcctctagttgaatgtagagaagagaggactgagttctgagctcagtagaagagcccagtgatgggggctcagcagtgtgagctgtagactggaggaggaacaaggaaatagcatggcggaaacccctgggggtgggggtaggggtaccaactccagccacactgcccattgagtcagtgtggtagggactgagttctgaccttaggattcagccagaggtcacagatgaccttgaaaagaacaggtcactctcctgttttatctgagaacctggagagcaggtacgacggacaccaagggcacagaaacttcaggttggtccccttttttcccccttgttctcagaaatagcaaaaggataatagtataactgaccttgacacatctaaatcaacatccaatctgaaagaaaggaaggtaacaaaaccatgtttgaacaaatcttggataacagagatttaaaaaaaaattcttctaaacacccctgctctgtacaattgctggcttaatgttttgctgttcataaccctgcactccactttacttcattaatacgcatatagttttttctttcttttttaaattaaaagaaagaagaagaagaagaagaagaaggctgacctgaaagcctagttctagctcgtttggtaccctgttctcctgcttaccgctccatcacaggcgtttttctgtgctgtcttcttgccacggtaacctcagtagttaaaattcacaggatctcattagaacctgctcccaacctccatatttcctgcggagtctgaagctaatgaaggggatgaggaaaatgtctgtaaatattttgttgttttgcaaacacaggcactcttaaatccagtttaatgattgctcagtttaattaaaccctcttggtcttatttgttacccagttctctgcactgattagggcccggtctgaaaggagggactcagatgtgcagcgcagttgcagtcgcttctctctctctctctctctctctctctctctctctctctctctctctctctctctctctcttcctgagaatgcgaagggaaaaatttgaaagcaagactgtggatctgttctgtgtattcttccgaaccaacttgcacagtagccttttgtttggatgaggggccgcaaatctttcggatgtgtatgtctctctcacccctttgaaaatgcatcaagatatcgcttctagtttgtcacgttaaaatacacaacatggcaatacttggctatgccgcagaaccgtgtaaccctgtgacatttacatgtggaattgttcccttaccctaaaaaacaaaacaaacaaacaaacaaaactctcttctcttctttcctgttctcaacttccatctcgcttccctccccaccaactcttccccaggcagcaaattctccactttttgatactatggttttcccattgctaccattttatataaaaggaactatagggtgtgtggtactttgtgcccgacctggccatttagcctgctcctttcatgctttgaccatcgtgggcatcatgctggggactctttcatagttaggatctacaatacacttatgttttttcccccctgtttctgactcacctcattcaccttgttcaaaccaaaatcactatgaccatgataaccctagaatattgttgtgcacctagccctttctccatgctgcagccccaggctggccttgtgtgatgtcctagtcctaagctctgccacagcagaccagagtcctgtggagagaatggcctctgagatcaacacactgggaatcgcttattgtcaaaattaccctcggaaaatcctttaaggcttctgtgataaagtttgtttgtggcatgattcttaagcccaatgcagtgtataagatctgttgaacctgggttgggagatagcttagtctgtaaagcttgctgtacaggcttaaggatctgagttaaatacgaaggacccatgtagaaagccctgggtgtggtggcactctcttgtactcccagctctgcagagggcagaaacacgcagatccttgggcttgctgaccagccagtgtagcctatttgcttagctctaggccaatgagggactcggtgtcaaaataacaaagtagatagttcctgaggaatgatacataatgttgtcctttaacctccacaggcatgtgtatacacacacacacacacacacacacacgcacacacacagaaacatacagagcctattgagctagactaaaagaatgagtagaacaaaatcaacacacaatcagtggacactgacgatactcttcatagaatgggtgagtgggtgagtggggaagttccaaggccttcttgcttaactacagggatttgtcccattctgttttagttttaagtctttgactttaattcaaatggtatttttcagggggcagtagcaatctaatgagctaatatttgcaaaataaagcctacagttggcacctaatatattcagcaagatgtttcatggactggcatctactgcttgccagatccgaagcacatgtagctcgtttttttttgtttgtttacatttaagcggaagggcttgggccacctggccttcacatttcccaactgtcatctctggcggggcccacacattagcattatctcattctcatcctagaggcttggtcagctgcttatagctcaacgttccagttcaggggctaaggtccaagccctgatctcaggaagaaagaggaatttggggaaggaaaagcacggagcacccttgatctcaagaagagaaacctggggaaggaaaagcatggggcacccttgatctcaagaaggaaaagaaagctggggaaggaaaagcttggggcacatctatttcacctgctttccttgctgctgttagctgtcctgatagagacagtccctttgtcttcccactgccatccctttgtggtttccttgattgagacccagccctgaaaagctggacaggtgctttcacagcctgtaaagagagcagagctccaggagtgtttggcgttgagtttcaaggcatagatataaacttttagtgctgcactgtttcctggtggcaggtcttagccggagacggaggagtggatatctttccctgggcaaggtctgttttatgtttagggagttatatggatggtgcagcttgtcgtagaggggccttttcctgcagttatgggtgggagggaagctgcagagagcagtggactagtttaagcatttagggcagctcaatttagcatctttcctttagagtcctaactgatgaaagataaacgggtgtataagtgccttccacctatatatgtgctctccatcctgatagtgtaggtcaggcctcgtaaatggtatggcagtccagagtggtggctgggactttgccccgcttcatcctgaactgcttatcagagtaaaaattataactgtgcacagcagcaagaaaacacgttaggaagcagacactatgaaagtaggaagagtttagaatgaggagagccgtgtggttggggtgtgttggtttgtatctgaaatcccctccatatgatgatgcttcgaggtttgttcttgagctggttatgctattttgagagactttggaacctttgggtgctgagggctggctagtagaggtaagtcattatgaggggcaagtcttctgaggacaaggcacaatgcccccattctgttaactgttcctgcttccttgttcaaggtgatgtctgggagcctctgccacatgctcttgtcatcaggaacttcaccgtggcttctctgccacgatgagtccatgataagatgtctgaagctgtgagccaaaggagatcttttccatcttttactgtctctgccaggtgtttgggtgacgtggatacaaaagtagccaccccagagtgagtggaaggagaagtagcctgataggtaaagggattggcagtgttctttggtggtcagccagtcctgggaagggtctgcaacagaggaagaaagcccatgtcctatctgacacagtcacactgggggtgatttgtctacactggttagtgtagctacattgagggtgagaatttataagcttcctctttggtcttgtcataggtaagctaaggttgttcttagttttgggtaagccgtgtggggaacatggttctaggcaatgagctgtttcctgtaacacacagggctggaagtctttctccatcaggaacacagagctttagtgaagcttaggctccgatgacttctctactgactgcacagaacaactggaactcatgactcacactggtccccagggtagggagatcactatgggccttatgctgcccatttgagttcttgctgtgcctgagctagaaggaaaatggtatctggaaggtggcaagaacaggtgagagatccctggtgcccaggctcaggtgggcaaaacatggtagaagtgacaggatgctctgagacccggtgaccactagtgagtatagccagggtaatgggtggcggcggtggcggcagtagcagcagcagttaaaggaccagttcctctgctcctcattgacagctccccttaggtggagcagtggaaggccctttgtttataacaggtattctcaacctctgggtccagacctccttgagggtcacacatctgatatcctacatatcagatatttacattatgactcatgatagtagcaaagttacggcctgaagtagcaatgagataactttatggttgggcatcatcacaacatgaggaactatattaaaaagggtcacagtctcagggaagttgagaaccattggtctataaaatggaggcagctacagaagagttaacctcttctgcgtgtcccgaccctatgttctgacttagctagcaacctgtcacttgctttttggtttctggaggtactttctgtaataatgaagtggttaacagtgaaagaggcctcacaactcaagttctcaagccccagggagttctttttcattctggactgattggagggcagaaaacaatgtggtttcactggctggatatttaacagttctcagtccttcttttggtaatgccttttcaaatagcatcgattcatctgtctcccagagtaagactatggatatgttgtgaggtataccattaaggcagctgcttccgataccctgagctctctggatcggggtgtatgggtgagtctggtccactctgcagatagatgcaggttgcttcactggacagcctgccctggcatagggcaaagctgggaaaccaacacaaagcttttgtgtgcattaggatgcagctcacagaggactttcaagccaagccaactactgtcagggcagggactccccagccctttcttgtagccctgccaggtttgagaactctttccaagagactgagtgatctttctgcaggggcctctaagctgaaccataagctcagacttcgtaatggaagctcgggtttccaagcacattgtgtagtacagctggcctcccagagaggccctaaaatggcaaaggcggtaattctgggagccgttttctctttcctctgaccatgagacattaacaaagatattagcacagccatttcactccaatggccaaagtttgggttgcctcttttccttaattgtatctctttcccccgttatctctcagtttattaagtcatgggattgcatatttgtgaagtaggccatttagggagggctaggggttcagataattagagagggaaaaggtgccctagggccatgttttcaaggcttctgcctcacacaaattaggtggctctgtgttttttattataatttttttaactttatgttaaggtttcaaatttatactaaggaggtaaaaagcacctgtgattatcaccttgtggttgatctttcactcatacacaatccatttaccccttaggtgtgtcattaggatttccccccattattgagcagattgcctcgtgctattgcgtaggtaagaaaacctctccttaccttcagctcctgttcaccatggatatgttggtgccttcccgtcattttcacaggcacagagaatcagatgcaggaaggcaggtgttttgttatccattggccttgtgggaaatatttaaaaatgagaacaggcacacattcctgaacttgtgcatttgccccagcagactggctggccatgcactggtgggcaatgaccaacctgtttttatcttgtggagactctgactcagaactccaagatctctctacccagctcactaagtttcctctggtaggttattaccatgccaaacccatgcttcaaatctcccacagcctttgtggcacacatctggcaaatccacactttgttgctgtacctttctcttttgaactcagacaagccgtcgtatgaaggaaaatgcaacacaaacttagttcagaaacaatggtaactcaatcgctgagcacaacaactaaaatcctaatcttgtaagccttattaaaatctgattcctccaatggcgaatcattgcagatctaccatgataccaggaagctctagcagctacatcttacccctctgctgtccccattccaaaagggcctagctctctcctgcttcctctcttcctctgtccaacctggaagtcctgcctactcaccaagtgattgactcctttattcatgaggggattggttcacaagaagtcacctgaatatgactcactccttgtctacaacccctcccagcagagcagaattagcatacaaacagcacaggacccatccacaacatattggctttcacttctagtgaccagaaagcatttgttaactgtttttgttactgtgtgtgtatcaatggtccagtcatttttattgggaagtgtttttccattgtatagaagcacatgtgtttggttctttaaaactcatgttctaaggagtcaagaatcatggagaccaagaatcttatcttggcgtgcttaatggactctggcttctaagaaaggggcgtttttgcataggtaacctgtcatccatgctttcttgaaatgaggcactatgaccagaatataatgtagaaggaaataaaattgaaatgagcaggttatgaagtagaaaatcaccatcctgtggcttacacttctagcagatactatgaatgaaggctctgccaagggtgaacccatcactcccctttccaagaaaacaacgacaatgttgtcttgtgttggttgtgaaatttgtcaagaatgtttaggaccctttgaagaatgaagatggatgcagccatctgcaagaaaatagagcaaaagaacagtagtcacatgtctgtgctagtggtatgttaaagggacaatatacctccttgcaatagaattggtaaaatggacttgaacaattactatatgaataacccaataacctcaaaaagtcactcgataagatccagttcttactgtgacttaaaagccagccagtagactaatatccctagggatcatgagatgaggtcttgccatgctcaacaaataattctctaaaccttgttttacaatttgccataaacggaacaggggcaccttgattaaagccactgctagcattgtctgagagccccataactcacatgaaaagatgtaagggatgttatatattaaattgtatctcccaaaagaatgcatgttgaggtactaactctgccaaaagtcaggtcactgagatgcactccaatctagtatgacaggtgtcccatgagaaggaaaagggtaggtgcagggaggggaaagatactacgtgtatacatgaaggaatgtcctgctaagatagagttggggatcatggaggcatatctgtaagccagggagtaccaagagcagcagcaaatctcttggagctgagagccctagaaggacccagtactgaccacccattcatttccaacttttgacctcagaactgctaggcaagaccttttgcttaagccacttggcatgtggtgcttttctgtagcagccatggggcacagatacgactcctaacacttcactgacactgtgtgtcagacactattttgaaactcaggcagggaggtttatcatgctagccaaaagctgataaaccaataagaggtggaacagggctttaatcggatcaatctgctttctcagcaattatctaacatcactagctgtgtcatagtcagacccataaatatcacttttaaaagtaaaacgcaggagccggagagatgcttcaacagttaagagtacttgctgtcctttcagaggacctgggtttagttcccagcacctagttctcagcacagtggctcacaactgccagtaactatagttccagggaatttagtacccttttctggcctcctcgagttcctgtatgcatgtggtacacacacttatactcatgcatactcatgtaaaataataaataatttttaagtataaaatacagttagattaataggtgcatcatcctctgtagttttccctggatgaattaaatatttaaatgtacctatagcttaataagagaaccaaaagatgatacacataagtattaatttttttctgtggcaccaaatacttatatagatatcctatgtagaaaaaaattctatgtgggaaatatgtaaaaaagtaggaatgtgatttctagattttgtttttatattctatagttcatgtatatcaaaaataattcagagaatagaaagagtcagaggaatacttgtaagtgagaatatgttaaatagattaatatttttactgtataataacacaaattagaataaacagcccaatcacaaatgaccaaagggcataagtcgataatttatgaatgaagaaatattaatggttggttaacttatgaagagcattcaagctaatattcaaataaaaagtgaaacaaagggcctctgcagttcgccaattaaaatgacaaagattaaaaataatgatgattttcagtgatggtgagattgcaagggagttgaacaatattccatattataagttttgttaattgtaataacagttcttgaaggtgatttgaatatgtatatacatatataattataatacagatcctccatccctagaactccaatgttcagaaagttatcctgaggcaaagaatatagagatgccttaaggtttattttcttgctttaggagtagtaaaatatgcaaacaacaagaaataataagagatatgaattatcaagggcatataagattatgtcaggcattaacattcaccttttggatagtaaaatggcaaaatactcctgatataaaatgtactataaaagctggttaggtggaggcctctatagccaccatgcttctagtacttttaagaaaataaatgtatatatctgtaactagaaaaatattcaacataacaaatgtgacccaggtaaatgtctacagaaatgaattagaaggagattgttgtgttcttcattcttccccagattacctgcaattaaaaaaaaaaacccaacctcatttcttttcatttagaataaaaacaaaacaataagcgtatgtaggatgctcctatataacatatgtacaactttctgatgttaaatataacaaaatatgcagccccactttgatacttgtgaacagccctcagccttcttactctgaacacactcaatcttatcaaatatctatatatttgactatagggtaaccagaataggcagttactccttattcttcatcaataattagtagttaccaaattgtgagctattgggttattaatacattttactgctataaacccctggacataataataactattgtatatttaactttttaaaatatgccagactccccacacctgagattccagagcttgtggtctcctttaataactttaagtgtgtgtgtgtgtgtgtgtgtgtgtgtgtgtgtgtgtgtgtgtgtgagagagagagagagagagagagagagagagagagagagagatgtgtatagagaagactcacaattgttgttgtgactgttagatatggactggagacaccatgctttaggaagtggccctcctttgatgcatttacctgaaaacatgctctgtaatcatgtctacctcactggtatctttattttgtgtagctgccttttacagtaccctctgggtatcattgaataaaacagctgtctcaagattcactgcaatgtttggacccagtacacatctctcattcacctgtctagctgtttcccagaaaattggggattctttggggagtcactagaatcagtgcttcttagagcacaccacaggtcaataccatttctcctatttacgtttccagtaagagctgaactgtatggtttgctagtctctgaaacctctatcaaggttcctagatgactaggccatgatggtcatatgaagagtcttaatgacccaaccacatggtttcatgctgctcccacatttctggcatacatgctacatctcacacatgtgcatgaatgcatgtatgtatgcatgtgtgtgtgtgcgtgtgtgtgtgtgtgtgtgtgacaaatgcatgcatgcttaaatgcacatgtgaacacaaacacatataaatgcatgtgtggaggctagaggtaaacatgaggtgcctttctcaatcattttccacattggtttttgagacaagatctctcactgaatctggagctctaacccactgagctagtctcagtggtcagcgtgccctagggatcacctgtcttttcctccatggggattacaggcatgcgattatgtgtttggcttttacatgagtgcttggtgtctgaactcatgtcctcccgggctgtttccctagtccttagctctgtttcttaaggttagccttcgaggtggctcccagtgtaagcttctttgagaaacccctgttaaagcttccaggtagagatcagggtgattctagtgtgtctgaatcaaaagagcttcaaactcccaaatgggcagcaggattcctagatgatcctcagggcctgcaggctgccacaagtcacatgatatggcctggggcttcttatgaaaagcataatctaaaaatcttcaaccaaaccacctattagattgaagaggataaggtaggcagctttatagcatccacttacagggttcaaaggtgtgattgtggcatggagagaggaaagatgtggaaagagataggataataaacaagactgaaatagtgattgggctcagcatgtcttagaacactgggcaaaggtctaaatcatagtgctttgaagagctatggacaatagcaacttcctccctccctccttttgtccctatcttcctccctctcttcttttttctttccttccctcccttcctcctctttcttttcttttctttctttctttctttctttctttctttctttctttctttctttctttctttctttctttctctctctctctttctctctttctttcttccccatcattgttgtatatttttaagccagaggtaaaatccaaaatgttaatatgaaagtaagtgcatttcagtgaactaacagatcttgtctccaagacccaccctattcccttacctgagctccagcaagaagttaggaacatgagataggccactgtacagatatagcagatgttggcaaatgctgggcagggcacgggtgccttcatcagaatgagggccaggaacatgaatcagaggattaagttgttttctgtacaatcctggaaaggtgagtttgatccctggagcatgtaaatgtggaggagagaaccaagtcaaaggaacatgtttcctttgactatagagtgtactctgatacacccttttacatcacatacatggtgtttatcatagtaatagaaacattaactactatatatcatcatcaagaaatttggcatggctacatggaataatactagccacatccggagacaggcacctgtcatgcctatttgcatcctgtgagagtgttgcagagtcctgaattcaagttattgtagcataggcttcaggttcccctctgtcacattactttccaaagctcagagaggggcccagcagtttgttctgagagtcatatattttataaaatgatcaaaagcaagaacactgtagtgatagttggttaagctggctgcatgatttcccctacagtagccttttcatcatacgtttctttagaaagaggaaagtgggaggtaaggtctttggagtagtcagagtactttctggatgtatataagcagaaattaaaatgtaaacttgggttaatagaataagcacatactgtgtgtgtgtgtgtgtgtgtgtgtgtgtgtgtgtgtgtgtgtgagagagagagagagagagagagagagagagagggggagagagagagagagagagaccatgctcaataccatcagttcatggcttatttaaaatcacttaatacacaagagaacataggatgatcttgaatattatagcacatagatgagaaggatctaaatgatgagaatcctcaagagttctaaactgtataaaaaacaacgtaaacttgaagggcttaaactagctactaataataaagaaatagttttcgggcagattctcagtggttaaagtatctgccttacaagtgtagggactggagtttggatcacaagaatccatgttgctgccaggtgggcaggattgcctgcctgtaattttaggcagagaatggggatccatagagaagcttggccatcaagactagacatatctgtgagttctgggtttgattgagaaaccttgcctcaatggataaggttgaaattcagttaaaggtggctcctgacatccacttcaggcctccacatgtatgtgtatcatcacacacatgtatgtgtaccatcacacacaggtgtccacacacatgcaaaaccatgcatgcatgcacaggcatactatatacacacacatgaaaagggacaaaggaaaatagtaaaataatgcagagatattaatcaagctttgagagaggccatttttagtctccattgctatgaacatgatattgtaaaagccattttaattgaaaaataatcccaagcacaacatccagaaaaccagagagaagataataattactaatgctgttgtttttcaggaaaatacagtatttgtagtggtttttggttactagaatttttttccatatgatttcttttcacattttaaataaacagtgtttgttctgagtttacatctttttcttgaagatgttggtatctttgggaaagataaaacactttcccatagtgtttagccttcaagttttacaaaactcataggattattgtcttctcataagaacttcactctagaaaggaatgagtgccctgtcccaggtcctgcctgggtcatgggctaggcaatgtgcacaagccaggattcctcaggcttctcttcacccattgtatatgctctgcttccttggcggagcatgtcgtcagatgggtttgctgttctccaggtgactccagttgtatttgataatgggcagggccttggaaggccaggggtgggggggttatctgctcagctttcctcagacttccaggtctccccacgtccagaaagtgttcatggtcgtggcttataaaagatacatctcttgtccaggcctctcggggtgagctgttcagggctcatgattgcttgccatttggttaactgccattggtccttatcttaaaagctatcctactctcttgtcctctttacattctgctcttccagtatgagggctcttctagatgcttctggagaactgacttacagcagagatataagagaggtgttgataccaaagtaaagggtacctcaagtgagatatccccctcttcctagatctcctatcccagccgtcaagttccaactggcagatactccaagctcttccagaattcactaattattttaatacccagttattctttcaagaatggatcccatggggtgtaagttctaggcattttggatgggcccagattgtgtccaagtcaatgagggaccatgcctgtggtttgtatgctgcttttgattcctttgctcatttcagccggtgttgagattggagggcttgtcatgtaggccatttaggtcactcttgatgctgtgttttgcattttatttactttccatgagattccttgagaatctacaaattgccatctaatcctgctgtcttttcatttgatctcagtttcccgctatgtctctttcttctcgtttcagcatatatagattacatatagatgtgtgtgtgttgtgtgtgtgtgcacacgcatgtgttgagtatgtgggaattcgtgtctgtattcatgtagaggccagaggtaaacttcaggcattagtcctcagtgtactgttcattttattttattttatttttttgagacaaagtctataggtttctcactggtctggatctcacagatttggcgaagcctgctggccagcaccctcctagatctgcccatttctatttccccaatgctaggactacaagaacacatcactaccacaaataggttttacaggtgtgctcttggtcttgaacttgggtcctcatgcttgcacaacaaacacttccctgactgagccatctcccccttaatgaggacatagaatgttcaccagttcgtgctcttgttattaacatcagcaatgctttctagttctgtttctcctgaatttattctcatatatttttgattcttattttccttcaaaaattatatttcataagtataggtaggatatatcaaggaagggagagctatagaatctaatccaggtcgtctgttgagaccagtgatgtgattggtttcctaatcattagatgtgatatatttctgaacatgggtgttgacagagtagaaaaaccacacacaaccgattaaattaattaggcagattcccgttcctgctgtagattctagcaagggtctagcagagaaggtttgccatttgtatctcaaaatccatttcagtttctgtaactgtagcatcttttctcccatcttcttcccttaattactacactactacactagtttctttccattccctctgaatacccacttccccccgcccccttttcccaggagttgcatggtcatttgggtgaggttctatgagagacagccaggagcttccagccaggtccatcttcaacagagtgtacccagccaaggtcacacagccagctggtggcaaagccaagtctttaacgcagggctcttttctcctaggcaaatcctcagtcttcaggaccacctgcctccttgtcctgtcaggtcctgacaggattattatgtgatttagcaagtggcagctttggtggtagaagttcatttctgtttcagagtttttgcctgaggtgaaatcatgttggcaggggctgaacctctgctttgggcctttgcagatttaagaaagaaaaaaaaaagtgcacagagctggaaattgctaagtgcttgttctggaaatgagaaatgtgtttgtgtgtcctggacatgaactcttaggcatctgagagactgacaggaggtggttttgaggtattgggtctgctttatggttaggcaccatagcgagcaaactacttgccttttaaaggattcatcaaaggctacttctttaatcctcaggagagtgctcccttttgttggcatccatctctacctaggccagtttccctctgcagacaaccaaagtgtcaatatttgagagtgggcaggttggctggcggaactgaggacaagctaatataatgaacacaacagttcacctcaccatccccaagacccaaatctgtgggttgacccagtaccagcatctgggtgatttaagcttcatatcattgaggccttcttatgctctgtccttaaaaaccctttcttctatgtttaaggttcatctggagaggctatggtggatgaatcccatccagccaccacaggctgatttgccagagctgaactgctgaaggggtttctacagccaattatatttaggataatacccagacctcagtaaatattttatctgtgcagttaccagtttggtgatttatggaactctggctgctattaccaggcttaatgaatgtatgggaccttagtctttactttaggtaattaaatgttaatatacttataaaattaaagtacatgaactggtatccatcagctggacctcaccatttcttaggcttttgcatgcatggcactgtgcaatagacagatggtggcctctgaggaaagagaactgtcataactggcaggcataaggggttgtggactggattctgaagtcagtagggtctctattcccccctcttcacaacgattaattcctgcattgtgggatgtctattatgattaggtaagatcatgaaaaattactggcttgatgctgggaccatacaatgcaatgtttaataatgatcactttctatagtggtataccttattaatttgtattaaatattaaaaacattctgttatgagaagagcttaaacaggcacctcacaggctgtttctctctgtatttcactgttcccagctatactgtgagctctgagggaagtagggggccgttcctgcttgtctctgctttatctggggtacctaaagtaatacctaccttacagtagacagcccatagcctactcatgaatgaaatgcgaatgtggcttgaatgaatccacagagggttctagcaagcagtgcggatttccaggatgcagagtttcgcctgtttccatacagaagacagaagatgagttgagagagcttgggtctgggtttgaactgaaactcactctaatcatgactctggctattgggaggtagataggcccaaggaggtcatttaaccatgttcaaacccgggctcccacttttcaaaactgcattttgtctcagagggcaaatcaagggtgactctcaggaccggagtaggatagtccttacagaggacatgtgggttgggtacagacagctgatttttccagagtgggatttgagatcactttaaacgatgtgagagtagttcctctgggagactcttgattcagaaaccacccttatcagggctttctccttcttctgctctccactgggttcctaatggctcctgctccccgggttctcttccaggtgactgtactagttgctcctttcattgctgtgaccctgaacaagaagcaaccttggcaaagaagcattcattttggtttacagtttgaggggacacagtctatcatggcaggaaggaagtagagagtgggtagaaaataaaaactagtaggccaggctataaaaactcaagatcagaagcaagcgagcaagaattattattgccttttactgagttttcctcccagatacttaatcattcattcattcattcattcatccagtgttgtttgagtcctcagcattcagtgatgaatgaaaatgggcatatgtttcctaccctagaggggtgggcctcccactggaagataggaaatgagtgagtgaatgattggagagtctactccgggtgtacggggagcaacctcatccagcataaacacaatggcatggtagaaaataattagagaggtgaggaggctatttttgtcggaatatttgagaagacttctccaggaacttgaattttggtggggaatcatttggagcgagcctcctgaagctccagtgtggtggtgatctgagttggaagagctggaagtgcaaagctcctgggagtgctgggatcttggcttcagcttctaacgatttctgatgctgatgctgttgcagatgcagatgctgatgccagaaaccttcccccattttatcccaaagtatagaaagttttctccctgagatggggcatgacctgtggtcctccttgtctttcaatgctccctctaaataaaaaaaaaaaaaaaaagaaacagacattgctgttgtgtggggaaagatcaaagatggtcttctggcagctgagtgggtagaggtctggccagggtccagggcttctgggctctgtcccagttctggaccccttctcgttgtagcctttgccctttgtctgtttacctacctgtaaaattcggagctgggccagatgatccttcagtctttatatttgagaggacgtgggacccttgtgcctgtcccagtgctgttttggggcagagtgaattgctggttgttcgggctacttttctagctgattttattctcctgctgccccccatcttgagccttctttaccagtgatgactgaaggtggctcttcttttcctaagcttcaacctctcgttgataggttgaggctgagagcaagctctttttcatactttatctatactttatctatactctttatcatagtcttttcctggttatagatcatcctagtgttcatggacagactggtaccaaggaaccttaggcatgagagaatgtataaacctgatgcctcataacactgggagacaaaggccagacagtccatgggaagaagctagttggatgctcttatttctactgcagcagggtatcatgaaggaagttccaatcacgttctggtagtattcagaagccaaggggtcccaggagatggcttgcttatggcctctgttacagatgaagaaacctggaccatggggggaccatcttgtctgaggtcatctagtagaaagtgctgagggtgctgggggctcattatggttactgccagtctatccaggacaaacaagcagactcagatatagcttctctaatgctttgctttaaaatattttataaggtggataatggaaacacttaacctttccattttgaatttatacatggagatgaaatatcaatgtattttgtacttgaaacctactgcgtgctagtctgactctttatagatagttcatccagtccccataacagagccaagaggtggagtctataagaatcttaggcttacagatgggggtaataatgcacatagagtttatattggccaaggtcatacagttaagtgaaacagaagagtttaatggctgactccagggtctacagctttagccacctcactgagctaagaacaaccacctctaatgaaggtaagtgtgtttgtgattcatgaatttcagtgcccacattcacacagtaaaaccagagcccggcaaaggtacaagaacattgacttcagcttgaggacatcatagcttctgttaccctatggttttcccagggtgctctgctgccttgatttccaagcacacggctggtctcaaagacactcagcagcaaggtcatcattcccccttgaaaactcctggctacctcctatctttgtcactttccttcttagacacagcatagtgggccatattgctgctcagagcctcacaaggaagaacccgttgatcagatcaaacactatttccctgccccttggggaatgtccaagacaacatcttgtttataataaatgcaacatccaaagagctctaaagcatcttttcttttttttttttttctattaggactattgtttctatctgttgagtccatgagtatttgacattggatgactttataaaacattctactaattggatttgttaaagcaaataaatcaaacactaattggaacgtgccctgccattatttttgcttactgaattagatataatggtgtgaaggccttcttatcatatttgtgcacttatttaaacacccccctggcacacacttctgcaaattcaattagatattcaaaaaagaaattcaatttatgcaaggctggtttacattcattccgggggcaaggctgggctccccacgatacgctgctcacgattaataagccctacttagatcctgccctgccttcagagcagctgtcggcacagggggagaatacgaatgactagggctggagctctttagaatgtgtgtgtccatagaacagggtttgcttcctgggcctgcaaactctggttactcaggctctagcagctggcttagagcactgctattgccctcttgatttcttaattgtgtaacattatattctgtagggtagttatgtgctggcttcacaacgtttagttgaaccttccttgggatttgctttggttggcagacgcggtgtgattagaattcaacttcttctgctctagactcagccttctcatctgtgcaatggcagtgtcagcttctcacacacaaggtgctttgctaagtcctgaggtattaatagtcttcgctcagtcagtccctttacctagggctgggtttgtgacgtcaaaagtcaaaagactggctgcatctctccatttcccagagaaaggaagaatcattatgtatctacgaaatgggaagggcgtgtcggggtcacagggcatcagacactcaagtgatgacacgtggtactgttctgaagttagccatcctgttaccattggagatgtccatgctactgaattaggattggagtctgcaccccaacactgagtcttccccgttttttatatagcccatggatgatgatgggttttgcatttttaaatggttaggaagatgaagggatgttatcttgtaacaagcagattatgtgcagttttaggtatagtgagtgcagcatatggttatgtacacctgcaaacccagaacttgggagacagaggtaagaggactgcatctcaggtagaacattgacattcattcattcattcattgagagaacatagacatgctaattctttatatattatgttttcttactatagtggcttggtgagtactagcaacagagcttgatgctattgcaataaacagaaccgttaggtagccccaaagattcctgatatatcccatagagttcccatcccctgcacagcagtgtgcatacagcggtcttgctccacaccttggttatgttagtgacaaaggagagagactgtcagatgtagctaaggccccaattctttgaccacaggctagagtgaatattttggatgtatctgctgtagcggacaagtccttcagaagaatgagaccctgctttaaggaagagctcgaaactataataaatatataaataagaaagctcttgctgggcatcccatggccagggattgtgggtagcatctgtgggctgagagtggctgctgggaatagctaacgagaaaatcaacacgccggttctgcagcctgaggaactggattccaccgaaagccatccgagttgagttctaaagaaaatcccaaggtcaaaagttctgctggcacctggttccgtcctgggagaagagaaacagggttgccgatacctgcgtttgttccttgcagattctgcggataccaagtaggcattttaagccactgcctttgggataatttattatgaagcagtggaagacaaatgtgtgttctgtgacaaattacattctgtcctcctcggactcttgagttgacatctatacgctgaagcccttactttcagcataactgtgcttgaataaagagcctgcggatggggccactggggtggggtcagaactctctaggctgggaagagaccccagaagtcatgctatttttctggaagcataccaaggaaaggccatatgaggatctctgagaaggtggtatccgcagcccaggaaagaaatgatcgacagaatcctcccagccaaacctttatgtggaacttcatcttccaaagctatgaggaaacacatgtctgttttgtatgactcagtttatgacattttgttatggcagcatgagtagactgatacaacacacaaagctgacaatatttattccttggtcattcaggggaaagatttgataccccccttcatttaaaaataataaaaactggtactttatgcttttgcaaaggacttgcatagtggttcacacctacctgtacgtgcagttctaggggatccagtgactgcttctggcttctgcaggcaccagacacacatattatatacagacccacattcaaacactaacaattatatatagaatagaaacaaataaatcttaaaataatagttgttttggtcacatctctctctttttctggtcccttttaaccatgttggggtggtttgaatatggatgtccccgtagactcatgtgtttgaatgcttggcctatagggagtggcactattaggagttatgatcttattggagtaagtgtggtcttgtttgaagaagcatggaagtgggctttgaggtcttatatatgctctaggtacacccagtacaacacagagtattcttacacagcaataaaatccaaactaagatccatgtattcttgctatatctggactccaaactgttcctccagtgtttagtgtgagctatctctatatcagtgagtggtacatgaagctgataccatcttctaccatgtaccttcctgcttgattctgagccccctaccctctgcaccgtggtcttcaaggcaagctgaagctgcagagcctatttctgagcattgacctctagatttgagaactagaatcttgtagccccagaacagtatgtgacttgggaatagaggacttgaagaggcccagaactgaggaagatctgtgtagctaccccaaccaattctgtttaaaaggcaatgttaactgctgtggtgacctaatataacaggttgagtgtatgtgtagactgagctagctgggattcagagtcaaactttgtcacttggatttgtgtgacctagggcaagagttttagagcattctttttttttttctataaatttttatttttttttattttttttccattttttattaggtatttatctcatttacatttccaatgctataccaaaagtcccccatacccaaccacccccaatcccctacccacccactccccctttttggccctggcgttcccctgtactggggcatataaagtttgcgtgtcccaatgggcctctctttccagtgatggccgactaggccatcttttgatacatatgcagctagagtcaagagctcaggggtactggttagttcataatgttgttctacttatagggttgcagatccctttagctccttggctactttctctagctcctccattgggggccgtgtgacccatccattagctgactgtgagcatccacttctgtgtttgctaggccccggcatagtctcacaagagacagctacatctgggtcctatcgataaaatcttgctagtgtatgcaatggtgtcagcgtttggatgctgattatggggtggatccctggatatggaagtctctacatggaccatcctttcatctcagctccaaactttgtctctgtaactccttccaagggtgctttgttcccacttctaaggagggacatagtgtccacacttcagtcttcattcttcttgagtttcatgtgtttaggaaattgtatcttatatcttgggtatcctaggttttgggctaatatccacttatcagtgagtacatattgtgtgagttcctttgtgaatgtgttacctcactcaggatgatgccctctaggtccatccatttggctaggaatttcataaattcattctttttaatagctgagtagtactccattgtgtagatgtaccacattttctgtatccactcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagactaatttccagagtggttgtacaagcctgcaatcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagtacaagccattgctgttctgttcaggaatttttcccctgtgcccatatcttcaaggcttttccccactttctcctctataagtttcagtgtctctggttttatatgaagttccttgatccacttagatttgaccttagtacaaggagataagtatggatcgatgcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtcaggcatggtgattccaccagaggttcttttatccttgagaagactttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatatagatctttcacttccttagttagagtcacgccaagatattttatattatttgtgaacattctatgtgtaagtttcttcatgcttgtcacagccatcggtgatcatgtctagcttatgcggtgactattacaggcaatcagcagcatgcttggcatagggtgctatctatgataccatccctcagattggcatttgctcctaagcatccttctcctgtcccttttccctatatcatcatttcctgaccctagaacagttgagcccttagcagtttcgtctctctgcacctgttgctacaactctgatttctcctcctgttgcctcttgtcctatgggccacctttagcttaccttctttctcccaaagtgatcttagcacatactttggcttcccttctcttacaatttgaactctccaccattgcagaatagggataaatactcttagaaggccacgtctgactctgagccctcagtccctccctgattggaaggttcattgagttcactgtgatgccctaagagaaaggcacagatgtactacatttccttctgcagggtccagcctggcacttcgccatgaataaggcccatgctaatgtattcagccactcattgaatacgagtcaactgggctgtgctggggcctgactttggtggggactcctgcggtttgtgtatgttctcttggatctttggaacctggaactggaaaggcactatcctgtgacctcacatgtctcatcctatgccagagttgtcctttgaactccacaagcatggtgctctgtggcttcctagtatgttctgccccagctatttaggccagagtcaaaagtgtttctttgcctcccccatgccaggtcagctcagattctggtcatgtttgtcaacattgtgagttctctccaccagtaacacttaccatagagaggaaaactgaaggcaaatctgtacctttttaaaaataatttttctttttttatgcttggcctagtttcctatcttcactgagctccatggctggatattaaaggctccactttctattccagaagcggcagggtgggactcagaatctgaatatggagtattctaaaagaggccttgctggaacattggaaagcttctgtcccgcaatgccagggctaatgtcccacctcctctgtttcctgtgtttgagctgtttctaggggtccgtgatgctgcatccataagatgggataggcatggtgaagacagatagcagcgtgctgaagctagtgtaggtgagcgctgcacatgaacactgttaagaaaaaggagagttgctgtttttatcaccaactgtgatgtcatgctttttctgcagctgggaaagtcccttgggagttcctgcaatgagattccatgcagagagcgagagcatgatgcttagctcctagagcaagaactgacaggtgacaatccctgggcaaaatgtgacctgcccacattgttatgtataaagttttgaggaaacatagccacatctgcatgttttcatattgaagatggttgcttttgcattacaaggggagggcttagcgattgtgactgagaccatgtagccacaaagctaaagagatttagcatttggtcctttgtagaaaagtttgctgagtcctgacttagagaaaggtgttgggggttttctgcttgcatatgcaaacagatttgcatatacatccacacctctcacatacagtgcctggaacatgcagaaagtaacaaatctttcgtccctctcctgaacttaattctgctttagaatacataggatcatatctgagaaatgcagaggcaggcacatttatatttttattgaattctattcctctctcattttcaaaagaagagctcatgtttaaagagaaattctgattggcactataaaccttatttatgctttaatgtctcctaaagtatgtatcctgcactatgtttactcccttacagatgctgataagctatacattaccaaatccaaatggattttcaaaatccaatttccttgctacagtcttccaattctctgttgactttttttatatttgacttgcgtcagagcatctggggattttgccacattttgacctcaacctgcccagtgaaaaagctcatctgctcaagagcagagaccatgggtggtggcttccttcccctgtcctcctgtgattctgtgggtctccatcaggctggatggtggcttctggaggcagcctgagctctcttctgaggttgagttagaggtgaagatgtgatttcctccccaggtgactgtgctaagcttgacatcagttgcctgacaccacatggtccttgtgcccgagtgaggtcagcatccaaataaatttctctggggattctttcaaatcatatatcttccttaagtgctctgatataaacacctacagaggggtgaggtcttttgtcttatggtctctagggaggacagataaaattttggatgatcaacatcacctataagaagccttaaggccatggaggttggataaatgcttcctgttcagggttcaggggatcttgaatttcttctcttctcctttcttggtggctcctggtgtctattgcacactggcttattgccatttctgcatctctgtgactcctagaggttcctagttgtgtctctagcatacttagatcttctgacaagaaggttcctcgtggccatcttgttcctgtataccaggaactaaagactcagaagtgggactgggtgtgtgggttaggaactcgtctctgactgactgtcacctgctgtcagtctggagcatatgttcatgctgattcttcatatgccgtctgagaggaagaaaaccatccttaagtgtattttccttcttagtggttttaaacacgttatgcctgcatcaagccatatgagaggggagcaggtatccatatcagttgctatcgccacagtgctttgttttctcttatgtgtgtgtttgggcgatgctatcaatttatattgagaaggattatgagaagcagtctcacgaagctcgccgtgcactccttgtgtggatggagtctcagatagaggtggtgtctcattacgggaaatgaggttcgtcacggattcctgcagaggctcttgtctgatgtacgttcctggactggttgtcattgccctggaacagtttggcttttattataagaacacagtgtccggtacctgggaagctttctctcttgacataggaagctgggagctcagagtcaggcatataaccacagttaggcagatggacatgtgggaaattcaagcatggttctataactccctcctaccttgttttgccttttctttctcttaatatcaccgtgatgcacatcctgcttctgtgtctatcaggctcatgcagatgcatgctgaacagttagacagcatctcttaaatatgctccgctttctaggtttggcaccaaccacagatgggaacttaaatcccactggtcatatttccttctttgctgagaatctcagtactcaatgggaaagtctgcactgtgctcctggctgagatgcagacatgtgtgtgatatagggcagcccacagcctgcatctagaactcccttgtggagagacattaaaagacattcacaagccatgacaaaaacaaggcagggtctgaatatcctaagagtagctcaagagagagtatggcgctacctctggttgcgccaatgaagctcttcttgtgcgagccttctgttgccatgccttcctttgattgccaccacctgcagcctcaaccacaaagaccttttcatcatcagaggaactgagcacagtgtgtcagagattctgtatgtagcacctgtcactgagaggttagcacggtggatggccattgtagttcaggtctgcttccatttcatggttagaaatctcgtaccacttcagctttgtggttctctcactcactcccacctgaagcctctgtagtgcattgattcgtaattatccgtgtaacctgcttgtttgctgctggtctgcctcactgagtttcatatgtctttctggaagccactgtgtagccaatgccaccactgtgtctgctctttcaacaagagtcattgttgacttagcaagtagctagatagaagcaagtattttctctcctcttgtgcatcagtcacttcccaccctcttttttttttttttaatcagacatttccccctgaccttattgcagatttcagggtttttttgtgcttcttagacttctttatctgtgttcctctcaagatgttcatgtaattcctttcctatttcatgcaaagcatgcctcaactcccgaaacaatccctcccaatgggttcggtcctctattgctaagcccagcattcactggggtgctgtcataacctgctcacatgactataacagactacctggggctggctaacttataaacagtaggaaaaatgtcttcttcacagttttggagaccttgaagtctacagtcaaggcggcagctgatgcaggatctgatggcacttttccatagatgcctccattttattttatgcatattttattagcttattatcataacataatagatttaattatgacattctcacatatactttgttcttattgacctcctcccttctctcttctgcaacccccccccccccgttcctctcctgccatccttccgtcttttgttctcttgccatatatattctattatcttcttgaccttccctccttcacagttcctcactggcggcaggggggtggtggggatgtggtggggggtgggcacatgcactttggggcccttttatcaggatgtgaagctcctacatgagagccaaatcctcataacctaatcatctcatcaaaatccttcctcttaacacctcctcagtgttgagttccaacgtaggagctggaagaggacacagacacgtgacctgcagtggctgtggctcagcttgtgatcggagcagatgggtgtttagaggagagtggggtgctgagcgccaaggggacaacccagggatgagagtgggtgtgggtagccaaccaggggtccagtgtaggctcaggtcagcagtgccagctccttttgtgaatcagattgtgcaccgtttggaatagccttcctccttccttcctcatatgaaaaagccccctctcctctagagcccacttgattctctccttcagaatcgtgggctcctgcttctctgctcccaacagctctcctagttggagcctccgttctcattctgtatctctttcaatttcatcttgagcagacttacagtatatgctaagtttttccttgcccacatcaaagggacataagggggaatctggcgatactcactgttgactttctcatcctccaagtgcatggttgtctgatgtctcatcagtttgttcttcaagctttacaaagcacgggctttcagtctacttgtaaagcaatgtggtgggggtgatccagagtgtgttctgtgcttgcttttcagagtcaatccaaacagtgacttaccataagggaaggggtgttctcttccacatgacaggtggggaaaccaagacccctccagaggtgaaccaggtggctccaactcacagctctggagagctgaggtgtgatcgagtcctactggactctaaagctcctgttctctgtgcagcctcccagcccattttgcctgtcgcaggaagcaattacagaggcatgccctggcattcatttctcctacttagaacaagccgttgctgtttactttctcaggaaggaagattgaaatcagtgtaactagccttattaactttcttaaataggggggcctgcagatgctggcgcatttcctaagagcaccaaagcaaatataaaactccagtttgcccgcttttgatttgttcccccccttcaacacctctctggagtttaaaattcaaaactgtaaagggctgatggagcaggggtaatgaaccaaggttcaggcattgggctgtacttacctgtttctcttttttttttctttttctgtaggtggctgttcttttgacgaacattacagcaactgcgggtatagcgtggctctgggaaccaatgggtttacctgggagcagattaacacatgggagaagccaatgctggacccagctgtgcccacaggtatgtgatccatcatgtttggggctgagatggaggtggctgtcttttgcagtagctcatggggaaaggaccttcttatggatcgagctgtctgagaggacagtaggttgatatataggtggagagttctgatccttagaggcacttaagctagggtaagtgaattccttagtgtgaagtgagagtcctaggttattaggatccagagtcctttgggatttcattttactctgagacctttaagctctatctatacatatgatatcactgagttttgctctgtggcgagatggtaaagacattttaaaaagaggcaagttcactcctttcctctctgttatatgaacatgggctggatacacacactatgggatttccactgtcatattactaccactttgatgagtgtgcaggcatctagactaccaagcttctttaaccgtgtaaattcttgatggatgcctgcatgaggccggcctatgagaaatgcacctgctggctttaggagatgttctcaggagaggtatgtacagactctgggagaacactgtcagagctggtgagagtcaggcaaaacatatctacaaggttgcctggtgatgtaagcccagatgtcctacagctccgggacagttgaaacctctcttttgaacagtggaaagccagctggctataggacaggagaggacatgtctatggaggcttcctctccactcactccctggagctcatacactgtcttgtatttcatcagcctctgagccctccctgagcctcacccctcttcttccatagttcactatggccttaaacactagtgggttttgggcttgctctgtactcccctcatggacggcctcaccaaccgaattgcttcgtgttccatctgaagactgacaactctgcatgtgactcccattgccatgtcgtctcagccaactctggggtgagggtttctagagtgtcagtaagtggaggcagagagaatactcagaagaatccgggtcggaaatgtcttccctgcctttgagcttggttccaaagcaagaggtaactggctggatttttatggttcctactaaggaaggaaggaaggaaggaaagaaggaagaaaggaaggaaggaaggaaggaaggaaggaaggaaggaagaatggaaggaaagagagagagagagagggagagagagagagagaaagaaagagggaaagaaagagggaaaggaaaggaggtactaaattggatgttttagatttggtgagatcctatttgacttaaggaggagcaccacttgtctcttattccaatgactaagacatcatgggaaaactttatctgttgccccattgtggattttagtaatgctgacttccctccctccccctctccttccttccctccctccctccctccctccctccctccctcccttccttccttaggtgaaaatctcactgtgtagccttggctggtctggcactcactgtgtagaccaggctggtattgaattcatagagatctatcttccttgcctcctgagtgctgggattgattgtgcatgtcaccatgtccacatgttttgtgctctgttggccagattgaacaaatgtggctcttatagtgcatgtatgtgtgtgcatatatgtatgcatgtttgtattggtatggatgcaaccatgtgtgtatgcatttgtgtgtgtatacatacatacatatatgtatataaatacatatatgtttacatctgtatggatttgtttgtgtttgtgtgtgtattcaggcacatatcatatgtgttcatttgtagctcactcaaaatcatgtaatgtcttgtggactcaacatctccaaaatcattttttttccttccttccttccttccttccttccttccttccttccttcctttcttccttccttcctttttcagatagccttaaactaaagatcttcctgcttcctcctaagtgctgggattgtgaatatgaccatgtctagctaaaattgaaatcttaattcacttattctccttccgtgtctacctaatctctagaatgactcaagccagtggttggacttgtctccccctgttgctgtttggtagtctcttcaggctaatgattccccagctccaactcttagatttgcccagttctttgcctagactctcactttctggtcagaccatctttgcccctctcttgggtaccttgggacctttctttctgggtctttgagtcatcctttcaaatttaatccccactcagaagccgaaggaactctactaaagtatagtagtgtccatttccccttgcccttcttcattcctctccagcctctgtcttgaggccttttgatgtctcctgatgctctgagaagactgagtccctctgttgcataaaaaccttggtggcttatccttccttagtgtccaccctccctggttctgctccccccgtgcttgcttcatattgactcctagaagttgtgagaaaattctgactcccctgcctcaggaactcacatgcaatagtcctagggagcctttcactccactctgcctaactgttgctactcttctcattcagtctgtggaggctctgggtaaagattcccactatgtttggcaagtttctccctcatacacattgtgactgatgttccttatcctcatgtgagaagtccctgtgatttggggaccatggtagccttgtcccagctttaacttcagcacctgtgagatgcagtgtgaacacggagcatccctgagagtgtgctggaagggtgcatggatgcattgcttacccgaggttgttactgaaggcatcatgcatggcaatgcaaaggcctttggtgcttcacttcctgatcacatgttgatcctcttcctcttctcattcccattttacagataagaaaagcaaggttctgggcagcaactttgtaagattgctgcctcttctccccatagcccctctccctaaggcatggcggttgcttctaatctttattttctcagcccctttggatagcagagtgtcattttgtaaatattggatcatgctaatatgatcttctgagcattcctaatagaggcattcgatagtgatcaccgaaatgagtctgtcaggagttcccgtggatctcagcggctctgccggctgcttaggctaagaggtgtggaggtgaatttggataagcagacactattctggtttctgaaatcttacacgtgttctgtagtccaggagtttccatcgcttctggaatctaacttgagtctgtttattccgaagtctgtcgccgtttattgatccactctgtgtgacaagttctgtgtcatacttggcctgggcgaatcggatcatgttattttggagcttaatctctttagtggcttggcctttaagtagactgtgattcacctactgttaggcctaaccgggctatctagcatcttttttcaagtactacatcttaactcccagtgttcacaatactctggctggttctgatgattgacatgtcatattctgtcctgatttaccatgatctttgaacatgctcctcctactcactgtaatgcctttccctaccatggaccattttcttcaagtctcagctcacgtaaactcccatagaaaccttccctcagtgcagagctgaagaaggttcctctggatgcctacttacagcatccaattcttagcttccaaggcccttgttgtagatccagtgttagctttgcaactgtggcaagaaaacacctaggagaaacaacttaaatgaggaaacatttatttgggctcgtggatgtggagggttcatgccaaggtgagatggatccatggctttggatggacctgctgtccagcagaacactgtggcagtaaaggtgtgagataggatttcttctctttcagaagccaggaagtaaagagacagacatagagacagacagacagacagagaccctttaaagtaacgtctttagtgatatttgtcccctagtctggcttgccttcctcaatcttacatttcctggtattccattaagttgttaatctatcagtaaatgaatccattggttgtagagccctcatgatgcaatcacgtcttcaagttcccactgctgaatgatgcactgaacccaagagccttctagggatatttcctatccaaaccacaacccacatgacagatcagcttattccaggcttctgccaagcgatgctggcacctgggtgcttctgttttcccacgttttattggaaaatcagacttatgctggtattataattttcttaggaatccttcagctgtacaatcccctgcatcccggcatcccttccatccctgcatcccatccaatcctgcatcccatccatccctgcatcccatccatccctgcatcccatccatccctgcatcccatccatccctgcatcccatccatccctgcatcccttccatccctgcatcccttccatccctgcatcccatccatccctgcatcccttccatccctgcatcccttccatccctgcatcccatccatccctgcatcccatccatccctgcatcccatccatccctgcatcccttccatccctgcatcccttccatccctgcatcccatccatacctgcatcccatccatccctgcatgtttcttctacctttttttctgaggccagcaactcttttccaggtctaggtagctgcccactcaacaacctgtctttggcctgtcccttcttaagtgcttctgcaaagcagagtggtccagcaagtccttctctgaacccttccaggatgagaaacattctccctcctctgtttagctttccacaaatgcagccctgttgaatttttagcctttctgttatccatggtaagcactctgcactaagtttagatttttgggaaatgaaggaaagaagaaagcactctttactttaatacttggtattaaagcttggtagttgtctgattggaatggtttgggaggacaggagctggggacaaacaaggaagaacatgggacacctggcaacatgatcttcccatcagtctcctgtgagaggaggtatagcttccatgatggctctggtctcccttttatgccctcgggttctcaggccacgcatcttcatctttttctaactgctagtgtttatggagggctgctagcagctatggactgaattgttcttcctcagaggacatgtgcaagttctaaacacaggtacttgtgaatttgaccttatttggaaataatctggtacccttatgtccctaattgcattaagatgaggctgtgctgattatattggatgtcagtctaataggactagtaggacgtcttagggcttttattgctgtgataaaccttggccacaattagcctgcacaggaaagggtttatgttatcttagaactctcaggtcatgctccatcaccgagagaagtcagagtaggaactaagtggggaagcctgcttactgacttgctcctcatagcttgctcagcctgctttattacagcatctagtgcctgcatgtggctggtaacccctacaatggaatgggtactcccacattaatcaatgattaacaaagtaccccagaggattgccaaagtaagctcatggaggcattttctaaattgtggttctccatttttagatatgtcacaggttttgtcaaactgacgaaacccaaccagcacataggggtacaccacacacacacacacacacacacacacacacacacacacacacacacacacgggaagaggtcgcatgaagataaaagcagagattggagtgatgagtctataacccaaggaaagtcaagaatagctagtagacagcaggaactagataaagtagagaaggcttctttcctggagacttttgtgggaacatagtttggtcaacaccttgactttgaacctttggcctatagatttgggaggaaatgagttcttatagtgttcagttactattttgtggtagtttgttattatatcccaaagatagataaagcccagtcaatctcatatcagtggcctgcttctatccctgcccagagcacctttttcacagaggaacttacataagggcattagagatgttagaagctggcatttactctgtgcctactctaagcgagaattagattagacattttttccatatagtatttgatctaatttgcaactccctcatgagttcggagatattgtcaccttttcattttgtagtgtactgggtcccagagaattaaataactggaccaagatcatgcgagctccccgtggcaaaggcggacaggcttggaatcttgactagtaaaatatagatgatatgcatgcttctgtcatcaactgagtatcttataaaatgatttctatttgcagtgtgatttatgagggaaagaccaatgcatattcatgcaagcgactatgcacaatagacatagcgacggaaaacaaagtggaagtcatgcatgcatacaaatacatataaatatgtttcttcatatgcttttaaaaaagcattttcccatatcattaagtatttctcaaatcatgttatctaaaagcttcagggttttccattccaatgactgttccacaatttatttaacaaccctgtctcatttcatattcaagtcccttgtattttcttctaaactacattgtaggcctcattcgtgctcgtacaccagtgcactcatgtccagacagagttaccaaacttgcttccagtggtgtatagttctatgtttattcccttatggtacttccaaggcagagtgctttgcattacttttgagataaggggggaaaaacaccatccacatgccaaaaatgttcgggaaaatgctttgtgaaccctaaagcaggaaaggcgtcaggaacaaatggtagcttgctcagagtaatataatagcttgtggcttagatgttagatggacgggggctttccagtgtgctttaggaagaattatgcatgccaagatggacgtcagctgcacaaaatctcgtggcattgccagtgatgattggttgggtagcaagtttgttcatgggctgtgtaggaagctagagtttgttcttttgtaggtaaaatcaacatttttcttgaaatgtcaccagtgctaggacttaaatatgttaatgtcaatgtctgtcaaacaaattgtgtgtgcgcgcgtgcatgtatatacatctgtatatatgcatgtttgtgtgtgtacatatgagtatgtgcattcatgtgtctatgcatgcatatgtgtgccttcctgtgtgtatttatatgctcacctgtgtgtgcgtgtgtgagtgtgtgtgtgtgtgtgtgtgtgtgtgtgtttgtgtatgtgtgtgtgtaggccagaagacatggggtatcacccttggttgattgctatttcctgctgtatttactaaagcagagcctcttgctgaaccctgagtttattaactgtttagtctattcagctagcatgcctgggacttacccctttcccaccaccacgaatgagtactcggaccacagattaaggctatgcctattgttatattggtggtagggatctagactccaggcctcatgttcattcagaaagtacttcatccactgaatcatctctctcctcagcagtgtcactctgtgtgtgtgtgtgtgtgtgtgtgtgtgtgtgtgtgtaggtctggagaacatttttcacagttgtatcttttctgctgtgggttctaagaactgaacttagattattaaagttttgcgcaagctttttctcactgagctctactgagtattcttctgtgtatcatgagacctgagtggcatacaccccttttcaacctcttccatttattctctgtgtctagttttagaagactgtccttcaatcctgctggctagttttgggaatcttccattgaaatgaggcttggtacactatagagctaaatactgaagtatcacctagctgtccaaggtggctgctcacacaactgggatatggccacctggactcttctgccctgggtgtctcatctgggagtttagggtcagcacccagagggtcagcatccagagctttgagtgtcatgggatagtgatagtgcctgaccaccatgttggaatgaaaagatgttggtaaacttttgcttactggccaactcttttatagtctgcttttttcaagattggtccctttctcttcatgatgtttaatgatattcttccagaacattcctagttttgagggagacagtcagatttgattttttcttgttagccacaaacctggcatgtcccaccatcacgcctttgccatacttactaagtcattttctagagtgtgcctgtcttttcctattaaactccatatcatctaggagtctggaatcctttggacacttttctccactgtgctctgttgctgagtctgcccctgcctgctgcctcacattcctcactatggctaagagcctcctcaagacctggactggatttcctgttctctgcatggagcacatagtggtccatgtatggactccatgggtggtgggtgacaagtggagtcagggatgggggaagaggtttcaggacagttttcaattctgatgttttcatattctcagcagccctgtggctgtcacagtttgagtgtgtactctttgctggataaggctgtgaactggatccagggaaaggtcctttgggcttgctttctgcagagcttgtcctttgatctttgcaccaggtaaaaaggatttgggggattcaccttccttcatgctgaagctagtcaactgctcactggggagtgcaatttggaagaggctctctgggaaaagtgttgtgtgccccaagctcaattattatgtcttccaaagtattaatgctgaaatggcctgggcacatggtctttatggtttcatatcactcctaatactgttgctaattatttcaaaattatacattcctagattcccattcagcttcggctccatcccccctctgtaatgatgaaatactgtatattaaatctttaaaaaagattggtttgtacatatgtgtgtattctttcttactcggcatgagatattcatcctaatatcactattaacagattggcatgtgctgaaaaagagagaagaaaagggaggaggagggagacaaggaagggaaaaaagggaagaggacagtaagcggcagaagatgaggaggagagagagagagagcatacatgtatagcaattatgcagggtagatacacacatactgtatagattatagtaattgtcctgatcataggagagtggtatttatatagcagttaacttgtggcagggtgctatactaagcagcttaaggacattcagcagtataatccttaaaatattcttcttaagtatttttattatctacatcttataaacgaggagggtcaggcacagattgcttaagtggcttgtccaggatcaccatcagcatgtgcttgagtgaggatttggcctcaagaagtctgggcccagcctctgcttcccaaggctgcaggtcatgatgatttctgaagtcacttggcccttctgccctccgtctcttttcccactactgtattcagatctaggttttcgcctcccaagatggcttggtgtcctattgggtagatgagccatggtttattttactagcatccaaaacgtggcagcaggggaacagaaaggtgccatgcttctgacacacccaaagaagagacaaagtccttgtctccagacagtgctctgaaaaatgcttacaaagcatctcattttatgagatggtctctggtgtacctaggactacaaaattaattgggaaaactgcattagcctgtgatgaccccaatcagtgctagtttgggatgtttatagggatcacagaattggtagaaaaagagtggacagaaaattgaatgcaggtttagtaattatagcagcagatatgactgggtaataatgagcgctggctgttgttataaacaagggtcctaagaattgctttgaacagcaaaaaagaaccttgaagtgatcagaatactcatctgctagataaacagggcaatgcatctgcatgtggatggctatttgaatatatgttgccttgtgacatcatatctggatttcagatatgtctgtcatatgctcaggagtatatgcaatagttttgatcccaagtttcccctaaaggtttacgtgttcaaggcttggtgttagagggagttggtggaaccttccagggggaaatattgctaggaagaggtcttagggtgctagaggcatgtccttgaaggtgagagtggggcctcaatcatcatctctcccccttcctcttttctctcctccaccatttctctatctcctcctcttcttcatactttccctcttagatatcatcctcattgtcttcttctccattatttaccttccccctcctcttcttcttctcttttaactccctgggatataagcttttgatttttcagatgtggtgcctcactgtaggcccagaagcaatgggaacaatttattataggctgaaacctggaaaactctggcctcaaacatattcctgtataagctcatgcgtctcctgtgtttgttagggcagcagagttaactgaaacaggataattaaagcagaaagtgatatgcatatatccttcaggtgttttagtcatagacatcgatgcccagagtgcatatgaacagtttgaataaagaatttcctaactgggactcaggagatggctcagctgtaaagagcactggttgcttttccagaagacctgggatccatccccagcacccacatggaagcctgtagccaattgtaactccaattctataggatctggcacactcttcaggcatctgtgggcatcatacatgcaggcagaatgcccatacacatgaaataaaatcataaattttaaaaagaactttatagctgttgagaatttaataacgtacattctccccctaaatacatataccatttgttgagcaatagtctaaggtgtttgtgtctatttagtgtttgatatctcaacaatgctgtgatctaaatgttactctttactcttgattcttatttacaaatgaggagacattaactaatgaactgaaatatttgaaataaatagaggagctgagatttgaatctgtcctttctggctccagacaccttgggccattatccatttttcaactggtaagtaatttatgaaatatgtttttgttgtggtggttttgagataaatttcacccatgtagctcagggtgcccttgtgttcagaatcctgcctcagccttctgagtgttggaattcataattaataattaattattaatacaaatattaaatgcttaaatattaatattaaacacttgaaatattaagtatgagaaatagaggtgtagctaatgttactcctaaaactttatatattaatttaagattttctgaaaacattattgtgggcttctcactgggaaatggaaggaatggtttacttaaaatgatgttttttacagtaaaataaatttgtgtatgtgtggtctgtgtattcattagtggatgtgtgcacatgtgcacatgtgcacatgagtttacatgtatgtggaggccagaggttgacactggatgtcttcccttaattgctctctacctttcttttttgagacagggtctctcattgaacctgaatttcatcaatggagctaggctagatggtctgtgggctccagggaaccttctgtacccagtcccagcccctgggttacaaacatgctgtttttatgtgggtgctgggggttgaatctcaggtcctcatacttgcacacagcaagtactttattctaagaacagtgagtctggtttaatgattaggcttgattttgccagtttgtggagttgaccaagtcactcctgctcagtgccagcatcatggaagcgaccatgtcccagaaactccctgaacagaacaagagagagatgagctttcttgagcccttcagtctcctccttcctccccctcactgttctcagaacaccttgaaggcagccatggccaagtatccttccagccctggtgccttctgccgtctgttgagtattcttcttccagactgtttatgtaaaggactgaaattccagaggccaggcttctcctgagttaacacttcctttctgagtgtgtccactgtcttacctaatgagggggcaagtttcttaggctctggatgtggtcgtgatttgagttatcattgcacatgctgggagatttggtaagaaaagaaaatcgtttagtacaaatggggtagtctctttagatttagtgaaaatcagatggctgaggcacctctataaagcagaacccaataacttggaaaaagccaacagtcaactgtcgcctcactgaggcactagcagtttagcagccacagccacatgggtgagcaagtctgtaaaatacagctaatcttaatccatctaaaatacaaacctgttttaaagggcttcattatcagaagagcacataaaacattttcgtttaccaatttccatgtaatgtgttaacatcattttatatatttggagttagctagcaaaattgatcgtgctcatttctagcccttttgatatggcacctagagtatttaaaattccacgggtggtgtgtattatacttctgttggacagtactgtcacagactgtcagaatttattgtgccttctgttcttctgcccacggggatgtctctcattgatgatagtaacagctggtgtatattgaacacttactgtatgccagggtctttaaatgtgtcctctgcatggattatagaaaccccacgttgctaagttacttttataattgtctttccacagatagagaagtcaaggcacagacagattaaataccttgcccttagtccccaaaggagcaaagggcagacaggatttaaaccaaagccctggcccgtggctgttactgatattttttaaagctcctgctttctgcacatggttctaagatttctgtttctgctttgtgctagtctctttcccgttctcattttctctgccaagaagtgatctgactatccctcaatatccctcagagccttttggttgtgtgctttgtgtgtgtgtgtgtgtgtgtgtgtgtgtgtgtgtgtatgcacacacatgcataccaatgcacatttatatataggttgtagttctttcatttagccttgacattctgtgaaagagacaaggaaacgtctgtggtatttgtcatgccctgcaactctctagagccagaaaatagttttttttttttcttttggttttctgtacttctgtactggctgattttatgtcatcttgacacaagcttcgtcagagaggaaagagcctcagttcatgagatctaactataaggcattttctcaattagggatcagtgggggagggcccagcccatggtaggtggtgccatccctgggctggctgtcttgaattctgtaagagagctgattgagcaagccatgaaagaaactcagtaagcagcaaccctctgtggcctctgccactgctcctgcctccaggttccagccctgctggagttactgtgtggacttccttcagtgatgaactatgatctggaagtgtgagctactgaataaaccctttccttcccagcttatgttttggtcatggtgtttcatcatagcagtagaagcccttgagtaaggccaacttcctactactgtttctgtgattttatcctagctctgcaacttttgggtgtgtattgtcctctgtgccttatttaccattatgaataaacccagaagaagttcttctggtctagcgtcctttgatttgtaactgaggagtgaagtaaatggaacatctcaaacacaagaatttagtgattcttgtgtaaaataagacattgtgaaaaaaatttctacagcctcactcatccatccatctgtcgtccatcggtcaggcacgacaggtgccgctgactctctgacaggagaatttgtcttcatgagtgtgtggagaccaagtacccaagggacaatctgtccctgagaactgaagcttgcacattgagataaatcccccaggtgagcataaggtacttactttgtttccaggcgtccagagagctacaggtctgtactgtgcacaagtttggtctacattgtgagtgcaaacccagactggggttcatagaaaggactcatctaacaaaaaattaccccatgtttctgaaaatatcttctgtcacacagttttgacaatgctcagtgctagctttctgttggggaagcaacagtgttctataccactctcaaatatgccagtatcttttaaaaacacgtcctttcctatgtattgtgttctcatttaaaaagaaaaagttacattctcttagaattcaaagcattatctgtcaccatcaaaacaacttgtaaaagcctggacaggccagagtgtgctgcgacctttaagagtcttggagtattctaaggttaaaggaagagttttagcgctaagaactctgtaaagccagacctgctggggcaggcaagcctgttaaacccatcaatttggaattagtcaagaaaacagaagccaccttagggatttccaatgggaatgggtttcacagaaggtatcagatgctaaaatacttagaagccatcacctatgtggtcaagtatcttccacaggaagcaagactcaggtatggggaaggactatggcttccacaaatgatcttggatcaacagatttcgatatgcagaagaaaactgaacccttatctcatgccacacactcaacattaactgaaaacgagttagagacctaaacattggattatgaatctttaaaatatatgggagggagcttcatgacttgggccagtggcttctttaaaaggacataaaaaaccataagaaataatagcaaaaataggcacacagaactacataagactggaaaacatgtacatgtgtgtgtgtgtgtgacaggaaacaacagtggaaacaaaactcatggagtagaagaaaatgttttcaaaccacatctgatgatccggggttaatactgaaaaatatggttactacttacaactcaacaacgtaacaaggcattgattgaagatgggcaaagacattgaatggatagttctctaaggaagccatacaattagtaacaagcatatgaatagattttcagtatcactgatcatgagataaatttaaacccaaatgacaacaaagcttacatttatttggatggtttcatcaaatagaaatcaaagcaaccaaaagtagtgaatgaaaatggcacagatttggagaaattggaaccactgtgctataggcaggagtgtaacatgaatcagcttctgggggagacaagaaatctgaaagagagctgcacacgctctgacaatcccagcttcaggtgtgtgtgggacacaagcagggtcttgaagagataggcatgcatccatgtttcagcatcattcctaggagccaagagtcaggatcaaccaaaacagccacttacaggcaagtaggtaaagaaaggacagtttcttttcttttcttgttactcaaagagaaattttattgattaaaatttccccttcccctacctggactgcctggctaggcctcagttggggaggaggtttttagtcctactaggactagatgtcccaggatggggtcttacccaagggatctaaggagaaggggaggagatattgggggaaggaatttttaagggcaggactgggaggagaggggggctgggattgggatgtaatatgaataaaaataaattatgaaaaaataataaatttgttacttgataatttcatgcatgtatatagtgtgttctcctcactctgaccccccatcctctccgacctccctcttgcccctgatacccctcctagtctgtaaaggctcctttccctcatccttgactttttgttacactttgcatccctcctctgatttttaaccagaacagtacaggaacaggtgtgatagacatgcacagggatattactcgaccttcaaaaggaagagaagtctgactgcatggatgaagtgtgaggccattatgtggaggaggaggaggaagaggaggaggaggaggaggaggaggaggaggaggaggaggaggaggaggagacctcttaaaatggcttaacctgaatgatcccacttacagacgtacattactgtggccaaatatatgcctcacacagctggtgggaggaaatgtttggtcagcttcctctgtcaactcaagaagaattgggtcccattcaaccatggctgaggtggcttctgagcatttggttgactgaacctggaaatactacttccttaagaagccctttgttagtggaatattgcagggactctgtctttttaaaggaaatgctctccaaagagtttacagttttacagtctggaggctgtgatgagtgggctctcactaattcctgaaatacagtcaaagcatcctttctgttatcctggtacacattgcttgcttttctaatggcactaacttcttttatacccatggcctttctagcctcagaattacatgggcccatactcatttctagctttccatcgtgccttttcatgtctttatgtcccaccatttggtctcatttgtctctggaaacctggctaaaagcacacaacaataactatgttgtgccctgaatgtgagtctgtatagaaatttcctctgacaaatgcactcggttattaggtttgaattcagtcttactcaggttttcaagaagtgggcaaattgtcgactttttactttgggtgtatgtgtgtgtgccacattttaacatgaatgggcatctgaccatttcccagtgatgtgtctactcccttcagaaactgcatggctgctgtctttgttatctgtaattctggtggcattctggccttatacactcgccctggaacatcctgttatgcaccacttaagaaatctagggcttcctgagccctcctctctaaattccgcagcagttctaatgatacagacatcacacagtcatgtctagttgctcatttctctgctacaaattttctgtattagttaattttttttgtcttgttttgtccctgggacaaaaatctaagtaaaacaactttaaaggagacagggttgattttgactgacaggttcccagggtttaactcatggtgactgggaaaatagggacaattaactcacggtggtgtccaacacatgtgttgaaagctgctctcactttggaaactgattgcaagatgggaagtaaggggctgcatctaaccttcaaaggtgtccttcagtgacctgcttctgccagccaggccccatttctaaaaagttctgcagcttttccaaatagcacggctacttgggggaataaacatttaaaacactagcctatgggggacatttcagatgtaaaaacacacaatgagattcctataatagagaaaataataaaacctaaaataggcttgagattgctgccactgggaggagaagcggaggggcatagtattaaatggcatgctcatgttatacaagtagagctctgtgaggtggtagtttgtaaataataggcgtttatttctcacagtcctatgagctgaggagtccagggtcatggtcctggactcctcaataatgcaataatggagtcgcactctgcatctaagagactatcaaaaagatggtattgatggaacacacacacacacacacacacacacacacacacaagtatgttttcacatgacagatgatacttaggtctctgcagccctgttaaggtcactcactccatgcatgagggcctggccctcgtgacttaaccaggccctcaccacttgatgttcatacatcaagcttctacatagaaactttgagggacaagtgcattcaaagcacagcaagtgcacgcacgccacattttggttttgcaaaatgaaaacttcaatagatattttgtgtaacaattggccacagttagctctacagaattatttgtttagaacctggttcctggctgttttgttcctgagatgcagggttgcaaggaaccagatatttagtccctctgggccctacacaatgaaggcaaattgagtaggtaaaaatacagtgttcttgtatttttgccataacatgggatctgtgaggctattctgttggggtatgatgcttggcagtcaaagactttatggcttcttcactaaatagaatgaagagaatctcacctgcactcaaggatgtgtagatggacacagagactcattctaaacacagtatagctgttgtaaaagaatacttgtttttctttgggggttagtggtagtattgataattaaaagatagacttgatttaacaccaggatgaaataaaatgattatctgattttactccatcaaaaaaaaaatgttcagttttacaagcctgggtttttaaactttacacaaagttttagactttataatgtaaacaataatcacagaaagattatttttcctagatcgaaaatctttttcctttgattaaaataaaaagtcaccaacctttgtcctggagtctctacatagttgacttccaggagggttaccaggggcatcttctcatatgaagttcaagggcaccacagccaggagagttgcctggagtgccttgactgatagtgtcgactgccttctttggcttagggttttctgtaaccttgaagagaaggctgtgcaactgggaacagtgagattaaatgtcacaaaatgttgggtgtgtggacccttgagagatttcaaacagttgacttccaagggctgaccagtctcagagctgaactctcccttggattgggatgtctacctgtcctctggataaaactcatgcctgtccctttttctctttttatgcatattgaaatgtgctaggtgctaattgtggtctgttttactctatggagtccatagttcccttttaccactagttactgaaggctctttgtttacttgtatgctgagcttcagcagcgagttccagacatggctattttagagtccacatatagtcacctttactagtttctgaattaggttgaggatatcattaggggtgctggttctgcagagaagaaacagaaacagttggcaatggcccactgtaagagagaatgacgaccaggtatctgtagtgactctctgaacacagatcaacacatgacatttcagattctacatgccttagccactgttgcctgtctcagagagagctagaaatgtcaagttgcatgttggcaattgtctgtttgggggatctaaggcttcacatgatctgttcagctcacctagaaccatcagggtaataccagctgttcccaagccctggcttgtgactggggtggggaatcagccagattatggagtatacatccttttaaagatccccgacaacagatgaaggtcttcctaccactgaactccagccatgcctgctactgtaatcgtacttaggaaatgaatttaggagaccagcaggcttagtcaggcatgacaactaataacatagtcccagcattccagatccaggagcaggaagatcacaaggtcagggttggctttggccatgtggtcagaccttgtctcaaaaaacagcctgcaaaccaaaattcctcagacatcttttagacctggatcctggttatccttacagagctactcaagaactcatgagcatttgtgccctgcagtcttgatagacctgaggacttagtttctgttttgacaaggaagagattatctatagatagcaattttcagaaccaggcttcccacttctcattctagaagctcaaaaacaggtgggtctgaatcaagtccccacccacttgcctcaggtctctccagaaagggggacttctgtggcaggcttaagcaagtagtttacctgaatgggcagatgccctggacacatgggctaaatgcttaggtcatgtcaactctcccagctgcccaagtcttgcctgagtcataccacagttctgggcatcatggatccattaccatgaatagatagcatggcaaagaatcacctctttgtacccaagtctctcttcttgtgatgtaagactggaaacatctgtctgcctcatgttgttactgtaagtggacctaaggcaatgggaagcagatttggagaactctgtctttctaggtatttcttgttgctgctgttactgtgaccttcaagaacagctggtttcaaacttcctgtgtcaaagaactgtagtgctttctgaaaagaccacccctgcttactcaccagcccctgggagggcggattaaagttgttgtgactgcaaacccagccgatatgggctgtaatatagtaaattatcacttgttttgcagtcttgacgagaaaaataaatgcaattacactcatgaatgttgaaaaatgaagcaaagcaatgtggatcggcacatttgaggtgcttttccaaatgaaaagctgcctacaatgaatgctaatgggctccctccctccagctccttggcatatggtgcaatgtgatctttctgaattaagagagcagctgcaccaagtggctggccatgggggcagtagccttcaacagcctccatgataggagtctcagcaagtagacccaatgttctccctaacctgggtacccaggatgggcccagtttcctaaagatgatactgaaatgattttggagccatctctctgtttcaggattcttgactgtactctgtagtttactctgtgtggcaagcacacattgaacagcaactatatactccacagtgtactgggagagagggataagtcccagacatcctttccctgctaatcatacaagaccttgccacctaggcccaaggattgcaacatccagctttgtgttgtcatgacagtggccaccgtacacttaaaatatggctagtccaaaatgagatgtgcttgaagaataaaacacatactggaacataaacatttaatataaaaacaatggtcaaataattgggaaggtgggccaattatatgccagtagcacattattttgtttaagggactggggcgccagaggattttctgtttgcatggccttctggattctgatgagctaagttaaacatactaaatgttttgttttgttttgtttttttaaaccttttaacatatggctgataaaattttttgaagggagaggatgacttccacttacttctcttgagcggtgtggctctagatctgttttctggttacccacatcttttgacacacactcccttttggggacactctgttagaccttcagcctcacctgctatttgctgtctcagggacctggtacttggggaaggctttttccagagttttctttcaatttaactgtcaccttcagtgagaagtactctgtgactgtccttgtagcatatgtatctttaataacactcagttctatgatgtatgtatttgcttcagtatctgtttctcctaagagaacagaaggaaggattgggaccttctgttttattttgtgctattttcaagtgtgtgtgtgtgtgtgtgtgtgtgtgtgtgtgtgtgtgtgtgtgtgtttgtgtgtttaactgcacctattgtgtggaggtcagaggtcaaccttggtgtcattcctcagacacaatccatcttgatttcttgagaacaagttttctctgcaaccttggaactcaccggttaggtgaggctgtgtgaaccccaaagatctgcctgtgtttacttccaattgctaggattacaaatgtgtgccacagtgcctgactcttttgcttaggtactaagtactgaactcaggtcctgagagtttcatggtaaatactttatcacctaaactatccccctagctcatggttttccatgtcaatcttcatgttactgtagcaactgacacatagtagatactcagattattctcttaaatgaatgcatggatagttaagtgtttcatttatgttaccagggagaaaccattttggttatttttagattgctgatgtttgaataagagtcaacaatgggccccaatctatcaatcaagtgaagtctgaatgaaaagagagagactgaggaatgatgtaatgaatttggtagagtcaggattatgtaaattaatgagaaagctaagtacaagtggctgaactcagagaggagtctaaggggccagggcagggaagcccattagggaactgcttgaagtatggacaacacagccatccattgccttctgtttccctttggctgtaatgagccagggtagctggtgcatgatgcctggagatgaaggccaaggaggctccccctcttaagtacagagcacggaaaagggtctatctggattgaggaacagggacactagttacaaagtctagtgggagaacagacagtaattgttacccccaaaagacctaaaaagctacttccttttaatgtgagggaatgtgtctattccagaccaacaaccctctcctaaaagtattctaaaagtaggatgctcatgagcattaaaattgtttaacattcatgaagagatttctggccattgaatgggaagtgtaattatgggaggcataaagttgttatttgcagaggatattattattcacccaaagctcaagagaaataagtgaaaaaccattacaacccagtgcaagagtacaacagggcagccagtcagggactaatcataggaaaatcaacaatttcctcagccttagtaataactagttataaaaataatataaaatgattaattttgctaaggcatcaaagtatagaaagctgaggaaactcgagaactagggacttcagaagggagctgaagagtaaaatggagaaaaacaaatgaaagaaagagacagatcactctcattccgtgacaaaggcttcctactttaaatcttgtgggattaggttttgtttaaagtgcgtttcagtagcaattagtgagcagggttacaaatgaattgtttagttgatctagaaaacataaatgagtacagctgaccagacagatgttgggcgacaacaggggagggatattattactcccagaagattaagagaacagaatatgtcctataaagagacatgcatatgcttgtatgactcagtgtgtatgagcatacacctatgtatgttagataacctggacacttctaataagtgagataagtcaggatgaaaattcatctacagtgaggtgtgggctaagttgggatagagttttttccttttttaattaattgatttatttactttatatcctgatcatagcttctcctccctcctctcctcccagtctatccctcttctttcccctccccaacatcctcctgccctccctttcttctcagaaaaggctcagaaaaaagggaggcccgttgggatagatttttaacattcactatcaaaatgtattccagatgaatggaattagtatcatttaagtgtaaaaactttaagtctctatggcatgtgatgcataagtgacttttatttatttatttttgtttttgtttttgttttcgagacagggtttctctgtgtagccctggctgtcctggaactcactctgtagaccaggctggcctcaaactcagaaatccacctgcctctgcctcccaagtgctgggattaaaggcatgcaccaccacacccggccataagtgacttttaaaataattttaatattagaacagctcctggaaaaagagcaacaatgacaagtatttcaccctgaaaaaataaacaagaagaaaagacctacatcaaaatgagccttgatacatacacacacactatttaaacatatagctatataaaataaatgattgataccatgaatatgaaaagaacttctacaaatcaataaaagaaagacaaatgatccattagacaaattttgtgttggtgagacttctgagaaatactgtcagtgtaaaacacattggtacaatatttagagagaacaatttaatatctgtcaaaaacatgaactatgtatatctctggcccccaaatttattcttgaagctgtattgcaaggaaataatcaaagataagcctaaagtgacaagttctgagtgtgtgaccccgacttcccagaattctcctctagccactgtactacagaataaacgagcttgcttcccgggatggctgcgaggtttcttttggatgatttgcctgtaaaaagtcccgggagaatggtgctgtgtattcatggttaacttcggggctcccacatcttccccttccttctctaccttggggactattgtacatttcagctctaggaggagcaaaggaaagagcactacacccaaacacatgtttaaatttagtggcgcttctttaagggtagatgttcagttttgcgagacatcatttagtaagtgataacagtatgcaggcgaggacttagactgggtgtactggctagttatgtgtcaacttgtcacagctggagttatcacagagaaaggagcttcagttgaggaaatgcctccatgagctccagctgtaaggcattttctcaattagtgatcaagggggaagggccccttgtgggtgggaccatctctgggctggtagtcttggttctataagaaagcaagctgagtaagacaggggaagcaagccagtaaggaacatccctccaaggcctctacatcagctcctgctttctgacctgcttgagttccagtcctgacttccttggtgataaacagcaatgtggaagtgtaagccgaataaaccctttcctccccaagtgcttcttggtcatgatgtttgtgcaggaatagaaaccctgactaagatactgggtattgggtgaaaaaggatctctgcttgggtacacgttagcgagggacccttgagtcctcttctgcatgaggccttgaccttgacccttgtcttgtttagaatagtttcccccaagaactcctttaggactgtgttaatttactgagacttctactacccttggtccgtttcctttcctgtgaatgtggtaaaataccctggtaaattcaacttaaaggataaagggcttgttttaactcacagttccatgttataatccatctcagcagggaagtcatagtggcaggagcttgagggagttgggtcacatcacgttcattattagatatgaagagcagcatgtgagcggacacttatgctcagctcatgttcctcttcctatacagttcaggattcaagtcccatgaatgttccgctctcagtgggtgggtttttccagctaacataatcaaaataatcctccacagacatgcccataagtcatcctaatgtaggcagttcctcagtgcgatgcttgccagttgattctagattgtatcaagctgacaattaaaactagccatcataggctgttattaaaaattcaataaattaggtaatttttaggaacaacaatttctttctttcctttgtaggctaaggaattcaaaacgaagtctcttgtaggctctgtgttcagaggggtttcttcttatagatggagctttggagtttgtcttagttagggttactattgctatgatggaacaccatagcctaaagcaagttgggaaggaaagggtttatttggattaacacttccatatccatagtccatcactgaaggaagtcaggacaggaattgaaataaggcaggaacctggagtcaggagatgatgcacaggccatagatgggtgctgcttaatggcttgctcatcatgcttgctcagcctgctttcttttagaacccagggccactggtccaggtatagtggtacccacaatgggctgtgtcttcccaaaacaatcactaattaagaaaaggccctttaagcttgcctataccccaattccatgggggcttatttatttatttatttatttatttggttttctctgtgtagccctggctgtcctggaactcactctgtagaccaggctggcctcgaactcagaaatctgcctgcctctgcctcccaagtgctgggattatagccatgcgccaccactgcctggcatgggggagggtgtattttcttaattgggattcccctacctcagctcactctagcctttgtgaagttgacataacattagccaatgaagagttacattttcattttgtagaaggggcaaaacggtcttctggagtctccttcataagggagttaatctcattcatgaggcttctgatcccacgacatcgcctcacagcgatcttatcacttagggggctaggatttcaacagaattttgggaggatataaataattggaccatctatcctatagccatggctgacattcagccataactctgctaaattaactcattatgtgttctcctactgctcctggtagtatttctctgtttttgccctagctctgttttctattgcaacaattttaaagaaaatctgtggtaacattttaccatggcaaatatccatgtcataacaaattcctgcctgccctataggagctttagatctaatagataaacatgagggcagccccacaatcagctctttaaaggaacacatttattcatggactcaagagatgtataattaagatttataatatgttataacatattagatgatactgggaatacaattgggagcaaacaatatcccctacatacccactaaaagtagagtgagtagtggaggagggggttcctcatctctggtgttatgcatgagataggggtcccaggtcaagaggagagagtccctgcaggagatgcatctcaggtacatccacagtgagtttaaccttcacttatggaccacaaggccctatggtttcagagctcttgtaagcacatttgtgagtaagtaggatgctagatggctcaggagccagcctatctgggaagaagacagctgaggtttccagaggctgagaggagacacggacagggagattatcctaataggattttgcaaagaccacttagcagtcgctgagcttggggggaaagtagttatgagctgagggtggagaaatagccaagaatctggcaactaggcgaaagcttggagagaaaagctgacagccaacagacagaacaagatgatgcttgcaaaggagtaaaaagaataggctggggcggggggaggttactctgagagatgtggatggaaacaggagcgcattaatataagtggaggctgcacatttagataattccagtgctgagaaggagcagagccaagactttttcattacggtgcttcacacagtcagagacctcatggaaacaaatgtgggtagcagagggtcagggttgatgtggaatgaaatccgtggacataaaacactcacaggaatatggacgctactccaaccccacttctgttaagagacagggaaacagagcccccaagaagtgagggttcacatcaaagccacaacaaggtaatggggagagtagaagtttgggtgctgctgatgggtttgcaaaaaatggggtagctatggcgggaggcagttgacagaccctcaaaaaagtgaaacatggaggttttgtttttaaaatgagcttgtaacctccttgtgagcatgtaccccagaccccatattgtttcacagagcagaaataagtgtgcccaatggactcagagtgggctttgtgactactagtcagtgaccgcccttccatggcagctggtattcttccttgcattctctcctcttctcttccccctcttcattcacatggccacatcgatggaaacaagactttgatgtcaccagaggggatgagcctttgcaggcctggccgtgtgtcaacctcccacataacttgccaacacacagttatgatttcagatcagatatccatgaaaggaagaaagctttcctacctgtagccatgaagctaatgcattctcagtgtggaaacaaccattgcctagtctcactgtttaactacgtattccacagtgtttgctttctcccatttccccagtgttagaaagtagttgcctatttctgtttactggaacacctctgaattaaagacttttgtatgccataccttctttgaagacattcaatgtttgggttttgttgttgttgttgttgttatttttggttattttatttatttacatttcaaatgttattattccccttcccagtttcccctccaccaaccccctatcccttccccttccccctgcctttatgagggtgctcccccccactccacctcagcaccctagcatttccctaacctgggtcttctagcatccaggacccagggggtcccctcccggtgatgcctgctaaggcaatcctctgctacatatccagctggagccataggtcctcccatttgtactctttggttggtggtttaatccctgggagctttggggggggcggggggtctggttggttgatattcttgttcttcctatggggttgcaaaccccttcagctgctacagtccttgccctaactcctccattggggtccagtgctcagtctgatgtttagctacatgcatttgcacctgtattggtcaggctctggcagagcctctcaggagacagctatactgcctggtatagctgtcagcaagctcttcttggcatccacaatagtgtctgggcttggtgactgtatatgggatggatccctaggtggggcagtctctagatggcctttccttcagtctctgctccattctttgtcactgcatttctttttgacaggagtcaatgtttaattaatatgaattactttaacttttttctttgtttggagggggcagtcatatggtgatggtatttgaccccaataggttatttttgagtttctcttttctttttttaagattgaattttacttttatttgtgtgtatatgtgtatatctgtttgtgtgcatgccacatgtatggtggtacttggcatggccagatgagtttgcctgatcttttagcaccagagttttatgtagttgtgagatgcctgctgtagaagctgggaacttaacttgggtcctctagaaggcaggaagcattcttaatcattgagccatctttccagcccctatgctagattctcttttgcttggttccttactttatctgagcactgtctgcatcccctcttaggagagaggaagcctctggagacttgcaaatgggactatcagatatagttagacatagagacaatggcaactttgtttctagtctctatgcctaactatatctgataattgttagtaagataattttaactgacttggcattgggaaaaccctcaaaaggattggggctgccttctccagttcctttgtttttctccagaatcaatagaaccactcctttaagaagaggtccttctgtttcacaggctttggtctttaacttcctagacctgtttgttgtcttagcttatcccatgtttcatgtgactcgttatcatttctttatgatacggagttctaagaggagtttaaggaaagatgtccagccatagtgggctatacactctttaggtagctcatgtttttccccagggtttaaggatgcttttttaattgtttccttcagatcaggaatttctgtatttagcttcaacagtgccattccatttgaaagaagaggacagacattgattcatcttctttcagtttgacctggatgaccttaaaaatctttgacatgaagttgaggtactttctgtggtttgggatcgatcgtgctttctgggttcttttaacttcttgtttatgtcattcagctttggagatggaagccctgtgaaatggcatggcaaccgccatattttctggaagacttggcatcctttctgctataccttgctgggcgattataaatacactcttgcacagccagtgtgacacgctcttattgcaaagggttttcaatgaccgtattcactgaaatggcctatttatatgtcaaatgcattattggataagtgcttttgtaagaacagaacaactacaaacaaaagacccaggttcaggctgccaaaagatactgcagggcctctcctgccgtccctcccccatcaccccatgtgtccatataaagttgggacagaggggctcagtggtgaatagatcttaagtgggcaatggttttcagaggactgttttcctgttttcgcttcaagatcttaatgttattgatggcattgctgctgctgttggacctagcatcatggatctaatttaatttaatttgcttccttgcaaagaaggtgatcccttgcgcagctgctgctctgagcagagagggagcaagcaagcatggagataaaggctgaaccttatcagacctctccaaggtttatggtaatgagtacagcttagagagtttgggaacttttttcctgtgattgctttaactaccatgctgcttcctgggcagcaaggcatattgtgcctccctgtctgctgtgcagtgaggagctgggagaggtgggattatgtgggtagtggattctacagcttccaggtgtcaagctaagatgagtataagacacatggcaggtgtttttctatccattctgtcgctgtgtggctagggaaggttttcagggagaattatgatgggcagcaggtatggttaggtaatcctgcactaaatccagcttatgacttcacaagtttatctctttggaggaattcttcaaactttctgggatggcttccttaagtcatacgtgaagaaagccagtgcctctgggcgagactgccccattcttgtctgtgttctcagcaggatcagatatttttaaaatttagaattatttctaggtgtgtgtgtgggggggggtgtatgtgcatgcgcacatgtgtgtgaggatcagatatttttaaaatttagaattatttctaggtgtgtgtgtgtgtgtgtgtgtggtgtgcgtgcgcacatgtgtgtgagtgcacacagaagccattatttctaagtgtgtatatccacccacatatataccagaagccagaaatcaatctcattttccttctccaagagctgtcatttttatttttttgaagcaaggtctcacactgggccctaggcgtcaccatttttcagctgcatccactggctcgtgagctccagggatccttttgtctcagtatctccagtagttacatcataatgtgtgctaccatcctgggcttttggtgtgtttttcagggattggacttaaggctttgtggtttgccagttaacacctgtccctgaaaaccctgtggttcactgtttagactatagggcccagggaaaagccacatgaaccaagatacatttctgtggctgaattggtcttgctgctacacaagaccaaaagatgctcctggctctgcttcctttgctgtcttcctggaatgtaacttggatgcctctagtaattttgctatccagcctcgggctgccagcatctcacctcctgatgctttgacttgatcatctttgctatgcaagcttcattacttcatttgatctctcaagtatcctagcaacccaagtagaaactttatttggcatattctgttggccgttcagattgaccaccccactgggtggtctagatttctcagtgagttcccgcagtcccatctccttctgtctactctcttttctacatgggactggtgagatagttctgctccccccaccccctgcccccatacaacctcatgaaccgaacactatagataccagaagacatgtggccagatcagacaagtgggtatgccaagtagaacagcctcgtggggatgaaatccctgtgtgaaggacacacttctggaatgaacggtagaaaaaaaatcctcctaaggatgaaaaaatgcctggctcagaaaaaaaaaaatcaaaggacagaggccttagaaaaatatgattaatattctaaaaatgcatgcaagtgcatcaaagaaaactccattgacattaggaagaggttttaggagtcagatacaaaataaattcaaaataaaatatttgttagcttttctcctatgtgcgttttttaatgcatactatacagaacaaagggatcccaataataatagggtcagaatattttaagggttcaggatgaagataataataagatgtagggcctggatgaaaaagctaaagaactggacacacaaaagactggactgcccaggaaaatagcgtgtttctaaatggaagcattcagccctctcaggatgttcgttctccctcagatttctttcctatttgtgcttttgtgacctgtcagacatcattctctgtgtacatagaaaaggtgtatgccactatgaaggtaaacaactaattaatttaaaaacaaatgggttatttgcaaggtaaaaagttataaacagttctaaaatgaagtaacgccctaaacatgttatttttgtggctagtgaaatataattggagccaaccaaaaaaataaagtaggagtgatgggcgtctgcatgaagtaagagtgatgggcatctgcatgagtatttactatgtgatggctatggattgtacattagtggagaaaggattgattattaatgcaattagaaaaattggtgcttcagtggggagagtggatcattattatatgttaggaagcagaaaacaaaatgtagttggattctacacggtattggtacaggaaggtttggaagttgtaacgatgatgtttgatttttatatgtgcaaatgaattttaaaagtgtcattaaaataaaaggcccagcttctctcttccctttctggtaaagctcctcaagagactgctcatagtcgctgccgtcagtctctcagctcatgataccatgccagaccactgcagccatcgagcccctgttcccgccctccacaggaacggacacagccaaggacacagtgacctccatagctcagtatgctgccacttctctcccttgacctgtaccttctgcttccgtttcctcacttgacttctggatcgtcgctctctctttgtagtccccagagcagactgatgtcttccagtctggtttctggccctcttagagtgcacagagccacaaatgcttttatgtagctgggtagactctaccgagggcctccattgggtgcttgccttgaagtctattgtagggtgaatgcagcctccattttttatcccaagttaagctttttctcaatctatgctttgaaaaaaacaaatgccagcatgttcccttcacttgggtgtctttttagtttctccactatagcaagtatactatcaaacttataatgttcccatacccccactctgacattttctaactcccacggtgccttagtcacttttcattactacgaccaaaatacttgactgaaacagcttgagagaagaaagagttattattttgactcatggtaccagagggtcatagtccattatgatgggggagggcatcgatgtgtggcttggaccctaaagctaaaagaaaggagtgaccattgtttacatggtggcacacaggaagcaaggaacaggccagaactaagggtggttataactttctaaagcccagccctagtaatcttcttcagtcagcaaaggccacctcctaaagagtctacagccattaaaataatactgcaaatgtggggccaggtttcaaaacaagagctgttgggggaacattccagatttaattggcaacacatggtcttcattaagtaggagaaatatcaatctcatgatctgttaatataaacatataataaatattagttcttttttaaatcacaagttggcaacttatggcctaaacttgagatctaagagtttgatttttataaattatatggaaacagggctatactcgttcatttactgttatggctattttgcagagctaagtagatgcagcaaccccagaatggtttcaaagctatggattgtacagtctacctccttgctaatgtctgatgaccccaggaattatcacctaaacatctggatttggagctgaaggaatggacaaagaaagagaaagaatcttgttccctggaaccattacgattggagataattttgccttaactgggatacttttaaaattgaaattggtatttgggacaggcagtaagatatagcttcgggtgcctctaatggatcattgagaactagattggaaagaaagaagtgcatcaactaaggttagaattaatagaattaagtaaaaaaaataatagaaatcaatactggtaaagcaacagtcttcatcagtagctgggagcattaagattctttgtaactttagatactttccgtgtgaaacagtaaatcaagcagccattcgctcttcgacagtggacagaatgctatttattattcaagataatagcagggacagaaactcaagtgctccttgaattgtacaagggacagagatgtgagacaagaacaaaatgttccactctaacgagtggaaaagaacatcagaagacgggtaacatggacgtttgaaatagtgcagaatggtggacaggagggaacagctgtaattacgtaaagatctaaggaagtgtcaaggagccagtgcttgcacgtttgacttagcaatgagctagctaccaagggctctaatgaggaccaaagaggatcttacttgtgtggaatgagacctgggtaatcattacttccccttctctgaggttttgtgacatgagagaacagagtgtggaggcagatgggctacagggctgtccttctagagagctagttccaaatagctggaaggaagtgctctgaagtaaactcttggaccagcttttcagataaagtccttgagacttggagcatcttccatgtttcttggagaggaaggaccaggccatgggctgtgggttaaactgacagctcagccctgaaaggatgagcaagtttaggtgatgcctttgaggagaaagaccataagacagttgggtacatagcaagtgaataagtcagatctgacttggtgctgctggaggggatgcccaaaggctgttctcaggaagacagagtcgcagcactacttaatagaaatagctttattagttaatgaaatgattaattaatgaaatcccacctctgctatccttggcgggcctatccctcactgaataagacatagtttaccttctggttttaaattttttgccttttcagagtaggaatgtagctcagttggtagaatgcatccataaaccccagggtttgatctccagggctgcacaaagcaagcatggtgacacatgtctgtaatcctaactctgggaagataaatgcagtaaagtcagaagttggcagttatcctcatttgtatggtgaacttaaggtcaacttggaatacataagaccctgcctcaaatctgtcttggaaatgggctttccccagttttgtcgacctcaggatatgtgaggagagtcccaggatagtacctgaaaatatatgttacctgtccagatcttctcagagttagtcatactcaattctctataatgctggatctgttgattcggcttacagccctgtattgcataatgatgttttggccagtgacaggtcatatatacatgacagtgatctcctaagattatactgcttaatgatatagacatcctggttcacgtagatgtactctgtgatgtcttcacaaggatgatatcactaacaatgtatgactcagaacatgcgaccatcccatgtggtcactccaggaaactgttttatgaaacaatgagatatatttcctgtggatctctgaattcagaactagcaagagagaacatttttggaaggatgcgatgctggttgtgactgaaaaagtcagatttgctattcaggaacggtgtctcttttactttaccaattccatggatcattttggctgctagaaagactttattttttttattctgaggatagaaacactcaaggcctctttttaccctaagtcattgcctctaaaatctacacgcattctctagatgaatgtagtaggtgcatgaaatgactgagcttctagattatggcatctgtcttcaaagtccagttagccttctggtgaccagggtcaaacctacatatccaaggtgatttctggcacaaacatgtcaagatgcctacttaaaccctaaatgctttctattctgtgctgctgctgtccacgtgaccctctgaattccctctgtccttctctgtcatgttcactttatgagtcaaccttgctttcatatgacaggggactggagatgagcaggaaagtatgttattggaacttattctataaaccccttctttacctcaccttaggccaactatgtcccttgactgaaggtcacagaacctgtcaaaagaagagcattctcatcactgtcctctctaacctggagtctgttaagaattctttcagagtgtttctgtgaggtagaaattattctctgaaattcctgatgagaaaagcagggctcagagtgtaacttacttaacattatatagctcaaggctatatagtggaatcaaggttcaaactatcatggcttcaggactaatgctctgcccatcactccaactgaccgtggagatagatgtccctagcctctataattcattgtcccaactcatccaagatatgtgatcttgtaacccagctgtttactaactttgctggggttcctgtcactagaacatgctcagtgttatcatacttgggcatgatctaatttgatcttcattaaaaaatgggaggaactagagattatcttatcatagtctctattattgaagggagaaaagccaagcatggatcaggtctattgttctcttcagagtcacattgttggccaggaaaacagagagaaaagtttgcctttagctatattgccgattactgtgctagggtccccagttcctcaacttctttttaaataggcttgagatccggggcagtggcatggaaaagaaagggagaaaaagcaggcattgcacccttcttggaacccatccccagacttgtatgtgtcctcatcaaggctctccagagcttatcacttcctatgtagcaagaggggtgctcagggtcctggtgagcacacagagacctcagaaaaattaattatccaaatgctttattttgttcattcacgcctttatggaccctctatcctcagttggcttgtatggtgagttctatattaaatcagggtgatactcctgtgcccccaagaggctgggatagctggggctattgctgtaataccttgattgcaaagggggaaggagccctgctacctttcccttgaggaacatctaatccttccctgactggccttgctgctgcggaagcctttgccccagctgcacatctgcttctgtaatgcgttttgttgatctctcctgagagggggtgctcaccataaggaaggtgtttcattaggtcttaataaatcctgtatgtgcagcctggcctacctctcccccatggagctgctttctgcatgaggcagggagaggtggatgattcagacacaatttgcattggcagcaggaatattatttttgcattataaagcacagtgggtgaccttatcaaagctggaggaagtgagcagacagcaagagaacaggtgtccacagtaacaagtgacaccctgaggctggatactggcagggggggatggtgagaagatgctgagtccctctgccaccttgtgctaggacaggggttgcagaatgttcagtcttctcggtagaaactcaggaaacagcccaaagtttggggggcaatggggacacggaagaatcagccctccgggtggatcaaagctcagaatgagcctcaaacagcacatggtatccttgctgtggaatccctataaacataggtgtgaggtcttgctcggattggtgacttaaagaatgagtgattggacaaatttaagaatgtctgagtgtgaaggaagcaccggatacatcagaggtactaagaacagtacattttggggaggaaggatgttgaagtcaacgttaacatatagagtattgaggctgtatggacccacagctagaggaaagtgctatggtaacccctattgaccagcatagttccagacaggcccttcccccaccacagggggctacgaagttggtttcctgccaggcactttggaggttccaaagaagaagaaaccattgacacttcagaactcactggtcctggggatgctccctggaagtcacccaggccaagtagataactaacccttgtagaaaagccctccattcaaggggcaaaggcgatgctttggaggcagcggctgctttggcacagactcatctctgagatgagctcatccgaggcctcactttccttgtcactctctttggatcttacagtctcctcccagggacctgtactcttttatttaaaccagagaaaagtgggatatttaaaaatactattatttctatcactgtttctgccatttcccctactatttgtgccattacagcagctgctgaaaaacaagtaaatgaagaatttatcatttgcattgcagtgctaagtgttggcattcagaatactaggcattcagccatgcacttatctgaatgcctgcactcacctgcatgttagctgctgtcctggcctcagggtgtgtatttgataccactgttctagtttgaggattcaagattcatcttcttgaattgtcttcctcctcatctcctctgattggggcaaacacaggggattgacctcaccggctgcttggctgtgtttctaagattttcaaatgtgatgcacattttttttttctggccagttaaagggtattctctttgaggaaagagaaactctcttgggtcactatggaggagtggtacgcatctgagtctctcctgttttgttctttttaagagcatggcatctgaagtctggggaggtggatcaatcagtaaagtgtttgtcttacaagggaaagtactgtgtttaatccccagaatttttgtggaaaacctggggacagtccaggctctgaggaagagggggtgagtgaattcctaggcccatgggtcaggcagcattcttacttggaaagccccagaccagtgagatctatctctcaatagatgattgattgggataaataagatagatagatagatagatagatagatagatagatagatagatacatacatacatacatacatacatacatacatacatacatgatattgatattacaagaagaatgatacagggacacctgaggatattgtctaacctccatactgatatgcatacatgtgcaaatgcactccacatacatattcaccaattcaggtttataagcatgtatatgtgtgttcacacacatatactcacataaacgcacacacactttccccactctttctctctcccccactctcagtatccagcattgagcacagagatgattttaacctgagtctgaagtgtccctgcctccctgggagctgcagccaggggaatgccttgtttcatccatacttacaaactgctcagactcctctcactctaccccttcccaaatgatgcagatcacaccggctacagcccctatatttctcagctttggacttagggcatcatctgtggtcaccttcgccaagtgtttgcaaatatgacaacttgagatactcccatcagtcatgtttacctgcgttatgctgctcatccatctagacttgctatttaaaaaaaaaaaaaaggtcttttttttttttggagatattttttgacaggcttctgctttggggtcgctgcccagagaggctgtgtggtcagagcatagagtctgaagaacaaaggccctcaggatgctgcagaaccatactcaccctgagactgtgccagccataaaggcaccgtgccaagtgagatgtacagtccgtaattgcttatttatatcctgtctgggatcgcttatcatgaaatagctgtggctatagtttattttccagacctctttagagaaccaaagttcattacactctggaagaagaatggcacttaaaaacaaacaaacaaacaaacaaacaaacaacaggaagtttctttgactggaaacctactatgcaggtggagtccttgaaatcgagatagaagtataatagcctgtccagcatcacatgaggcctaattaggtgggctttcctgaccccagcttatacaattgagctgctcagctaccgtgtagggactcacacaggctctttattttcacacaccttctcacatttggggattgttcttggtgcaggcttcttacaaaccacttccaacataagcaaggaaggaacctgggaatcctaaagccctttcattacaccaggctgctttggaagaatgtgggacgtcacttattctgaggatttctctaacaacgagtctttatggtatggtgatctgtgctaaatcttaagagttgtagaattaaaaaataacataacatggtgattagagtgagtttgggaattagagaataaggagactgaatcgtgttgaggactactgaccacttataacacagaagatagagtcactcaggctaaactatagtgtttatggagactcttgaatcttggtgtaggtagaattttttccctatgctcattcataagtatttaattgtccaggactagccattaggcaagatatctacatgcatattattatttcttacactatgctacagattcatgaactagatccagggatacatcttcttacacaaagtgagaaatccaaaagcaatggacagagacaatggtcttttatcaagttcaatgctaaattcatttggctgtgaaatctgacccaaacagaagtctagctgtgtgtattcctcacttacctcacatcatagtgagtttttgtgtgaaaatatgtatgtgagtttgaatgtcttagattctatacggtggtacaagtatctttatcatctgtctataaacctgaactgtttccaattctgaaacaccacttgtcacttgtcctgagggttttgattagaaatgatggtgtggactagaatctgtgtttcacagcttcacaggaagttcagtgacatgcctcaggacacttagcccaggaatggcacagataactctagatgcatgtatagtttgaagggttttgatccattcattcctggtggcagaatatctgacctgtgatgttatttattaagaggcaggcgccaagcctgaagaagtaagaagagatgtctactttgtgcttagggtcccacctgagagtaggagtctgaattttccatccacatggatactaacatgaacatcaagagtaatccctcaactgctcgcttccctcaatccccagtacccaggcttggcagtttcctgtgaatgtttcttcttctcacttcttggtattatttcttctcctttcttccttcttctttcttctttcttctttcttctttcttctttcttctttcttctttcttctttcttcttctccttctccttctcctctcctcctcctcctccttcttctccttcttctccttcttctcctccttctcctccttctcctccttccctccttctcctccttttcctcctcctcctcctcctcctccttctcctgcaccatcaccatcaccatcactatcaccatcacctcgatatcatttcaaactactctatgtctctgcttggcctctccacttctgtctgcacatagcgaatggaaagatcttaaaaacaacttctgatagtgctgttgacatctgaatgtgaaatgttctccataggcttgtgcatttgaacactctgtctccagcaggtggtgctgtttgggaaggatgcggacccatcaagagatggatgcttgctagaggtggttggtcttgaggttttatagccccattttctctccttccttcttatgggtgcagtatgactagcagccacctgcttctgccggcatgctttcctcttaggatggatttgactcccagaaccacaaggaaaaggaaaccctatctcccctaagttgattcctgtcaggtattgtgtcaaaaccccaaaatccaggaaaagtaaataaagtaaatgtctaataattttcatgctttttccatttcttttaaacacattgagaatcctcaacatactttggagttctgcatcaattgtgggctgagcccctgccatcaaagtgtcagatttatcctgaagatggaaggaccatcttgtgtatgttaccttgactctactctaggaattttgcacatgtagtcaattgaggatattctctttcttccttctgcctagacaacccaagacccatctcattctttaactcgtagctcaaattccccaactttgggcttcctctgtcaaatgatcttacagtcttttttttttttttttaattttaatggatcaaaccacaaacttcagttatgtgtttattggtattgtaattgatggaagcctggtacttgcccataacccttactaaatcattttcttaactctcatattcctgaacctcacacaatatctggcattccctaggtgttaaatgatcattggaagaattcctagctagggaatcaacgtatgacaggctaggttttgtgatatcatagaacttttttttattgagtgtgatttgtatgtaacaaagctggaaccacaatctagcactatttctcccaagccccacgggctctctgcttactgctctctgctggtggtatccctggggtttctctggcaccaagattggtctcttgtctcccagaaaaagtgaatgccttattctccagaaacgcatgagcttctctgtcctggccacttacattgatgagcacaatgaggcttctctatggcccctcctcgttcttccccgtccttccctttcaccccttgcagattgtgtgagagaatttactgacgtatcaacaaagtgccagtatgacgaggcatgtggcaacatactatctgtcaagaatggggaggaaaagggattcttgttcattcccggtgggggcataaatttgtgtagccactgggaatggtagaattctcatatgacttagcctttccagatctcattatcccaagagagcccaagcctgtatagatatagttgtctctgctcatgcctgatcattgctgtatgcatcataacgaccaagacaaggaaacagcctagatgttcattagcataggaatatagaaattgaggtacctatacagaacagggttctattcggctgtgaagaaacaatgtcctttgcacattgttttcaaagccttcagaaagatatatttttcaactataggatacttgtgccaatgagggagaaaatcacacaggtgggcagtgacactgttgaggtctgacctgaatatgagtcttcaaggtgacatcccagaggcaggagatgtgagaaggactctcagcctctcagtgttgaatgtgaaggtgggggtaagagagagctccatggtctattatgccacataatacaattaacttaatacctatttttggtcaggtattgtaataggcttcagcttatatatggtccctagactaaataattagctgaccttagttgtaagtgttatgaagaaaacaagtacttaccaaagcaaagttgctagctgcaggtgcaggtgtcaggggatagactgccccttgtataccccctgtcgagtggggtgagtggcttagatgccccccgggcccgagtggaaagcatctggcagccctcccacatctgcctacccagagcataggtggaactctggctggatatgggctatcctccctccccactctttgccctgcccccctttttagttcccacaacttactttcagggttggggacgctaaggatcaacagggttctgggcatacccagatgggctcctaaaggccatttgcatgtgagatgcctccagccatcccaccccccccaaaaggaagtgcatcttggttatattgccactatctgtacaactctgagcaatcccatacttacagtgggtcttagcctcccattatgacatgggcagaggagaaggaaagagagctggctctcacttattccaagaagttcctgtcccaggataaaatgaatagcactgtcattcaatctggcctcagcctccctgggttcaaatcccacgtttcatagtctttaccaactaacactggacagattgcctgggctttctgtgctgcggtttctttatgctttaatatacagatggtaatagttaattcttcatttctgaggattaaatgaaattgtgaacataaaatgtctggcaatacgccacagatgcagcaagtgtctaataaacattagctgttgtcatctaattatttgctaatcgctctagatataaaggaggctttattgtcctggttttatgggtgagaaatctgccaaaaggtgttgaaattagtgtcaggaagtaaatggctgaccagggaatcaaacctgggaccattttgttccaaggctctgctcttccacgggtgtttctctcagtttctgacccacaaccctgaaaaccagcttgactgtgcccagatctcagcatggccttgagctccccttacgatgccatctttcctttccatattttgtttggctctgcgttaccagttatggaagatgtcagacggatcagcttctaacatgggaaccctttgtatgaaatagaagcatccacgtactttttatttaacagcagaaatacacaggccaggaacaggccctgatgtctcagcagccatttacactgtttggggagcctgtactgaggtaatatatcaaaccgcctgtggaccatgccacagtggaagtaggcctggccacaggagctgtctgcagaagcagcccctggcctctggaccaggcagtagtaaccgaaggtaactgtttctgatggggattatggtgagagacctctatggtggattcagtttcttggaatgaaattctagaggtagaaggagatagctgaactcaagccatcatgtagagctgaaaagaagaggccaaaagggcaaagggcagggctggtactgtcccaggctcttgttttgcatgggagattgtaagagccagttttccaatgtgtcgtcttaggggaaattttgctctgtgttcccaatccctctttccaaatacagctctcatccttaataaaacacggcttttcctgtggtttatttcatattaggtttgttgtgaccgagatgaattgtttgtgtgtgtgtgcgtgtatgtgtgtgtgtttcaggatacttgtgtgtttatgtacaagtgtgagcatacacgtggaagccacacaacaacctctccatgtgtctctaccttgccagctctgggattataggagtgtgtcaccacccccaacttctttaattccttttcttgtcttcctctcccctccgttcccccctacacttcctcttttactactttacccatatcccacctttccttcctcatgggttctgtggaatgaacatattctcccatccttgcaaggcaagctgtttactgactgagccatgccctagtccaactgtttctttgaggcctgtggtgaagaaaagataacagggagaaaatcaaagcgctcatctcaggcagccaggtcacagggagaaggggctggggacacacccccagggacaaacttcttcacctgggcctcacctctgaaagactgttatgagttcatagatacactaatttgctagatagttcagagcccttgtgatccagtccctcccccaaatctcatcaactggcaagctaacctttaacacaccatcctgttagaagacactttatatccatagtgttcccaattaagacgatggggtatggtggttagaatggcagtggccccatagactcatacgtttgagtgccttgttgaagtagacatgactttatggaaggatgtgtgtcactgtgggggcaagctttgaagtctcctatgttcaagctattcccaaggtggaacacagttgcttctgctacctgtggatcaagatgtagaactctcagctccttttcccacctgcctgcctgccgtgtctgccagtcttcatgcttactgctatcacgataatggactaaacctcagaaactgtaagccagcctctattaaatatttgcctttctaagagttgccatggtcatgttgtctcttcacagcaaaggaaaacacaactaaggcaaggagaaacatttttctattctatatcacatattatgtcttattgttcttgtttttatgcatttctcaaattcactccatccctccatccctccctctctccctcctcttttccacccctccctctccctccttctctctgtcccttcctccctcctcccctcccttcttttctcccttcttcctttcttcccatcctattcatttccatgttctgatcagttccctcaaatttatcttctaagacatctattgtgtttttattatgctcttacattttgacatgggtgagttctcttgattctcttgatgcccctttcttatgcatcattagcattcttgtgcttatccccgcctctttctttcatgttaaagaggtgctgggtccttggtgtctctggatgcctattcttacttaaagagggggctcagcatgtggaaagtgtgggctgagagagaagcttatttcctgacagatggactgcacagaggtgatgaagacctcactgaggccttcatggtatttgtacttgagatctattctgctttacttcagtttccaaagagatacaaccgctgttctactaagggcacagggagatatattaggaggctggcccagggactgtcagacaaggagctacttttgacacagtgtgttgtttcctgtgggtcaccacccctggctttgtatggcactgcccacagcaagtcataaagtcaaccatacaagattccctctgttagatctgcttctatggttaaatcctcactctcacctaggaagagaggaagagagaaaggattatattctggatgcttggcaggggaattatattaacagggttttatataattcttttgggtcctatgcccatacccacccctgccaggcattggaatctggtgtccccaatttctagttctttctagagttctgttgagttggctcccttctgctcctcagtgttggcgctccccacccagcctgactggctactgtttttcttcaccccaaaatgatagcatctctttgtttctttgtttcggctgattgctttctgcctcccatgcacatgtaagcttatgtttttgcaactcctacactgctcttttagtgagaacggaagagaaaatggagcttaatgtgtgtgattaatctattatagttaattggaagctgatctttcctcaaccttttttccatcaaccttgatataactgttcctatacatcatcttttacatttgtgtaccttactacctttgtttaatatatatatatatatgtgtgtgtgtgtatgtgtatatatatgtgtgtatatatatatatatgtatatatgaatgatatatattcgtaaaactgagaaaactctaacggttagggtttcattcttttctctcctttggattctactcatgtttcccatcatgtagtacttttagtgactgaacattttcatctttatattacagtacgttgctacactataaattattgaatcacatctttaccccagggaatccaaactaattcctgccttatagcgttataaataattttgttttgagaagtttcatgcaaatctttgttggtgtttttagctcgctttctaagttgggattgtccgttttgcaaagtgagtattttgacagaatctgactcatactgtgataaggaatatgatagatgtcaaattacctctcaataaatacttttgtcagtatgtaatccaaacatccagagactactcatgggatgtttgccaacatttagaattatccctgttgtaaaatctactaatttgataagaggaaatgataccacatactgacttgaattttcttttctactcgtgcagatgaacaaaaacacaatgtatttttatgtgtgtgcgtgcatgcatgcatgtgtgtgtgttcatgtgtgcatgattatgtggacatgagcacatgcatgtgtgcatgtgtctatatgcatgtgcttgtgatgcatggatgcacatgtatgtgtgcatacctgtttgtatatgtaggcatatgtgtgcatgtgcatgcccatgtgtatgtgtgtgttgtgtgtgtgtgtgtgcgtgtgtgtgtgtgtgtgtgtgtgtgtgtgtgtgtgtgtgtgttagggtggacagtgtacatgtcacagtagatgtgtggaggtcagaggacaacttcacaagtattggtactcatcttgctacttgtttgtgacagatattcacactctgtgggccaggctagtgcgagctttcactgtttttcttgccactgcctccggaataaagggatgggctactagagtggtccagctttattacttctgagactccagattctgttcctcacacatgtgtgagcagtgttttatgccctgagccatcactccagttctcataccagtgtattttagaaatgtcctctaaagtttcttttcctcaatactttataacttccatcatgtttataagttctttctaaaaggaaatcatactctacttgctaattattataaagtctattttcctagtttttatttgcttcagattttttgatgtctctgatgaataattttaacttttatgttgtccataataaaagtactttgtattttcctttgcttcttgtttttaaaatttatttctgtatcccttaaagggtaaatatcctcatagattttttttctccattaaatgatttttaaaattcttctttatgttcagctctttattctttgtatttgtatgctggctgataaactaattaatatttggtcctcaattcactctttttcagatgattacacaaggataattctagcccagtattcctctgctctcttgaagtgggtttcttcttattaggccctgttcctccttgactgttcttggcatcattactttctctgttcttatcttagcagaggattctttgaataactacaactttacagggcatttgatgcttacaagaaggatcctttctccttatgcttcactgggacagaagtatcgtcctcagcatctcctttcaggtgacctttagaattatctgaaaaattccagaagattctttggtcacgtggcaagcactgtacagattattgttatgtgtgtgagaatttccatctggttgagtggagtcttcacattcagggtcattgtaggggcatgtctctttacttttctaaagttccttttatgccccttagtagtttttggggtctctttgtctggtcctcacctgtctcctttaaagctgcttgcgatgtatttgccactattgtgatttaatttatttcctgttaggatctgcaagtggctactgctgctacaggagaaagctcttgtgtttgcctgtttatttttaaagctcttatcttactggattctgtccacaactcttgaggtctttgggtaggaggactgggatttctcagtattcacaacccaatgggccaaacacaaaatgtacttttatctcctgcatttttttattacatttcttcctcatcttttcttgcctccctccctgttttaattccattgcttagaattgtaaatctatgcgaatgctattggcataaccttgttgtgttcaagaatttaattgaaatgcatgacttgtctgactcctgtgcttggtcttgtcctttggtttcctatggacacggtggtattccaaggttgttgttttctcattctagaatgctcatttctttaaagcctagactatggaaatatttctttttccccaaagcctcttttgcagcaataggttggacattgtttctcttactgtgttcctgctaaaattgtccaacatagaaattcatattaactttgcaaacagtcttcacattcctagaataagtatgatgactacccatatactcctttttcacactgtgataaatttactttaattcaggaatcattgtttgtatacataaccataagtcagtttgttcaatggtttcatattttatttcatataaaattaccaagcttgttaaaggagagaaaagaaaagaaagaaaaaaaaaagaaaaggaaatgagcgtagctctgaaacagcgtgtaaaggcgtgtgttgaaaggccaccgtccgctgctcagcttctctgcgccaagcccactctcataggccatccgtttctatttctgtttgttctgagggctgtctctgcatgtgtaaataatttgcttaaagtgcttttcttgacttgttgatttaaggcgtctatgactttctgggaagagaaagggatttgttcttttcagtcactctctgcctcccattgtattgagatttcacattctctgcctcggcctggcaatcttttctttcacattcacatggtatttttaacctggtctaggaacgggtgtgttctgagactgggaagaagccattggtggccacctctgcttgtctccttcctttctgttgcttgcttaacgcttgtggtcagtgtttgcaatttctagatgtttccttgtaattcttcttgtcattcatgactgactagtctcctggttctgaaagtggagtattcataagtccctcttacatcattattcctgggtaggtactctgcagtgtgctaggaccctgacttgccctcttctggattcagatgtactttcagtatttctcaagggagcctgctcctcacttcaggttcaatggctgctcttttgtccaaagcctatgatttccttttataatactctctgaactattgctaatcatctttgatacccactccactcacagctttatcccatggaattagatttgcctctcaccttttcttatgatcccagagctatctgtcttaccaattgaatcattgcaagacactctttgtggttgccatttgacacatgtattttttacatgttagctttagtgacctgagacggacaagggaagtgttttttgttttgcttttgtttgtatgtgtttcctgtcacccttaagcccagaagcatttctgctttcagacgcttgtttagaggcttgaaaaaaccctagtattagttttgtttctacatctcaggctggccttgagctaataatcttcctgcctcaatgtcccaagtagtgggatttagacatgatacatccctgtgtctctttgtaaaacaccttagtactaaagtgatagaagcccaataaataggtatttcaattaaacaattatcaagtaaatgactaagaaagtttacatgggaagtaaattctttaagattatattgctccaaatatttgaattagatttgcttatttgaggggtatataaattttttttatgattttttaaacttaccaagcagaatgggttttatagccccctgcctgcttttcgaactaagttctcttgtagcttaggcttgctgttacagtttgtgtatgctaggcccagggagtggctgtaagccagcaccaattaaatgttgtcattataagagttgccttggtcatggtgtctgttcacagcagtaaaaccctaactaagacactggcttcagagctgctatgttgtcaaggatgatagtgaactcctggtccttctgtatctaaatcccaagtgctgggatgcctgttatgactctcacctttcattataacacgttgatgtctatctgcttaagtggatgaatgcttgctccttcgtctccccatccttgcacatgccagtccctcacacttacactttttattctcctttctcccagctggttcctcatttgtttttgctggtatattgatcaatcaagaggtatattttatatgtgagaaaaattgcacgattctaccttaccctcccctccattacccttggtgtttctctcttccctttgtccccttcctccctctcacgatcactagacttctactttcatatccaccacccctaccctgaatgcaccccatgtaaaggtcagagggcatcttgtaggcgttgattctcccctttcatcacgtgagtttgacaagccaagcccaggcttagcaacaagtgcctttgtctaggctaccgtctccttgcctcttctactatcttagtcttttgaggcagggctttttgatcaaacccagagctaacctatatgaccaaatttctctggtgatattttttgtatccaaacaccaatcctttttcctgctaagcaagattctgagatactgtcatagtcttgaaactctcttatctttaattcatctcttgacagacatctacactggttctatatatcagccactgtaaatattgtagtaatacatatggatgtgcaagtatctatgtagcatacctagttagatgcctttagttttataacaaatagtatactatattgacagatagctatatcacatggtagtcctggttacagatttcagcagacaatctggaccttttgtcacagtggttatactagtgcatccacccaccccactgggtgagactccaatttctttatatgctccccagcttttcatttgttctattgatgatgaaaactattctgactggtgtatactggaatttcagtgacgtttgaatttgcattttctctgatggaaaggtgtgttaaacaaaccttcataagtttattggcttattgtcttcagtcttttgagaactgtctattagttgatttgccaatttattgttggatgatacatgggtagttttgtgtgtgtatttgtcttggtgcttaatattttcagcagttctttatggagcctagatattaattttccatcagaagttatatgctgtatctcacctatttattgcatttatggaacaatctttatattcctgtaatgaaaccaacttgatcttggtgtatgtccatgaattagtttcctaagatttaaaaaatattttatttttctgtataatacatcctaatagcagcctctccttccttccctcctctcagcaccccctacctcctcccccagatccactgctcctctgtttacccttcagaaaagagcagacctcccaatgatatcaactgaactcagatacaagaacaagatacagtacacctagatatagtccctcatatcaaggctgggctgggcaatcctgaatgcagcaggaggtttctggatagtattactcagctgttagggaaagaatgacatcatgaaatttgcaggaaaatggatggaactagaaaaaaattatcctgagtaaggcaactcagacctagaagggcaaacatggtatggtttctaagtattttactgagagtgttgtttctacattcatcaaggtaataggtccataggtttctttgttgttgttgtcgtcattgttgttgtgttcttactgggatttttatcagagtaatattggcttcatagaatgcctctgttagtgttttatctctttctaattcatggaatcaagaaatctgagaagcactggtgctagcttctttcaaagcttgaggaaattttggcagtcaatcttggacctttctttgtcacaagctattactgctttaatcctatttcttattatggatctacttcattcatatatatatatatatatatatatatatatatatatatcctcttgaattaagtttggtaggtttaatgtgcctaggaatttattaatttcttttggatttcccagtttccaaaactataaattttcaaaggattccatgatgatacttggatttcatcagcatatttctgcaacatttccctttaaatccttaattttatttatttgagtatcccctgtttcttttgcttagtttggctaatggtgtgtcaatcttacttaatttctcaaagagccaaagcctttgcttcattgcctctgtgtttttctttcagtctgcacttcattaatttccgctctgatcgttattacttctttctccccactgctttgggcttcctcttgtttttgtttttctaagaccttgaggtccataattaagttatttatttgaactctccatgattgctttcatatgggcccatatagctcttagcatccctcttacagctccccttgctggttcctcagaagctctgctcagtgatgtttccatttccccttgattttggaatttttaaatctcttctttaatttcctcactggtgtacagtcaagagtatactgctcatctgctcactctttcatggcttctcttgctattgatttgtagtttcatcccctttgattgaacaagatataagaaattactttgattcatttgttcttattcagagttgctgtattccttagaatgtgatacattttagagaaagttccatgggatgctgagaggaatgtccattcctcagttgctggattgaatgttctgtagatgtctgttaagtccttttgaactatgctgctattaaactttgatatttctttgctggttttatttatttatttatttatttatttatttttactagttgacccacttattaattaaagtatgatactgaagccactccacattattatatcaggacccctatttgtctctacataaccattagtgtttggtttatagaattgggatccccaatatttggcatatatttatttgcaatcattatatacattactgatacatcattctcattgtgtagtgttattttgaatgtagttatcttttgagtaattttggtttgatgcctccttcagatatcagaacagctacataaggttagtttgggctttcatgtgtttagtacattgacttctgcctttccaccctcattctgtatggtctttgccagtgatggctgtttcttggagacaacaggtatttgcatcttattgattaatccaatcagctgatctccatcttttacttggagagttaagaccttttatgtttaggggttgttattgacagagttttggtcagtcttgcttttgtgttggctgcattaggttagatacgatttgttctcttacttctctattcatgtgtaatttttttataccttactattctgggcatgatgactttatcctatttttcatttattcatccattatcatgaaatgttgtagtgggttggtctgatgctgcttatattctaatgctatatactggttatttaaaatgttgtctctgctgcccctgactcaaggtgataggatgtgaactttctgcccaatttaactggtcagtaaaaggctagaacctgtgattgggcagtggagggaggaaggtgggactggaggttcaagggagtggggtgcggggagaaagagggagaggaagcctgaggagcaggaagctgagatggaccagaatcacgtggtcaggagaaacagcaagtaacgacggactttatagctgggaaataagttagtatagccctacatctgcccaatctaggcttatggcttataaataaaatacctagattgtgtgtctttatatgtgcttgttaagattataaaatctttctataaaagtgtactttcttatactcttatgacagaggatttcttctttttccacgttttgggtgtctttaagtatcttctaccttgctatacatttctgtactttctatttgtcttggaatgtctttattttctccacagatttaaaagacaactttcttgtggatagtcttggttgagggcttacttacctccaaggctttaaatacattattccatgctttcttgactttcaggcttctgttgtaaggtctcatgttattctgatgtgcttccttttgtaagtgagtaaaagcattttttcttacgctgtttattgtgtttgtagttttgacatcttgactacagtgtgtcagggagaggtcttttgtggctgtgcctgtttggacttctttgtttcttgcaccttgttgtccatttcccccttagaatcataatttttcctgttagagtttcctggatatattttctacatttttagctttccaactcggctcctactccatgtattcataggcttggattctttatcacattctcgtgttctcgggtactgtggtcatggtcatctgtttattgttcattactgatctctgttataattgcttttctcttgatgtggtaaataccatgaccaaaacactcagggagaaaggggtcattttttccctacagattagagtttatcatttagggaagccagggcagacagaagctcaagcaggatctgcaggcaggcactgtagtggccagcatggaggaaggccacttgttggtttctttcccagcttgctcagcggcctttctcaaacaccccaggcccacctgcccaggaatgtctgtgtccacaaggctctctcgtgtatcaataaaataagcaatgatgaagacacccccacaaatacatcctcagtccagacttgtaaaagaaagttgtcagttgatattctctcttctcaggcgtgtgtagatttgtatcaagaacgaaccagaataaaagctcgtggtgcagaatttattgcttttgtcctgggtgagagggagaaagtatgtatttcagagcacagagatgaatgttaacgtaatcacttgtattttttaaaaaaatcagtattatctaatagtacactggcttcaacttatcttatttgtggttgtgtatatgcgcatacccgcagcatatgttatatatgcctgcagcatatgctatatacctgcagaggccagaaggctctgaatccctttggagctggagtttccggtggcttggagccacctgacatgggtgctgggacctaattctggttccttacgagagtcacaagagctttcaacatgtactccatttcctggccctacactggttttgaaagcccttcccttttcggagtcaacagttgattaagcttactgttttattccttagttgtctcttctttctctgcttaaatatgaaaaagaacgaatcctcactcccagatctacccaaacattggcatccttaattccatatcttttttatgaggacaaaggcctttgatggggagtaccaagttcctgtgaaaggtgtgagggtacttcttaacgcacaaggtccatccccaagatgacttcttgtgagcagtggaccttacataagattctaagtacagagttcctgtggtcctcacttcctggggaagcacagccttggcctccttctgtttctgtaacagtaatggatgatgtggttcctaggattttatgaagtgctaatgtagcataatcccgtgaatcagaaaatgacatttattattatatagtaacagatcattcattcacagccaaaattattgcaaacttattcttcatctaaaatgtgaaagctcgcacagcaatttacatagattaagtatgaagtagttttattgttgcagaaaaactttgagtttagtactgtatttattattaccccaaattatatgtgaaaacacatttcagaaattcaggttgagctctttaatagaatcctcaccagagacttctcaaagcatagaataaagaactcccaaataagaaaacataagtaaataaaatttaccctaagatctaaacaaaggaaataaataaatgtgaaatttaaacaccagtaagtaaggaaagaaactaagaataatgtagtaaggtggagagatgagtgaaggtttttaactcctcattcctgaatcctaagatttcttcctactgcagtggtcttcaacctgtgggtcatgatccctttggaggtcaaacaaagcctctccaggggtcacccaagaccatcagaaaacacagatatttatattatgattacattatgtaatagtagtgaacttacagtaatgaagaaacaacaaagtgattttatggttgagagtcagcacaacatgaagtactatatgtattaaatgtcacagcattaggaagggtgagaaccactgacttagaggaaaccaaattcaccgaatacttatctttcccctcatctgattgaaaatacaaaaaatggcataggttgtgggaagtataactataaaaagtgaagttaggctatatagacagttaactttctttaatttagccaaatgttcaaggatgtctattagattggataaatatataaaagtaggggctacttcattatagaagaataaatatgtacaaataggtgcagttaatctgaatgctgaatatttgttgcacagactctaggaagaaacaattgataccttgtattccaacaattaaatgtcacctcgctggactttcctttcttacaattccatcaggtctcaggaatcaggcagcacaatatatatttagacacacacacacacacacacacgcacacacacacacacacacacacacacacttttcaagcagctttgaggaaaaaaaaaacaaattgttccctaatttagtggcagtggagtcagtcactccccatgtgactgacttcccataccataaaaataaaatcaaaagtttggctggaaccacacaagcagagtcatgtggtcagaaggagagaaaggccatgacaacataagagcacaccacaaaccaaaacagcagcacagcgaggccaggaaagagagagaaaaacacggaagcaggtgagcaggggtagctctgccagagcggtgattttaacctagaaagacataatacattgaggctgggaagtaaaagattcacagccactttgctctattaaacagcgctgaataaacaggttgataaagcccaaggatgaagctgcaaacggacagaatgagattaatagggacaaagattgtgcattagcaggagtacagataccacaagtaaattcacggcagtaaaaactaaaaattaagagagaacaggaaagacacacgtctgggggaacagcagagtggagggtctggacaggtctaagaatgccaagggagaagagatgaggtgactgaggggtaaataagatgatgaggaagaaagaaggcttagtccatgcatgcacatatgacatctacatcatgctgatgccatgaatgctgtctgtgtacacacacacagctaacattgtattcattcaaatacattatagcaaaatattgattaagccaaacttgtttgttgggttgtctaggcagcagacatattttagaggttttcctgtacttaagttttcacagcagttcgaggccaatataattaatatttctgacttgccgattaaggagttaggcacagctaagtgccttagctagggtaatgtagcaagtatagacagcagaactgggattcagaaaagtggaactcactactcagcttgtaatcggaaaagaaattcctaaagtaaccaagtttcccaatgttgttttaaaacaaaatcccaaatgttcaatttaccaaatgaagactcgggagtcagaagctgtggtgaaaatcacacacagagggagagaaagcacccatctgaccttcctactccactgatgtaaataccttttaactcaaagtccctcctttctctctcctgggttttcttctgttcactccctgtcaactggttgcttgctccacctcttgacccatcattgactttatttagctcttgtttacagaaacaattaaaggtgtgtgctaaggctgagccactggactggctgggttttgtgtgtcagcttgaaacaagctggagttatcacagagaaaggagcctcctttgaggaaataatcccatgacatctagctttaaggcattttctcaattagtgatcaagggtgggtagtgccatgactgggctcgtagtcctgggttctataagaaagtaagctgagcaagctaagggaagcaatctaataaacagcatcccttcaaggcttctgcatcagttcctgccttcaggttccttccctgtgtgaattccagttctgatttcctttggtgatgaacagcaatgttgaagtgtaaatggaataaaccctttcctctccaacttgcttcttggtcatgatgttttgtgcaggaatggaaaccctaactaaaacagccatactacaactacttgtttacagtaaacacaaagctctgggatgaaggtgtgtgctagggctgagccacaccacaaggtttttctagttcacaatcttggaattcacaatgggatcaaatatcctgcaacattccaaaatgaagaaagtctgttgccagcagtcacactattgtattcactcattggcaatgaattagaggaccagcctctttccatcttcccaacaattaatttttgtctttaacaatatgattttacttagaagaaaaatagagactacagtcaggcattggttacactgtttgggtggtgacacgtgaatgctcagagctcactgatcagtcagcttagacaaaattgtgagctgccagtcagtgggagagcccatctcaaggcaataagatgcggaataataaaggaaggcatccaatctcctgatctggcttctgcatactcacacttggatgtacacaactgtacactcacatatgtatgccacacacacacacacacacaagatatatagagaatacgaagatactaagaaacagaatatagattattagttaccagacttgggaaggaagaatgtaaacttgatgcttagtggtcacagaatttctcttttgaggggttgaagatattttggaaatagactatcctgaaagcggcacaggacagcagtgttgcagaatccttcacttgaacttaattaagatggtaaattttatgttataatttttagaagaataataagaaaatatacactagaaaacattggtcctgaatgctgtctaggcagtgaggcacagcctgcttaagttgttaaaccctgggataaagagttggattttttttctagacacaaaacattctgtataaaaagagaggtatgtggtggggagtgtcagctggtttcagaaatctttaaggcaccatttggtcttagaagatagatgttacctaaaagatttgaaagaaagaaaacacagttcaagagtatcacagaatagaaggctgagaggtaattgtcttcacgggtaaatgtatttgagtactataaaatgcagggcatcttgaaaaagataaattaatcacaagtccaactaattaagagtgagtaaaaataaagattaatggatgcagagctcagggttcaaggattgaaggtttggagtgaatctatataaatatggaactaagtgtgattaaattttgcagttgcagttatagatcaggaatgaaggttatatacccaatcactagaacataagtagccgttggtacccaacactcatcagtttggaggaaacttagaggaagagggaaaataatgcgaacacccttcacatcatggagccatgaacagtctctaaaattaaaacaaatagctaagaatacattgttccttcaagttctcagtgtctgttcacactctgttctcaaacgtgagtaaatcttttgcttaaggcacatccacaggtctacatttctttcagtcctatttctgtttcccttttcttgtgtccaaacaaagaggatatttatcccatgtttgttatttatttatttttattcttttgccatctaccatgcatctatctatctctgtatatatcagaagatatttaagatgatttttgccatatgttaatgatagttatttctggatggtgagactgggaaaattttttttgtaacttgaattttgtacttctttgcattttttgagttcttcaaaatgaatatgtatcatttttcacaataacaataaagtgatctttctttaaaaataaaaagtcaaagcaaatatgtcaagatgttcacagtggtttaatcctagttggtagaactgtgggtgtttatgattttattctttgtagttttcctattttctgacagttttaatttattaaaatgtacaaagaattaagagagggaaaaaagtgaagtgcaaacagactcatgctaagttatacagtcagcgagtgttgaaactgtgattcaaacataaattcaggcaaattgagatgggttagctgggacacttgccaaagtagaaagcagcaatggagacctactgtcgtggaagtcttcctgatggagctacaatccctttgtagaagaggccagtgcttcagtggtgggtgaattacttctatctaagactcaacttttgattaaaatactgaaaggccatggaggggtctggacacccctgccctgtagactgtatatttgactgatggaggtctgctggcaacagatgttgtttcatagacatagataggctttggctctggcagctacttttgaggctctccgttgccttcctgtgtatgagtaggactgaatgtattcttatccttaaatgaactaagtcaggatccaaatccagaacagacccaggagacttgatacatgggtgtttaattcaggcttccatgcacttatagctggccagggtcttcaacttgctctctagttcagaatcatttcagcataccggtggatcaggttctgctcctactctctcttttgcttataaggacattgtgtgccagtacagtagttgaatagtgacccctttctctgagatatatgcaatctgtaacctctggaacttgtccctgtgacctaacttggtgaatggtctttgcaaatataagtaagttaaagatcttcaaatgagattatctagaatttagagagggctctacattctttgtaagtgaaaggcaggggaaggtttgaaacagagtggcagaaagaagacaaaaataatacaggggcagagagtgaaaggtgtaactgctcagagcaccagtacccaccagaagctggcaaagaccaggcaggtttcatcgatggagcctctggaggctcctgtagacagaccatgagttcagacgatgaccttcaaaacagtgagaagataaatttctgttgtcttaaatccaagctatgtgaattttctatgacagcctttggaatgccagtttcctgcttgggttggtaagagaagtcctcaaagttgaggcttctgacttaacactagatctcaggtctggggaagtagcttagttataaagttcttatattatgaacatgaagtagaacatgcctctgatcccagcaatggactagatgctctcaactgaggctagatgctctcaactgaggctagatgatctcaagcccatagcacggcctaggctaggctgagttatatgaaaaaggaaatttgaattaaaaacctaatcatagaaacagcagcagcagtgaagggggaagaggaagaaaatataactaactgcacaacatcaagcctgcaaaaatagcagcatgggtgagggagaggctcatgaagttctgcccctagatgagaagctgttagcaattcatggctgttggggaaagtagagtccattttctacagggatgtggtcccggagaggctacccatgctccagtagatggtgtatacagataatactatatggacccatgaaggtaaaatgtggggacagtgggggaagaattggaggggagctggtggggatggattttgatctgagcaccataaatgcatctataaagttctcaaagaaatatataggcctcttggctctgtctcactgcttccttacctaaaggccaggaatggagaagtagccatgttgatttagggccacctggcaggaggatgctggctgtgtcctcttggccataggtctttccttcctcaataatgctcacttccactgtccagccccagagcagatttgggatccaatagaaggatgaggaattgggaagtaacagtgacactatctcctgcctgagcttggccttagcccctaactgattttttctacatcaagtcactttctccagtaacatgactgacctccccgctgggccctacatattgctaattgcttttttttttttggttttggttttttgagacagggtttctctgtatagccctggctgtcctggaactcactttgtagaccaggctggcctcaaactcagaaatctgcctgcctctgcctcctgagtgctgggattaaaggtgtgtgccaccatgcccggctgctaattgctacccaacccttcagatctttcatgagccagaagacatcgagtcctaaaactgttcttccctgttcctcagactgggggttgcaatcagattccaccagtaagagctttggaaggcagaagacccagaatgtagctaagggtacctgtctgtgtcaggagtcagcagacatatatctttgcttcttgttttctgactttcctggcagtcacccaaacagaccaagttggttttcctgtgacacctgtacataggggtttcttttgtaaggttttcctgactgtcagtctaaaggtcagagtaattctatgaaaaacccagtgttggggatatctagagtggcttctctttttccaacaggatttcacagagatctgaaattactgaaaatgacttgatgtagaaaaatcagttaggggctaaggccaaagtcattgttacttcccaattccttattcttccattggatcccaaatctgctctgccacttctcagttctctcatgcatctgtcagctcccaatggaatggcactttttttttgtccatgtccttggccttcatttcctcatacactagtcaggcaaggttagtaaatgattttggaatggcttgtgtggtgttcccctataatgcagaagtagggtggaggtgggtgctcatcaggacaattttttggcaattagcactagggctagcagctttgggagtatcaaggagctgatggaggtgaaatagacagtaatccagactgaggaatatatcacaccgacacctccatcaatctttgagtagagtactgtgaaaatggcacaccttgattgaggctacagtctgcagctataagacagtccttagagaaaatgacagctgaagactgtgtgatgaaatgtcccagcagctgcagcaacaagacttcctctcaaggaagtcctttaaagtacattgtgaggctcacttttccatttagcttaagaaacactcatggatagagaatattgtatgttcctgcatcactcattctacatgatgcttgctcatgaacacttgatggtcacaaagatgagttgctgaatgaatgagtggtcaagggggatgaattcatatacagtatgagagggactgaagccctcatgagcagaatttctacacaagtgacaagtttggcaggcacccattgtctgtgatgaaaggactattttaatccttggtgcaggtaataaagtgaatgtcataaaatatcaggagtggataagaaattgggtccaccattttggtcataaacagtagaaacagagggcacggggctcagaaattctactctggatgctaggagcccatgatagagattagcctgaagagcctttgggaattctagtcatcttcatgtccccatgaaatctcccatgaatacagcaacaaatgaaaaaggccatagtgatagaatcaagtaagttacataacccatagatggaatctggaagaattgtcccccgttctatgactaattggagtagtcacttagtcactcgttctgtcaaacgaactgtacatggggcttcagttcttctctgccccttgagtagaggacagaagctcgtctaaaatgggacagacattcttttctaggaaacaatccctccagagaatctcaaacttttatacttttctcaaactctttcctgttgcttgaggcaaaaacctcacaattccaaggcacaaattagcagggtaattgtggcagtctgctgcttcttggaaggtgtagttttcacaagtagagtgctagaggtgggctggtaggaatgtttatgagtgtgggggttttatgtatgccatctgttcttggtgtcagaaccagagggtaggagtaagagaggatctaactatcccccttttgcaatctcatcatagttaataataataataataatggtgagttcttatgaagaactcagcatctgcccagaactgttctaagtcaggggtcagcaagctgtggttcatgctctgttttgccagctttaattttgcagagccttagagaagcacacctgtgaaggttagtctgcattgccactttccctgcattttaaatcacctgggagacacatctctggacaccagtaaaaggtgtagctaaggagagaagacctaccctaaaataagtggtaccatcccatggtctgtgatcctaggttgaataaaacagggaaagccaactgaatgccagcattaatctctttaatttcagatgatgagcacagttatgaccagacatcacatgctcatgcctgcattatgaactgtatcccatcaaactgtaagcagaagtaaaaacctttgtgcatcaagttgtcttttgtcgagtatttagttacagcaatgaggagtgtaacgaatacagcagctcatctatttatttatctgttgtctgtcatggctgtcagatttcactgctgctacagaggagctctgacaaggactttatgtcctgcaaaacctgaaatcctgacccttgaaccttttgtgtgaggtgtttgtcaactttttctatgagttgtttcatatattaattctataatccttatgatatggtcattgtattatcatgactttaaagactgggaacaaagagaaagatggaaatgtttgaggatgtggcagagaaaggactcgactgcctaaatctgactccagagcctgaatcttaaccactgtgctatgttcacagttacccatgaggtaagagaatctatggtgcaccatgaactagggtgtgagatgcatgtgtctatctgctttctaggagaacatccaaaaagaaaatctgggagacagattgtgagcttgctctccttatctcttacaagtacaagagtcactgatctttgttgtttaggaaaggtcgagggagctggggaaatggctcagtctctaaagtgcttcccacacaggcatgaaaactttcagttccctaaacacatgtgcaaaagctgagtgtggaggcacacacttataattgttgtgctggggagacagagataggcagcttcagcatccagctatcctagcctaattggcaaacctatgatcagttagcaacctgtcaaaaacttgatggatgacacctgtagaagaacaaaactggaggtaaacctgtggtctctacatctatgtgtgcacacacatacccctctgtctctgtctctgtctctgtctttctctttctgtctctctctaacccttctgtctccttgtctgtctctttctttctctctcccatctcaaagaatgtgctaagatttaaaaaatgtattcacagccatatgatttattttataaaagtgatgccaagtcacaaatgcacaggcacagataatgcaccattcacagatcctgcctggggaaataatgactgtgtggtacttcagagcactgaaagatgagctaaaaatcaagaactaaaaatgggcaaatcataggataaaaaggctggtgagtctccctgggggttgtctacagggaccccattcaacttactccaaagatcccgaggagaattgtcatctccgcaaagtgactctgattaagtgtcttggctgttttgttcatagctgtattaccagggcctacaaaactgcctggtatatctaaggagcatggtctacatttgccatagaaaataccttgtcaccagtgagctgacagcccaatggaagggagaagatgcctgcttccccccagtggcacatgggtataacttcagtgcaaaggagacctccataaactgttactcctcattaagcttcttcttctggacaagtttactaactgcaatcacaagcccaattaaatgccaggagtctggagaaagcacctacctgtgccagaaagcaagactagaaggatgcacctaaagagagtgtgtgattgccttctttttttttaaccccacctaactgatttttttcttgtattccttaggtataacttcataattaaaacaatttcccatgcctcctctgaatctaatgttaattcatctccacagaagccatgaggacttccagatacatttttggtggaatgagcacagtagttcattaagggttgaattttccttccccgagttccatatgttgaaatctgaactcccagtaggccatgtgagcttgttgggaaatagtgattgtatatgtaactcattaagattagactgtattgataaaggatagacactgactgacttttacatatagaaaggaaaggaaaatttgggcacacaggggaaaatgccaggtgcatctgaatgtatggaccaggtcatgtgtttataaagcaagaacaccaaagatctttgaaagtgttaggaatcagaaatggggctgtgttagaatagatcccctgccagagtcctggaaaagaaatagccccaaagatatgtagatctcaggcttccagccttcagactctgagacaatcagtttctgtttacttcccctcagaagctttattgtggattcatagaaaggaatccagaacccttcactcagttcagttcagtgtgatagttgcctcatcaatctcatttcttcatccttctctattctgtctttccatttaggatctggtactgccatggagcctggatggagccactggctcattcaaatatctttagtaatttgaagcatacagttcattggggctgcctagaatgcagcagacatcagcaagggtaagagtagctggaaacattagctgaagtgaagaccttgaagaacaatagagggtatagggatttaactgtaagcactccagttgacaaaagtagagtaatggtgatggcctcgaggaccaaggaactgtctgtatctgtgagttgtcccttctcccctctattcttctgatacatgacatagccatagtgccttctcattgagaagggcctgactagaccataggttagtgatttagtagtcctggaagagtcctttgaagagtggtttctgaacgaaaaaaaaaaaagatataaaaggaagagaaaggaacatgatggtcatgaatgttagcaccaaatgaaagaaagaaagaaaaaatgaaggaagaaagaaaggagggaggaaggaaagagaaagaaagaaagaaagaaagaaagaaagaaagaaaggaagaaagaaagagagacagaaagagagagagagagagaaagaaagagggagggagggaagaaagaaagaaaaaagaaagaatgaggaagaaagataggaagaaagaaagaaagaaaggaaggaaggagagaaagggaggaaagaaaagaagaaaggagagaaagggggaaagaaaagaagaaaggatagaaagggaggaaagaaaagaagaaagaaaggagagaaagggaggaaggaaagaaatgaagaaagaaatggagagagagaaagaaagaaaggaaggaaggaaggaagaaatagagaaaaagaagaaagagataagaaagaaaggaaaggaaactcttctcaaggataaaagaacctctggtggaatcaccatgcctgacctaaagctgtactacagagcaattgtgataaaaactgcatggtactggtatagtgacagacaagtagaccaatggaatagaattgaagacccagaaatgaacccacacacctacggtcacttgatcttcgacaagggagctaaaaccatccagtggaaaaaagacagcattttcaaatggtgcttgcacaactggcggttatcatgtagaagaatgcgaatctatccattcctatctccttgtactaaggtcaaatctaagaggatcaaggagctccacataaaaccagagacactgaaaattatagaggagaaagtggggaacagcctcgaagatatgggcacaggggaaaaattcctgaatagaacagcaatggcttatgctgtaagatggagaattgacaaatgggacctcataaaactgcaaagcttctgtaaggcaaaagactacatcaataagacaaaaaggccaccaacagattgggaaaggatctttacctatcctaaatcatataggggactaatatccaatatatataaagaacttaagaaggtggactccagaaaatcaaataaccccattaaaaaatggggatccgagctgaacaaagaattctcacctgaggaataccgaatggcagagaagcacctgaaaaaataatcaacatccttaatcatcagggaaatgcaaatcaaaacaaccctgagattccatctcacaccagtcagaattgctaagatcaaaaattcatgtgacagcagatgctggcgaggatgtggagaaagaggaacactcctcccattgttggtgggattgtaagcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagtcagaagctggaaagaacccagatgcccctcaacagaggaatgaatacaaaatgtggtacatttacacaatggagtactactcagctattaaaaagaatgaatttatgaaattcctaggcaaatggatggacctggagggcatcatcctgagtgaggtaacacaatcacaaaagaactcacacaatatgtacttactaatatgtggatattagcccataaacttagtatacctgagatataagatacaatttgcaaaacacatgaaactgaagaagaacgaagaccaaagtgtggacactttgccccttcttagaattgggaacaaaacacccatggatggagttacagagacaaagtttggagctgagagaaaaggatggaccatgtagagactgccatatccagggacccatcccataatcagcttccaaatgaggacactattgcatatactagcaagaatttgctgaaaggaccctgatatagctgtctcttgtgagactatgccggggcctagcaaacacagaagtggatgctcacagtcagctattggacggatctcaaggcccccaatggaggagccagagaaagtacccaaggagctaaagagatctgcaaccctataggtggaacaatgttatgaactaaccagtaccccggagctcttatctctagctgcattatatatcaaaagatggcctagtcggccatcactggaaagagaggcccattggacatgcaaactttatatgccccagtacaggggaacaccagggccaaaaagtgggaatgggtgggtaggagagtggggggagagggtatgggagacttttgggatagcattggaaatgtaattgaggaaaataccttataaaaattaaaaaaaaatttaaaaaaaggaaaggaaagacacgattgttcccaggtatggtggaggaggatgtttattatagataaagtagagcacatagataggagcatggtcagagacatctgaaagaatccagtttagacatgtccatactgagctgggccatgttgggagagggaggaggaacaaggagaggagacaggggtaaaccaggtgcatcagccagaaggcctgaaggtaaaaagagagtgcgtaaccaaaaggttatattatatgaggaaaggcagcctaaaaccctgggctggagagttcagggtaggggacaggatatgccagtcaggagctccctataatacctaggggctgagggatgcagggagaatctagagttcaagtctgctttgatgtattaaataagtaccttggttattagtcctagatttgaaacataagagttttgtcattcactatgctgggaagtggtggcacatgcctttaatcccagcacttgagaggcagaggcaggtaaatttctgagtttgaggccagcctgatctacagaatgagttccagggcaaccagttctatacagagaaaccctgtctcaaaaaaaaaaaaaaaaaaaaaaagaaagaaagaaagaaagaaagaaagaaagaaagaaagaaagaaaaaaaaagaaagaaagaaagaaaagaaaggaaagataacagtttctaaaaaattcatgttgttaagtataaagaacatagactctgaataccttatctcatgatgggaaagtagagaacaccagagaacatatctggctttagctactgtattcttctgggtcacccacaggctaaggatatggttctcaaaactgaatgtatgtcagtatttcctggagcaacttctgagcccatggttggacactcattcccattatagagttttggcttagtctagttagggcctgaaggtttgcatttataatgaattctagtgatgttattgtaggtgctcagggaccgtagtcggggacccatgggcaaataaacatgctctttaggggtcagttgggaaggatattcatggcttcatagtatctcctaggactcttgactgtataaacagtgagaaaagataagacttgcttactctgcataggatcaattagcttatgtttgacactcataggatagctcagagattcttatactgaccatgaaagtgtagtagttaatattgaatctttataatacattcagtttttataaaagaataagtaatataggtgttactattaccttcatcccctccattttacagataaataaactgagggaagaaattatggagcttgaggaaattgccaaaggagatctagctgggagatggtagggttgggattggatgtgacaatctaaatctagagtccatactcctttattttccattatttcaataactctgtagaagaaaagaggcaataaatagccctagtaatgttggccaagttatttgtattttctttgctctcattcctctctcaaaaaaggaaatagcttttcccatcttatgtgaaaaaaaatacctttagattgaaaaaaaataagctgtcaggattaattggataacagctgtcaaactcttgtagctccttagaggatggtgaaagaggaggaataattattgtgctattttctatgcagaccctagtacatttgggggagtcaatgaatgtctaatgatatttttggtaattagcaatgatggaagagagaatgttcaggccagagaagaatacttgcagggactaggtagtagagcttttacagttgatgtccagtggtctgagacctcatgctcctgtaagaagtaagtagggtatggctcagggaaaaagggagtcaatccaagctggtaagcctccagtggcccaggaggaaacagaggccaggattacttgttgattttcttaagttcacagactcctggcttgggcaattacagagcagttactgaagtggcttactaagtggggccaaagatcaactacattagcctcacttagaggcttattggaaatgcaaattcttacattcgacccaaactgattacaggtggaacctagcaaactttcatatttccaggtgctctggttacattctataattctggacttgttgttttagaggaaaatagctttgatcttagagtcagatactcagctaagatcaaatattgacactatctctttaggttatgtggctttgggcaacttaccacacctctatgactatgacgttttcaatctataagtcaagaatgtgaatgttataggttaccagtgggtacttcacaaggcagagactcttactttctggctttgcaacagaaaattttatcttcatggaatattgttttctttttacctgtcggacaccttcatcacctcagtctttcgcatatttatttactcaagatggagattgtttttcttctttttatgcctcctccatacacatggctctctcatcataagacctcccatattattgtgattgcttttaattttgttgtggttcccagaaggtgagacattttttcagtacagtctgttgttcctgtgtagtgtcagacagaaagtagctggaggaaaaatatttaaagtttgagaatgttaccaaaattcttgactccagtgagttttatgaggaaactggcagaggattggattaccatgtgggggtaggagtaaaagaatgtagatactagaagtcttctgcaagttatggatgagtaacataagatgggatagtgagctctgatgtttgaggactgagggacagatgctgtgtaattgggacatatataaacagcagaactctatgggctaaaggctcattaattggcgtacacattcacctttaacctttacaatgtggcctgctaactattgagccatcacttgtgttaagaagccctccctagggcttagattataggagaagatcttaaaacttgatcctccaaactagagatagctgttttccctgaagcttactgacaaccatcctgttctgtgtgacaaactcctggccagtgagaaagatcctgttttacaaaaagtagatggcacctgaggaattatgcttaaagaacataagcacacgcgcgcgcgcgcacacacacacacacacacacacacacacacacacacacacatacacacacaccacggaatactcttatctttcatttacttatcacagacaaggttgtagatctctttgggaaatagatggatgcttttcccatgggaaaaacaaacaaaaaccacaacagagagttccctccattgaccttaccaatcactggatacctggccaggttgctttcagtccagtttatgtagtgaatataaaaaacattcactgagaggaaaagtagatagtgacattatatgtctttcccagccctgttattttaaaacttggaaactaagacccaatttagtaaaaggtaaaagtaaggcttcattatttcaacaggctagtcatctctttgttttgttctcccccaccctctgtccatctgtccctccccattctctccccttcccctctttgctttctccctgcttttccatttgtgtcatttcccattgcaacaatatgaagtagtaattcagtgttttctacagagcatagcatagtagaacattctgagtttaattggagcataaatgtaactaatcaaaatattatcatgccaacggatgtgtgaagtgttgggagatttaaatatatatgtgtattttagttccacgtcattttggttttgagtggtagacacaaaggacttagcccagttaatgtcaaaaaacagtttagggtctgacagtgtctcagctaccctgtgttctccactcttcatatggtaacagcttgccagttcattatatttttgccctttcctcccactctttgcccctcttcctacctgtaccagctgtacagaataagaccatataactccagggagtttgggtccattccttggcataaactttaacatgcctatgagtgacatgaagataaaataataatggcagctgtttagatctaaatcccagtgctggtgttaactgtatggccttgagaaactttcactgttcttgtccatttccctttatgtaagaaacagtcatgatagtaagtactttgtaagattgattttagatgagcttatggatgtaagtaaattgggtagtagtatgtgtttgatatagttggtaaagagagaaaagaattcttgaagacacatgcatacatacacacatgcacatgcacatacacgtatacacacttgtgaaaaataccctttcgtcctcaccttcctcagaaggagtccaagacaacagtcaggttagccatgcttccaagtaagccatgtgtcctggctcagcagtgactaatgctttagtttctgagaaggtgtgtgtgtgtgtgtgtgtgtgtgtgtgtgtgtgtgtgtgtgtgttggggtgggctataagcttattaagaggctatatgtatatatatgctttgtatttagctctgtcttgaggacctgatctttctctccttctctcactactgggtctgtgtcctttatttcctgtgttttatttctcctgcctcagatctccttgtctatcttgccatccctcctttccctcttctctcttcttctccttgtctactttgccttttctcctttctttactttgttcccttcttccttatattgtctcagtgaaggtttcttagctttctggtgcttaggagaaagacccaagtgcctatgacccccaagcctggttctgcttgagtcagggtgcagagcatgcattgtagggaccccttcctgtcatatatcaaagccaatcacctcagtgtacttcatttttaaacattatccacacctacatggattatcagataacagttacttagaaaattgccttaacacatttgcatatgaaatgcatgaatcccaactttctggtctgaatggatgaatgcagaaatacttatgacttgttcccacaaacttactgacaaaatgttcacaatgtgcagttcatttgaaatttcaggatctgtttttcttgttttaaatacatatcatgcatcaattaagctgtaattaacaccctccctctattttctggtatattcaaaaagaagccactttctctcctgtttttgacacatggtaattagattgctttcacagataatatgggtaatactgaatgatatgattgttactgtggctattggtttactgttatatttttgatcagcttaatggtgatagttttcacgacaatgccctctacactaagtggttccattacacatgtatcttcacgtttcacggtgcattgtgcctttgatggtttgttacccactcacccccattgctttggaccagacagcttaatatcatcagtgtgaacttttaaatttagtttcatccaaaatagctacagtggactcgtgtactgctgtgtgtagggaccatggtgcccaagtaactgctttctgaccacttgtgacaatcacacagggtaagtgggatttgtggagtttagtggcttgggaagcattcatttgagaaaggacatgacctgagaaaaacccacgggcataggatgcttgggtgttatcctgtttttcttatattgctatgattaaaacactactgtcagaagcagcttcggagaggaatgggcttatttggttcacacctccagtcatagcccatcatcgtggaagtcagaacaggaagtcaagcaggaacttgaagcaaaaatcatggatgatgaacactgcttggtggcttgcttgcttggcagttgccatggagataaggaaaaagataggtgatctgagaagctaagaagcaggttctccaagacctggatgccttatcagctataaagagtaagggtagggcagtgtgtcttactctgttccttagttggttctttgttttctttttttaagggtgtgtatacatacaagtgtatttacgtgcacgtatgtttgagtgcatgtgtatgtgcctacatgcatgtatgtacccatgcatgcatgcatgggtagggcagtttttttattttgttcctaaataggttccttcttgttgttgttaaagtatttatttgtgtgtatgtgtatgcgtgcatgtatgcatgcatgtgtgcgcctctgtgtgtgtatgtgtgtgtgtatgtataggtatagatatgtgaaagccagaggttgtcttcacataacttctcctgttacgttgtacttactttttgaggcagggtctctcactgagcctggggactagctggctggcaaacctttggatcctcaggtttctcttttcccagcgctgggactacaggcatgcacataggtagcagggatccaaactccagtcttcatgcttgcacagcaagcactttattctccactgtagtggtaaatgtctgactccaataagaccatgcatggaaagcacaactcaattaatatgaatataagggagggacagtgaacttttatgtcaggttagttgagttctaattgatatgatggagccaatttgttgtggtaaatgtccaaccccaataagcctgtgaaaggaaaacacactatctatctatatattttttttgcatgcctagactggacagatgcaacactatgctattatactttccgtctatgaaattccttgttacttgcagttcctttaggccaagtgcttttgctccatcttccttccacctcctcctctttcctcctctctctcccttctctcctcctctctttcttctcctctacatccttctctaaaacttccagcttcaccttcccttccactgcccaatcacaggctttagccagtattttacctgttaaaaatagaagtttcagatgaagtcacctgagtatgtgattcactccccatcagaggcagctcctctgggggaagcagaattagcatcaaaatacaaatgggcaccagggcaatccacaacactccactacatccttagcctctaatgcttggctactttttcttcagtctgctaaactttccctgctatatggaaaaaaaatccggggcagtaggaaggctagaaaagaagctaatactgagaacacaagaagccacagtctctgtctgggcacattttaatcagcattttatgtaatccttgtgagtacaatggaaaaagagttttcatggtgattttgaagaagaggaaagcaaagctgggatagtttgagagacctgcttggcatagtccagggaaaagcagtgtagatgcgatttctgtccagcgtgctgatcttataaattcatttagtgtcgatcaagtggcttgttgaaggtcacatgacagtgaagcctgagactctgagttgctaacttcattcctgtttttttgctatgggtgactgctgtttttacttgaatcacacagttctaggcgtttgttcccagattgttctgaaagagggaaagatacctaatgttgcctccaggaagctaagcactcctaggaattttacaggtcatgtgtctctcgggtccacacccaacacagagggtgcacagcctgatctttggcacgcgctcagccaccatgagtcaagcccctaacttttgtctgtgcatcagtaaatattcttgaaaactgggccagcatgatgctgcctcattggaatgctaaatggtgtttagactagtgcctggtatgtagaatgttctctgtgtcactccatacgtcagaaccatctgctgctcacactacttgctgtaaaatccacattctgagtcaagtactatttatcatttaatatttgccaaactacatccatttcaacatcccattttatagatgaggacactgagggctggacactttctcaaaatcacttccctaagaaccaaaagacctggaagggaaaccagctgtagggtaaagatcctggaccctttccactctgctacagctgcttggctctcagcaactcttgggtctctgtctcagtcctctttcccttcataggtcctgtcgcatggagctggcgggctacccgtctgcagggagcactctgtgttcttgttctcagagctacaggccctcatctgccagtcgcccaagcacactcatgtaatcttaatgaacaatgtgcaaagccattaaaaactcaattaggactctctttttactgccgacgtgaggaaatgcaatcctgaggtgctcatgtgtaaacacaatagctgccatctgctactgagaagtgtgctgcctccaaaaaggggatctgtgtggcagacacatcagtaacagggcgcttatcgaggcgttattatgcacggagggggaaatgcagaatttatggccagccagagagtacttcctggttgaattccacgattttcagtgttatgtgtaataactatgaagaaactaacgctgttttatgttccttatcacattggtactttttttttttttgtttaagggcaaaggaaaaggctatatttatagtcttctttcttgttttatgcttgttttttttttttttttttttgactgatctaggcataatcactgactcatttttgatctctaggaaaccgacagccctgggatgatattaattataccaacctgttgatcaaagaaggccccactgagccactgcaaagcagggctctcatgcttgaataatcttagaaatggcaagcctgggatccaatggctctggggctacagctcttacttttatggagggtgtggtcagccatttcatggaggggctactggtatctaatctcataccatcttaagacaccacacccacatttctgattgttgtgaatttctgtccctttgcctttgcacactcccttctgatttgaactgcccagggttgcttctcttattggcatctcagtttaccacatcttacaactttgctttatgctttcaattctttgaataaagggacctgagacatagtaggtgtcttactgaggagcctggataataatgacatggctgtggaaatatctcaaaattcccttggctccataacccaattatagtctatttcttttaaagattccctttgtgtccaaaatgagtgctcctgagatttggagcacctgcaatttagccatggccatcctggattgttcactgtggccttactctctcctggattcttgaaatcctgaacactcagtgcagctgggagacgagaaggggtcagtcattcccatgtatgtatgtatgtgcattattacttgaggctcttgatagaaatgtaggtacagatgctataggaatgtggggggatgagattttcaggtcttctggctcttagatgatgctgaggtgtgaatgaaggatcattaactaggaagagaaggtaatgaaggatgtgggcatgagaaaaagccagttgttaaggactgtacatggaacaggtgcacagcatactccaatggctttgaaactcagtactgtagccactctgaacaatgtagggaaactgggcgttgcctctgtctctgtgtccagaattgtatatgaggcttcattgaataggataaatgcaacattcttggcaggattgctcagctactgaagctaggatgaacagaaatgatggcatgaaccagtggaaggaccacttcctaacattctctgctgtggggtataagaagctgcagatacatgcctaatggtatggcttggcaggtggctaaaaagctgagtatatatagaagccatcatgcaatctgggacagagagagtccagacatttcactactcaggctgtctctcttcctcaagataaactgctgctctcagtggcaaagactgagaaagaccactggcaaagaccactctttgtgagacttgtgagccataagccatctgacaaggagcctgcatgtagactctcaatggcaggcatgggtgttggttcagtcttatctctgagcctcaattccagctcttttttccttgctacctcattggcagcttataatagttaggtaacttctgtaatagggagacatctttccattcaccatcagttactcccaggtcatgaaggaggtttcttcccactcttgacgcctcttgatctacttccactggctggtgaatcaggagctggctgagttttctgaatagtaggtcactgataacctgacctcagtttcttctgtccttgtcatctggcttcctttttgaatcttattaatatgaattcatccaaatgcccccagtggtcatcccagaagaatagttctgtctctagttatctgagttgggttagagattgataacagggctttttatgtttggatgtagagcatgctggaagcccaagttggcatcaagactgttactttctataatccagctttgagggcaattgtataaagattttaaatataatctcccacctgtgtccacttgtaaattagttcagaacccaggagacaaagtgcaaatggcttgtactgtctaaaacccttataagaagtgaacaccccagcccttattaacttacagatcttagtccttttgctatcacagtgtgcaaggtgacttatggctactgaagtggctcattttgtctggggatagggattttatatttgattcagaatgaagattttagtgatcacaataaggtttcaaagcaatgctggtttttctagatggaaaacgcttatgaaagcattatttgagtttatctactgtgttttatgatacattttattcagtattattatacaacttttaagtccctgagtttagccttcccccttgattgtgaaattttgttaggtatcctagctggtgcaggctttgagaggctgcctacagtggtgaggactcactttgtctctgggcatttgatttcactttgcacaaatttcagttgttataaataaaagctgtcgcataaagagcggagatgtgtctcttcatagtgatggatctgaatcttgttcttggaaagctttatcaattagccagtgtcacagcaatgttgtatgaaccactcaggagcaaacccatggcaaacaacagtaaacattgattcttccatgcatggatccttacatcgatcacaggttgactgatacaggttagatgtgttgaccacatgacgatgcatcttgctttcaagggtcgaagcttggctcttttatctgtgtatgttaattcttgatcccaagccaacggagacaccagattctgtgtctcaaaaattaaaataccacaagataagcctagctctaatggcaactttcaacatctgtttgactcctattaacaagtcatataaaggagcccagatcaagagatagcctccggttctacagagggagctataaagtcagtgccaaagggtttggatccagaaaggggtaaagaataagagaggatttctatttgtcacaacagtggtaagaggctcactcctgcctgggacacagccttttgcctgcttagaagcagccatactttctgcaaatagatacctaatattaatatgagtctctgagagcgtagtgagtgccactcactttgcattcctccttacgcatctgatagtaggttctcatacttttttggcatttatttcctcctcggatatgctctattcacgtactgtctcctttaatatggaatcttccctgctgagcgcagaattctagatggagcttgtccatacacaggagcttcctatactatagggattctgcctaggctagcacaagtctaagcttttatgaggcaatcatttcacctgtagagactgcagttgactttcttgctaaggttttaaccctcaaggaccagcatttagttataagcaatctactgtgttggatgctccttgtatagtactagaaatgcttcttgtgtagtaactatctgtctcgttcttccaataccaccatgagtagggattttagcccctgaaatggaagtgctcagactcttagaggggattagaggggatatggcttcttcagagtcaacctgaccctgtcacctaaaaagatgttatttctaacatcccttcttggtaccatgtataggtatgacaaggtttcacaaggacatttttctctctttgtctctgttacccacgatgggtttctagggtccttcatgatggtgaacagctctggaagggcttcaggccagaaagcccatcttcttctgccaaccttgaaggagaatgacactcactgcattgacttccattactacttctccagtcgagatcgctccagcccgggagccttgaatgtctacgtgaaggtgaatggtggaccccaagggaaccctgtctggaacgtatctggcgtcgtcactgagggctgggtgaaggcagagcttgccatcagcaccttctggcctcatttctatcaggtatgccattacctttgcttgctttctagcaggtaataattacatccctttatttccctgcctttcccagagtggattggactaaaaagggcctcattcatttactctttcaacacatactgaagagtcttttccagggatgcagaggtgacctaggacagcccctgcctccctggaggtcatcaggaagagaccagtgtataaataaacagttccagcatagcaacttgcatgtggcttcctaagactggaggaatgcaggcaccagagcctcttacaaactaacaactgcattgcacacatgaaaagattgaggttcaaagcgagaagctgactagtcaggtagagtctatttggctagaaagacaatacaatagcttctaagaagagaggacaaccaggacctatttggaaggctcaattaaaatacactggaaaggttggaccaggcactggagatgctctgtggatgatgcagaaggaagcaagggtgagtgggagattctaaggaatttggaagctaagttccccttttctttttgtttgttttgtatcaagcttttgttactactattgtttgtttgtgtttgaggcagggtcagtatgctctagtccagagtatcctgaaacccacaatgcattccaggttggcctcaaagttatagcaatccttcagtctcagcctcccaagtgctagaacttcagatgtatgtaatcatacccagcagaaaccaagtcctttaaggatgtcttgctgaagagatattgagggaactgaacttgcagagcatgcaagtcatgggtttgaaggccaggctaacaatcagctcctataaccactgtggttcacaactaccactagggaagaagggaccatattctcctaattttttgtggaccaatatttctataagccaaaataaaccatgccattgcaatgccaaacggttgtgtttgctttgaaccccatactcacttgccatacttatcccagtgtggatgatgtgaaaggttgcagatccataccaatctacagaatgtttgtggggtacaaatccagacaggtttaagtcaaaattattgggaaattttctcttaaacacatccttaattaaattccccatgtcatggaatcaacctgtgtttaagtgtgccatccagtgcctttcttaaagtaaagccactgttttctgcattttaccaacatcaaccattgtatattttcatcatccaatgagctctcttgtacctaatctcagcccgcattcaccctgatgaaggttttcaagtaagaaagtaccacaaatctgcatctcaaggagtttttgttagtgtctgaagcagaagataaccccaggggtgacagatgagtggccagggcttcttagatggccctgagttccacacccagtggatagttctttcagtccatcaaggttaggaatgctttctctactgagcttgcttatttacatcaatgaggcagcttcagatctatttcttctttgcttcggagactaaaaatcagaatttaatactcaattaccttcagtacttagcctacatttttttgtcacacctatttcccattttatctccaatgagttgtgatttgtttttagaatgattgcactgtcctctgttaggcacttcctgtaattcctctagaattaaagggaagagaatgatgatgatcctgatgctgatgctaatggtgatgatgatggtgataatggtggtggtgatgatgatgacgatacctaccatttgttgagtgcttacgttacaggcacagtataaaatatcctgtcagaaattcagaggtgagtcaggcagagcctagccttgtggtagtgagtgtggactatactcattttattatcaggcagagccctattctctctgtgggagcagcaatgtcttaccaagaaaattggctaaaaagagactataatagttttaacatgtgtgtcattaacacagaggcatactttattgtagatgttttgagaaaggtgcctttggcctcattatttttttttaatcttttctccccttgtaaagatgtttttaaagttgtatcaggtccacaaacctcgatctggcattcacagtgtcagatatgtttcagagttcacagtatttgcaatttacaaggttataacatttgcatgcactgtgtgctttgtaagtaacacctatcatagaattgcagagccaagcttacagataggctaaccacaaaaattatatatatttacaagatatggtataaattaaggccgtgtatggtatctaaacagctcatttatcaccaatttatcttataaaatactcatatgacatagcttgctccagtgcatgccaggtgtctaggttgccttgggtggggggggggtgtccttctgttttgtaccttcatgggttcatggctgaggtaagatgttcttctttctacttcttgggaagaactcacactagttgttctttgagatgctctttagtgtaggtgaagtgttttaggctttgggaaagctttgtggtatattctatctagaaaatacagccagcctagtagggtacagcctagtagggtactagggagccagaatgaaatctatgcattggtatttaatctactgccttctgtagaaatttgaccttaatctgcttttagcatatccccatcttaacatagaggcagtattctaaagagtggtgtcccagttttctggttcatccgagatagccctgcttcactccgctcatcctggtgagttgttgagcatcatggggaccagttggactgctagattatacagcatctatgtccatagaggtttacagtgtgtatgttggtagaagtggttttggcttatctctattgtgtaccagacaaaaaatgttttactttggtaagcctcaatgtctttgttgtcattacctaactctgcaatagggccatgaaagcagacttcacaatataaaaatgaatagatgtaattctttcaatagaggtttatgtgtagcaatgactgatggcccaagttgatttccatgttctagtttgctgagctcttgtgcggatgaagctgagacacatattagagtcaaacagcacatagcaagttactgacacaacttaagttccctggtccccagggtatccctactttactgctgactatgaacatctgccatctccataagctcacaagtactctcaatgagacctcaggctccagccagaccctttctagagcctgttatgggtagacacaaaatagggtcagggcttgaagtatactaaacaggtaattgacacagaaaatggtctctcccaccatttgctctgctctttgatggagactgaggaagaaaaggacttttgatgagctcccagttctatggccctttggtaagcctcttcctgtatttcacatgtctgtactagagcttcctgtatttggtggcagcagatcccatcttccagcgtaggggacattattggtaaatcaacattcccatcaacctgcccgggttctccagctccgagctccatgtcctgtgttttgaggaagtgcttttcctattcttggaatctgctgctccctagttgtgtgatgacctgtgtcctgccatctattgtttaggattccagtggtctcggatgtaagatagaaagaggaacaggatgggtaccactctatgctaagctagattccacatgaggaggcttgtcgggcttgaattgattggaagaaagaaggagcagacatagaaggaaatggaagaagggatgaagccatctttaaagaaagacactgcatggttttgcctagcctctctagcctctgtgccttttctgaggtaaatagcctcaccgagagacttccaagcagtttcctgcatcctcgcattccctctgctctgagctttgtgatgataaacaacttgtctgttgaggcagcagtgtggaaaaagcacatgtcacttctatgcacacttagtcattcccaggcactcccacgtccatgggcacagtcaagcacacacatatgcccaaattcctgcctctgcccagattcaaatacactcactcataggtgacagaatgagaaaggggacctcccaagagacatagagacaggagcgaaacaggtttttttgcattctccatactttcaagctccagtcctgtgcatagagcctgtggactgagtcaaattcagtttccaacattgctgggttttgaacctcatgggtttgtgtattcatttattaaagccatatttcacagtcctaaaattgactttagctctgtaataaacaaaaatgtcatctttcatatgactgggctttggactgctgggccttcagcaagagccccaggtgagacaaatccctttgcagccctccccactcaccccacattgcctgcctctcttgggaaagctgatttactgcctgggaagccctacacttctgatctatgcctctttccaggtgatatcaattctatttcatattttaggagttcttaacttttctgccctaatattgagggggaaaataaaactgttactaatttttcagccacctacttactcttctctccattttctgcctatgtgaaatggccttttgttcagcacagagaagtgccccatagacccttcaaacgaaggactcacctgatgttggcataagtcttccccagagctcagtccctttctcaggatcttcctggcagttggtactctacatgtagtgttgacagtaacaattcaggagttgttgtcacagcagcatgccctctcttctacccttcgaatctcacccttctgtcccaaatgagatgtccatctctattatatagcaaatgttcttccttctacacaggcctctctgagcgggcatgggaaagaatgcaccttgattgggctctaagcaatcttccctatagtgtctgtagagcactcttcctaagagagactctgataagccaatgtttttctcttatcttttaagacatgtttgcagctctttcagattattgctgtggaccgagtcaaattcagtttccagcattgctgtgttttgcagaagggttgctaaagatcagagagaaaccccatgtctcttaagccatgacctgacttgtttacctccttcccccaaacatgtacagcatgattcatttcttttttagtttaatgtaattctctatgagtctttcctgggagtgacttcgaggttttgactgcacaggggcaagtttgaaccagtctgtataagttccgccctcctgacacttggaccaggaagtctccagcaggggtttagacccaaatgagctgtagttagctgacaataggctctatgcagcaaccttggggctgagcagtgtccttcagaggtgcttgagatacctgggtcagcattttcaactgtgatctttgcatctggggtccctgcttctaccagtgtcctttgcccttctgggcatgtggcccacttcaccaccccagtccacccactcccatcctgctccctggagacattcagctctagaatattctcttgcctttctctatctcttatcacattttcatgaccaaagatagctattatctctgtgttgacagctcatacacagactcttatttcttagaggacactagcatccacctttgtggtgtttgtacttaatgcatagccattatcagcatcttccataccaaggcagaatgatggggcagtcattgccacccagagtgacaggagcacaggagccttctgagtcaactgaacatcttccatgccatttaagaatttgacatttagctgggcattatggcgcatgcctttaatcccagcactcaggaggcagaggcaggtggatttctgagttcgaggccagcctggtctacagagtgagttccaggacagccagggctatatagaaaaacaaataaacaaacaaacaaaaaaagaatttgacacttagaaattaatatcattcctattttatcttctatgactttttctgttgaaatgatttgccaaactttttggagtctatttgtttcttttcttggctataattctttggaactcccaaacttaccccccccccaaggatatgcttttgggatatatatcaccacatatgtcatttggctttcaatatttttatactcttgttaacacaagaaacatattatgatatagttattaagatacattgtataggttttaaaaacttagaaaatttgattagaaaattgtatgagactaaacctacacaatcttgttcattaggagtcttattggtattacactataacatagcctatgatctctttatagatccatgagcatttgaacagaaaagtaacacatttagaatctatctatctatctatctatctatctatctatctatctatctatctatctatagtattgctttttccatttgattgatcagagaccaagacacatagtataaaatcttgagatactatcttcttttcccccatcatcgtttccctttcaagtctcttgactgagttttagagatcaagttagtctccttggtggtttattttttccattttggttaaaattctactttgaaacattcacattactttttgaaacaactgtgttctgctcacttacatttttcttattgtgtctttgttccacttgctatttgtaaggttactaagtcattctgccttaggtgtttatcttacagtacacaattagactttgattatttagacagtctggttggttggctctattttaacccatttatatttattgtcaaaacaaacatatttttgtatttgtcatttttttgttccacagtgtgaatacttttttttttgctatttcttttgaaatatatttgttgtacattctctattttcttttaattttcctacagacattactttggtttttccattaagttatttaaacacacacacacacacacaccatacacacacacacacacacacacacacacacacacacacacacacacctggttctttatggaaagacttctatgagttttccttgctgcagaatgaaggagatgccaatcctgattctgcatggtcttttgcttgttttagcttatgcacaattccactgaaggacaggactgcatcattttaggaaaacattttttggagcagaagcagctgtcttgttatgtgactgttaccccccttattatttctcaaaactcccagatttcacagataaactttaccaccaagaaaactgccccattcacagcaattgccatattcttaatttgctctcttggtataaattttagatctccagggccaacagagaatgctaagcattgggtccactggcctgaacaatatgatttcctatagatatttcctgtcactgatatcatcacccgttgtggtgtccaatcacaggcttgagttgagtagtagagacaggacaggggttcattatggacaacatcaaggtggtagatatggaaaaagttcacaggctgaatcaaaacactgacactgatacctgcctgcctttgatccacaaatggctgcttcctatgatctgtctaagaacaaatatggaaaagccaggctgtagctaagaaatttcagtatggtagaatgaaaataaggaatgaggttaaagtagaagcccatagatgtgcccagatgccgtataatagcactgcattactagagagatgtcccattgcaggtaaggtaaaagatttgaaatatgctcatagctgttacatacagattgcatgtgaggcaactttatgttatgtggatagaatttcagaactatgggctgatttcatgatggtgattagtgttctgactaatggcttaagacacagagctgggcttgacattaccaatgagttggcagtggtggaagggtgaatgtgtatagttagatgataagtagaggaagccaagaatccaaaggggtagagaagaagggatgcctataaatgcatgataggatgcatatatatatatatatatatatatgcgtgtgtgtgtatgtatatgtgtgtatagatatacatatatatgtatatatatgtatgtatatatatgtatatgtacacatacatatatcatcagatttagtaattagaatattagtgtctgtcatgaatacaatcttgagaggaatatttaataaaggttgggaattttatgcttattattttatggtggaagcaattgtgttagaaatggcttattaaactactaagaattatgattgaaatgcaactggccacagagaaaacttgctacaaagagatactttttcaagaataggaaaagctaaagctatgttaaggtcagagggaaaggagtggggcctggaaatacagaatagcaaaagaaagccaagaagagcctcggttctagaaactgcagcagggatcagtcatctgagagtgcatgcagaaattgtggttggtgtgaaggaaggttaggtgtggggataaggagtgggaagtcagcccctctctcatcttcttgaggctctagagccttctgggattgggtgagaggaagatgcaaggagcacactgagtagggtttggggatggagagggaaggtccacagagagcttgacaaggttcaaaaggaggtgtaaaggaattagtcgtgcagagagagtgacatgggtgattagacacctaggctttcggagagtgttgaaagatctagaatgtgcagactctgggaactgtgtgagtctaaggagcccatgggagaggagggttaggagaggattgtagggttagagtctgacagagaattactgtttgagaatgtagctattacagtttgggggaggatgaactagtatcgtgacaggtactgatgatgcttgcacacatgctcatctgttcccagtgaggggacagggaatgcaggggaagctgggttatacaacccatgtggaagtaaaaggtttcagtagaaatcagagagtagagaagagaaaaattcttacttccttccactcctggatacaaccaggtaggttgctgctagtttctcagaggcataacgaagaagtctaggaaaccttagtaagtggcccagcctgcaaggtgcttgctatgcaaacacaagggcttgagtttgatccctagcatcttgtaagaagaaggcaggtgtttagtgccagtgctgggaaggcatagacaggcaactgctggcctgacagtctagcgtagttggagaattccaagccaagtgagagacctatctctaaataaataaataaataaataaataaatccaaaatgggtggcacctgaggaatgacaacagaggttaacctctggtcaccaaacacacatatcaatatacacatttacacattcacacaaacacacatacacatacatacagaggaagaccaagttgattgcagaatagcatcaagatcaataaggacgttaggctattaataagtcgtagcttctgtgattcatttgaaaccacaatgaaggaccttgttctgattatttgttgctgtgactgagtgttattgctaaaaatccattaaaccattccaaatgactggctgctctttctttctttctttttttaaatgtattttattacattgtatttgtgtgtgtgtgtgtgtgtgtgtgtgtgtgtatgtgtgtgtgtgtgtgtgtgtgtgtgtgtctatgactggcttttcttgctggtcaccagagtgtggactttttgcctagtttggaaacccaagttacccggaagtacagtgtacactcctaacaggagacgttgttagttggttctgatgggaagctgacacaggaagtgactggggtctgggtggcttcttcaggtgaatgtagaggactgattctgtgaaactgacatcagccctgtatgttgcaggtgatatttgaatccgtctctttgaaaggtcatcctggttacatcgctgtggacgaagttcgggtccttgctcatccatgcagtaagtctattcgtttccctggatacattattatttctctatgccagactgggtagtcacaaggctgcaaaatcctattcattcagctcatagctatctctcactcactagctcttaatccttcaaaactgctcacaggatgcaaggcaatcagttctgaataaatccataatttggctggcctgttcaacagcagcatctccaggaatttgtgagactggcaaaacaatttgtctgaatctctctccattattaagggagtctaaagtcctgattgtttattagtgggattcagaccactgaagtagaaggattagagacctttggatagaatcttttgcaattgtctttttttttttttttaaagcaaaacaacagaaaaagaacaacattaaacatggagcaaattagcacactcttcacacacagggaaaagaaccccaaagctattaattctttttattttatcccacctccaccttccaactgttccacataccatatctcctcccccctgcctccgccccacttgacctctaaactccctggggcctccagtctcttgagggctaggtgcatcatctcttaataaacatagacctgaagtcctctactatatgtgtgttgggggactcatatcagctggtatatgctgcctgtttggtggtccagtgtttgcgagctctcaggaggtccagattaattgagactgctggtcctcctacagggtggcccttctcagcttctttcagccctccctaattcaacaacaggagtcagctgcttctgtccattggttgggtgcaaatatctgcacctaactatttcagctacttactgggtcttccggagtggggtcatgctaggtccctttttgtgagtgttccatagcctcagtaatagtgtcaggccttgggacctccccttgagctggatcccactttgggcctgctactggaccttcttgtcctcagtttcttctccatttacattcctgtaattctttcagacaggaacaattatggatcagagttctaactgtgggatggcaaccccatccctcacttgatgtcctgtcttcctgctggaggtaggctctataagtcccctctccctaatgtctagaattttatctaaggtccctccctttgagtcctgagagtctctcacctcccaggtctctagtgtattctggagggtcatctcaaaaacaaaggacaatatattaagtatcttacaacaaagccaaaagcagagagccacaagcacataaaaccacctacaaaaacaaacatatcaggaaccaacagtcattctctctttaatatctctcaatattaatggactcaactcacctataaaaagacataagctaacagactggctacacaaacaagatccaacattttgcttcatacaagaaacatacttcaataacaaagacagacactattaattcttttaaagtaattgcaaatatactcataaagtctatacaggtgtaaggcgagatttctcatggtatttagtgctcatgatagagtatcaagaattttcaaagaatgaatttatgaaattcctaggcaaatggttggacctggagggcatcatcctgagtgaggtaacccaatcacaaaagaactcaaatgaaatgtactcactgataagtggatattagcccagaaacttagtatagcgagatataaggtacaatatgcaaaacacatgaaaccgaagaagaacgaagaccaaagtgtggacactttgctccttcttagaattggaaacaatcacccatggaaggagttacagagacaaagtttggagctgagacaaaaggatggaccatgtagagactgccatatccagggatccatcccataattagcctccaaacgatgacaccattgcatacattagcaagcctttgttgcaaggaccgtgatatagctgtctcttgtgagactaggccggggcctagcaaacacagaagtggatgctcacagtcaactattggatggatcacagggcccccaatggaggagctagagaaagtatccaaggagctaaagagatctgcaactctatcggtggaacaacattatgaactaaccagtaccccggagctcttgactctagctgcatatgtatcaaaagatggcctagtcggccatcactgcaaagagaggcccattggtcaggcaaactttatatgccgcagtacaggggaacgccagggccaaaaaatgggaatgggtgggtaggggagtgggtgggggaggatgtgggggacttttgggatagcattggaaatgtaattgaggaaaatacgtaattaaaaaaaaaaaagaaaagaaaaagaaagaaaagaaaaaaaaagaaatttcattggctcaccacttcaagctccccttcgtgcagtaacacttgaatgtgtttcagcaaagagccactgttcctggccagcctgggtgcaggcagctgtgatggcatcatacctataagtatatggttggaagtctaaagtctcgggatgcctaggaatcaaggaagccactgccagagttggctgggatgccagtaatttgggagtgcttttgtcatagatttctaccagttgtttctacataacctctgagggtttcaccattctcccatgtggtcatgagagatcgagtaaatatagtttagtaggataaaatatccatggcagactgacatttaaaacttttaatttattctttgagaatctcatacatttaatataatatatctttattatatctcatttcccttccagttacccccagaatcccacactacttcttccttccttacctccccctcattcttcccttccgtgcttgcttcttaattaattattgaaaacccacagagtttaattagtactttccatatagtcacagttgttgggttcattcttggggcatagggagctgccagtggtcacacacctaaagaaaaaaaagacatagccctcccccaacacactacagctgttcactgccaatagctcctcagctaaggataggctctctagggagctctttctccattcttgctagaattttgaaatggctagattgtgtgcagttcatatgtagtgaaccacaagatgctatgaattcacatgtgcagcagctgtgtcatactcagagaccagcaattcacagacctcccctttgtatcttcttgcttgtctattctttcgatctcctgttatgtttcccaagacttccgggctgaagattgatttagagtgcccatctacagctgagtttgctctttgaaggctttgtagaattctgtaatgaactcatctagtcctggcctgattttcagttgggagactttagtgtttcagtcttgttgctcattatggaactgttcaggatttatttaaattttatattgatttacttttcgtatattgtaaccatctagaaaagagtccattccctttagatattttttttcagtttggtagagtaggggtgtttaaaaatatgttcttatgattttctgaatttcacttgtatctgttcttatgtctcccagttcatttctaattttactaaattgtgtcttttcttttgataaatttgactaagggcttgccaatctttccaaaacccatctcattgtgctattgattattttgtagtattttctactgcattaatttcagtcttggttttgattgtctcttttcatctactacttggatgactggtttgttcttgtttttccatggctcatcattaagttatttatttgaagcaggcacttattgttataaatagtcctcttagaacaagaagaccaaccttctaaggaaaagagatttaattagctcacagtgtttggaggtttgaagggcataacactggcataggctccggtcagtgatggctttccagaatctgggagcagaacagagcatcatatgggaataaagagggagtgtacatgtggatgctgtctctgtccatttttttttaaacactgggattgaactcttagtgttccactgtgacaacctcatcaaaatcttacaacatctaaaacagccagctctaaaggttatagtcagattctgacctctttctgccacggacttcaggaattcaactttggtatgagtttggaagattaaccatattcaaaccacaactatgctatggctgaggaagtctcctcatgaggcacatcctgtgtacttccctatgtatctttaacccacacccccatacccaggcatgagcctcccaccagccccatcatgttgcttcaattgaaatggatcttttcatttctgctaccattcatttgtcagaccttaaatcgctgttttcctctagcttcctgggataagagcaccatggtctgactcactagcttaaagcaccttctctggaaacatgtatgctaagttccaggttctgatcaatgcttgtggggtcactgactgggtctgacagctacataagagagacccactctcagagaaatcaacttagaaacgctgaggttagattccctatgactctccctattctctgggttatgtctcaagtctctcagagtgtcttagatggttctctccatttactcatgcctgggaaatgtctctgatgaagtagacttgttgtgaagaggatccaaagtccccagcattgcaggggttccacagtaggcatgcagacaggttttccttgcttgttctgattgtcttccttccctgactctcatgagttccacatgcctatagccgcccacagctacacaaactgggtccctgaaagggaagctggggctatatgggagaaattgcgagagaaataacgagccaagacaaagttttctgatcaaggtcaatgtttacttaagagtctgagcttataaaggggggggggcatctcatcctctaccatgccaggatctcaggatagtgtcaggagaacaggttcagcctctccgcacgtagtagtgtcctcttggaggaaaccccagatgtggcagaacaatagacctaatctaggtccgaagactccaccctagatgggctagctgacagtgacagaacaggtctaagccagctgggagaggctacagatgcccgttgggggatggtctgtattcaagacgggacagtggtatcaggaaatatctgctcttcttgcttccatttaactatacattcaaccctgtacattcttcagttttgagtagtcttcccgctaaaccttttatcttccgcacataatgcacatgcatctccccatagagcatgctcatctttgctgcctaaattcattatttttatgcttggagatggtctttctggtaggtggcactgttttccctccagcagaatacagtatggtactctgttcttgggtcccagtgctctgtgttcaggaaaccgcactttcactataataccctgttttggtgtcccctagtctcaactgtcttatctccaagtcctgcccaccaccatcaaatactcccttctctttgttgtatctctgtaggggaacatcccagggtgacatttggatggctttctacccacaaaattcctaaggatcattggacatcttcccagtgttcactgggacttctgtgaatttaagattctcctcatagcctcctcctcctcctgctgagaagtgtggattgcatggctatagaattgctaagagtcacttacccagcaaatgggccatgggatataactctagaagacatgaccttggctttatttctgcatggtgtattgtggctgtgttcaatcctagtgcttaggaggcctaagcacatccttgccagaacatacactctgaggcctatgaaagggtagctggaattggagaagaatcacattaaggatatgtgcaaacaccgccagtgtgtatagacctctgaggtatacccacagctcatatgctcagtgcattcattgctagcacaggattttatccatccttcatctcaacaagtaaattattgattgtgaactgtgtgttcaagagctctcctgggcatagctgatagttaagtaagaaagggttggcttttggcgcttgattggcaggggggcgagaaggaagaaagaaatgaaagtatctaatactagataagcagtggataatctggggtaatggaatgtgccgtgaatatgataaatatgggaggtggaattccttcagtagtgtgctcaaagatgtggtcagagctgggactctaatcatagaaaggaatttgctttctaagaatttgggtaggaacttctaggaggaggaggaaatggtaagtttccaaaggaagacattccagtgctgccagtgtgtcctggtagatggagcacagcagacaatatcctaggtgaaccttgggcaagtgacctgggacctctccacctagggctttaggcatcattatgagtggatgttagcaggggggcaatgtgaggaaggctttgggggaatggaatagttttagttaactcataaaggatgctgtgcagcatacgagtttgagtcccataggaaggatggagaaactataagaaagagcattctagagctatgcaaaaagcaggggtgacctggagcaggattgtgaagagtcggccactcaccactcagggagcatttactgagcttgtactcagtgtctgggattatggaactacataagacaaattcattgtccatcttcgcaagactccatcaaagtgaatgagatcaaaaagcaaacagccagctctgcatttatataatatgtaacagatggtttattgctttgcaagaactgccacaggacgtgccagagactaggtggcttaagtgatcactagatttttccaatagcccttgtggctaggaagtcaaggttaacgtgctaaaggtttggctttgtagatcatcttcctgggctggcaaatggtttcctcagtacaacctccccatgggcttttcctatatgcgtaagtccttggtgtccttttgtgtgtctacaattcttctttctgtaagaacactagttggattagatcagggtctacccaacagccttgtttgcgcttgatcagttcccacaaggctctattcctagattcggttacattccaggttccaggttctggaagatagcagcaccatggagaaacagacatgcaaaagggtgctgcattcaggtcctgaagataactagtcttatttgattggttgcattgggagacagatgactgcctctgtatctctgagaattcttgctacctttgaagtgctgaccacagaccttggggctgcttatgggtttatactttctgatttgtctgatactctcgtgttttccccaaaagctcagcctttgaattaatttctctcaaaagtttttaagatgttatctgtacagaaaaagatgcatttcattatgtcttcaaatgttctgagtctccacgtctgtccttcaaaatatttcctattgacatatggccagaatttatcaataaatgtttcaattaattattctaaaagttgtagacagagaaatcatcactgatttgcaatcttatcctctacacattgaagctggctttaaatgtttatctcaaacttccaaaacagttaccaaaatccagaccttatcctccaagtatattattttcttttataatggaaaacttctcatccatatcttatagctcatttaactttttttgttgtggttgttattattccaaaagtagtttggccatagccaccatccactgctgagtcttggtgtcagctgttaataggggcctctgaggttataactttggtaaatgtcagcacactttgccacacagtttcaaactttctaactcccaagttgacttttagagttttttccaacctctttttgcccccatcacagcctcgcagggtcctgtcgctcagcccacagaacaccagcaacattgtttctaatggatgtagcagttttcacttcaattgtgtggctccctgctgagcattgtcaggtttaaagagcgagataaagggcacaataatacgtcttcagatgctgcactgacatctgcaggagtttaaatgtcaccagcaccaaggcattttgccccaaatacacaaccagttttgtcttaaccctgttcagcaggttcccattttagaggaaatcagtctcaaggaggacggttttgggggcgggatggggtggggtgggggctgcttaaagctgggcgggtggctgcttggaggacccgaggtcacttgttattggctgaaggttgggtgagttgatattggtataataatttcattcacagaagtgcagaggcagataatgatggaaagggattggccaatgaacagactggagttggggatggaaggagggtcagaaaagcaggctccaggacaagaccaaacacaaggcggatcccaacagaaagacactcactggtcatgagacatgggtgatccaggcctcggagactagagtttagagtctatggagagagtgcagaaggagaggttagctgagaaaagttcctacaattgtgtggtttccacagtgtgtgcagagaggagagtcactgctggatttacaggcccagggaaggcacaataggccagtgggaactgtcccaggagactgaacataagagcaacttaccagaggccacaaactggtgggacctgactgttgatgggtttagctaagactgtggtgtgctcatcaaacttagtcaaggtttttgggtgggagacttcacgtaaaacacagacttctcttttttgtttctggagaaatcagatgactgacagctgtgagcaaggtactcccacccccaccctactccctgctggcctttagcagcagagcctccctttcaatatagtgtgaggtctctctagttcccctatttatccactgcaccttaatttgccaacattaaaatgggtgccaaatactggtcctcactttgaccacagcattctccttatttacagaaatatctttccaaaaatgggaaacaagagagagagagagagagagagagagagagagagagaaagcaagaaggtggtgactttgttagtgttgatttacagtggaatcgctttgttaattttgatagctgtctagtttctgtgagagttcgggcttgatgtgtctgctggaaatcagggctattagtgtttccccagcattttacaccggcaacattcaatatccacattctgaatatagaagggagggagggggtggagtaaaaaggaaagaatccagaatgaaactatggggctgaagtgggaggagaggagaagagtcagaaacaggcaggtgccaaccaatgaccaaagaaggactagttctgactgcacatgtcctaaaactaaaccacttgtcacatgcacataagtctaagaaaagaggggctttggtaaaatgcacaggacatcttaactttggagccaacatacaccccctccctatataggaagggtgcccctttcccttttataactgaagcaaaatcagacctataaggtttgctccgtctgtggctgaagaactggtagttctaaaaatagcttcacaaaattatacaggagcaccaaaggacagcaatttcaagcaacctgagcagcctgacatctatcacattggtagatgcaggaatcttgaacaaggagacggacagcagaagtggccccacctgggccttggacccttgacaccttagccgcagggtcctgacaacagcatctgaactgttgtcagctggtttaaaaacatgagcagatggtatatactttctcatggcaagtgtccttgatcacactgaagtccttgagttttggagtcttcctggtggtggcacattttggtagacaaaactgttcaaaacatccacaggggaaggtaacgtggactgcgttccttgtaaaatatctgagagcaaacagagaagccaggagactcaccaccatctaccctggaagttctttctctgcactgtgaggctgtctggtgataccaacttccctctcaaggtcaagaaggcaatagggtggctagtttgaaattgagtttggaactgggctgaattctgtttctgtctctgtagctttggtgcctggtatagtttcatttctgttgtgtgataaaatacccagattaaaaaacaacttaggagaaaagaatttatttggcttaaaattctaggttacaatctatcatagtcggggattcaaagcagatgggtgagaagcagatattcagtcaagcgcagaggaaaatgcacacgcacttccttgcttgcttatttctccactgcgcgatttctccatttaaaaatttaggatacccctgtcttggaaatggcaccctacccatactgggctatatcttcctacataaactagcttaattgagataatcccctacagaaagggaacacttacttactgctggtggaaatgcaaactggtacaaccactatgaaaatcagtgtggaagaaaatttatcctcagaagatggaaatagctgtaccacaggatccaactataccactcgtggtatatagcaaaggtctctctatcttattacaagatgcttgctcattcatgtttactgctgctctggtcaccacagctagtaaatggaaacagtgttagatgtccctcagctgatgaatggataacgaaaatatggcattacacaatggaatattgagctactaagaaagataaacttataaaattttaagctgttaaaaaatgaaattatgagagtctccggcaaatgggtaaagttagcaacaatgattctgtgtaagataaccccgggtcaagaaagacaaaggtcacatctactctctcatttgtgggtgacagctttgagtcagatgtgtgtgctttgtttggaatacccagagagactaagaaatcagtaaggggccacaagaggaagggagctttcaagtgaggagagacagaacactactataaaggattaaaaaggaagaacaggatgggaagggttaaatctgggtgggccgtgggaggacaatggagtggagagaatctgggaaggggaaattaaaagtaaaggcctttgaagaaagttatatggaaccctacagtccaggctcccgcaacacatacataagcataatatcaaagaattttaacagttaccctgcaagaggaggacagtaccccaattagagaccacatgttagcaaataaaatccccaagtaacagaaaggattacctctttttgaattgttagccaatggggtcccatagaacctcaagcattataagctattgtcaatagactttagaagttgatgataagaccatacttctgaaggctctagaatatgagaaattaagctggtactgacctggaagctttcacagtgctgagcagtgctaagcatgatacagaaggagaaaattaattaaaccagaaatgtggcaaaaaacagaaaaaaatatcagtttcacacagcgtttaatcctgaaataacaggaataaggacttgtggttacagattctaggggaagatgtgctagtaccattttgcttaacaaatgtataatattaaaatgattcctaatgacttattgctatagaccagtgcatccagaagaaagtgtcttcttgctgcagatagtaatgcacacaaagactcttggctgttctgtgtgcagaaaatatgagattctggtgtgttcatacatacatacatacatacatacatacatacatacataccatcacatccttccccacaaggctcagggatccagaagcagtggatgacataaaggaagcagtgttttctggacataacagggcagcttcagatatgacctcaaacggattgcaacagcacgcccaagacctgtgcaagctcaagccaaataaaatcccaggatggaagtaggagatggtatgaaattctaccactagcccagtagttcatgtgcttgatagataggggaagagggaaagttattttttcttcaatgatatgaccatggtaggtagaccatacgctatggcagactcttgttcagaaagtagttgggcaacataaacaggacttgaggcagatatgggtgaaaacaaatgtagggagggatggaagggatggtgaagaggttggatataggaggagctgatggtgaatatgatcaaattatattgtatgaaattctcatgagttaataaagatatttagaaaagggtaatcctcatagacatgggcactggtcaactgagtgtccacagtccctccatctttgagattatctttcctggtgattctagattacatcacgttgacaattaagatagctgtcacaacaatcttggatttgctgatgctaatttctgcccttttagcatatgcttctctgggataccatgaaattagaatagataaaacatgcaaagtgttttaagccagctgtttttatatcaacttgacacaagatatagttatttgggaagagggaatcgtttaagaaaaatgctcccaccagattggcccatgggacagtgtgggggcattttcttgattaattattgatgtgggatggtctagtccattgctggtggtggcactcctaagcaggtggtcctgaatggtttaggaaaacaggctgagcaagctgcaaggagcaagcaagtgagcatcactcctccatgaccactgccccaagtcctaccatcagactcctgccctgagttactaccttgactttcctgaatgatgacctacaagctgtatgatggagaaaaccctttcctccccaagttatttttagtgttttatcatgacaacagaaacctcaactaagactactgcttagcactggtggggttttcagtacatgttattcttcctatttttctccatgctctgggccttctaagacccctccattagccccacttgggataagtagtctgtgcccagcttatcactgattttattaatagtggtaggggaccttcattgcactcaatgacaaaactcactcctcctgtcattcattaattatcagctaatggagacctgatattgctgttttatgagtgacttatataaaggaacacttggccacacaaataatggaagagctgaactcagtcatccaacatgaaacccaggattaaccctgggtctgattacctcacatgctgattttcatttgaagacttttatccatgtgcccgagcctcagaatttgtgttccacttcctacccacacttaggatgtgccacagtgaaaagctgagaatgcaaactgtgcctatgtgagcatggccagctctctagaattctttgcttctatattcatgaatcatagggccagttgcatcatattcattaaattgtaagtgctagccatggtatctatcatatagaaatattcagtaaatgacacacactatagtttcttcctccttttctcctactatactctttgtctgtaaccattgacaaattcagcatcagcatcatctgcatcagcatcatctgcatcagcatcagaatcagagtcaagggaggaagtttgggttttatgattcttcttttcatctactgtcattcccaggggtaacattcattttagattcattctagtgatgtgtgggccaagttaaaagagagattacacagtagctagtcataggaacattgagggtctcaggacaggattcatgtcttgctattttatgatcccaaattttatggatgcctgattatgccaaactatacaatgctcagagtcttaggttcctgacctatgaacagggactattctcctgtgaacttcatagacgtcacaaggcttaaataggtcaatatgtgaagatcacagaatgggcctcatggtgtagtgacccatgtggtctcatctgaacctggcatcttctcagccacacattccaggatctccaggcctatccagggctgctgcccctgatggagaagtgggatgagcaactgcatcctgtcctcatgtgttctgtgtttggttttgtctcttaggaaaagcacctcatttcctgcgactccaaaacgttgaggtgaatgtggggcagaacgccacgtttcagtgcattgctggtggaaagtggtcccagcatgacaaactttggctccaggtaagaatgggagaggcccttgttcacaccatttcctccctttgcaaggaagaaattatgtgcgttgaagaagggtgtggtgggggaggggtgcggccatttttaaatatctctgctccttggacattgctctccaatcatgctgttgtggattcatatcgactgttcagctaagttggcattttatagatagcgaagataatggcaatctaaaagctctagttctagagtttgtgaatacaaactgcccaccaagcattctctaacgaaactttgtttttaaatctacaattactaaagctaagacaaatggagtatcttagggtttaggtttgtgacgccatcaatccatgactaaaaggtacttggatttctgggtgaaaccattactcttttcttggaaaatgtccttgaaatgagcagtctgttctctggctaaatgagtccatcattgaatagagtccaccaggacagtgttttaatcctgaatctacctgtgtttcttttctgctcattgattctacttgcttagcaagatgagagagcatttatctgggtggggtacagagccagagtttgggacacagaatgagagcatctgctgtgatgacattgtcaggctcttgtcaatgagaatgcatatatatatatatatatatatatatatatatatatatatatatatatatcacacacacaaatataaagttctgggacaacacagaaggtcgagctaaggttctttctccatgacatgttcataagatcaccttctctctctctctctctctctctctctctctctctctctctctctctctcacacacacacacacacacacacacacacacacacacacacacacacggtggggaatgcatggaatcaagcagtattaaggtctttcctcaataattctaatgtgaggtccatttatatcattgcttatatcaaatttttaatttaggtagcttgttcttaatctattctaatagtgaaatattataataaaccgcatatcgtgattttctcatctattaacctattgatggctcaccattgcattgtttcccatttctatctgctaataagaatctattgtaaacagtgtgcacatccatgtgtgtatacatgttctgtcatttcgcttgagcagacatctaatcttgaaactgccaggtcttgtgtagatgtgagtttgactttctgaagaacaaaaagctgtttttaaacctagttaaacccttttccattgccactgagcagtctatccaagttttcccacaccctcactgacactcattctgatcagtcttgtcaattagaacaggtgatcatttggtatttcaatgtggtttgaaagtttgtttccctgatcacaaaggttgtgaaacatgtttgtttctttgtttgatcgattaattttattttattttgttgctgttgtttggcccatgtagaatctatctccattctgatggcagttcatcctgtcatctctctcctaaatttgaaccttctttcttgctgttgcaaactccctggcaaagctcattcagacactaacagtttctccttggtacttatatccctcctcctgggtcattcaacactgagtagtgctattgattcttttcactgtaattaaagtacattttgctttgaagacacatgccatttcaatggcattgactccactggctcacaagaatgatataggacaatcacaatatttttcagctactttatttgggcattccaattattgtaaggtcagtattgctcccatactgactggtgtgcactaagccttacttttgtacacaggaggatgttaaaattgagcccaatggatgttttgaagaaaatagacagaaatacgcaccactgaggtctttatttaccgatctacttttcaatgtttttcaggtgacttagaaaggatacaaagcaagatgagatagtgtaaattaaaagggaggcaccccacgacaggaagctcacatgagagctgcttctcaggcgatgactacatttcttccttcccactgctggttttagggtcaccagtggggcgcctgagcaccacagccgccagtgggataaaggaagcttgtcagatatacagtttacaatgtctgcgagataaacacaacccaattgctcaggaaaattctaactgttgttcacacagaggccagacagggaatggttcccaggagccctcataaagcaaagactgtgtgatgtaatgagcagcatcctctaccacagtcttattgagggcacacaagtggcttttgtgggtctgcttcacatcataataatactctgtgtgaaagcaggctgaggtggtagaaggaaaggggggaaacacagctcaggcaggggtccccagctttctgctaatctatctctacccagggaggctttaaacttaatacagcaagtgaatagatacaataactattcctgcaaggaaatctccttgagtaccggctcactcctccatatttcagggaatattgcgaaggagggcacgaataccaggcattctgacagaggcctgtgtgactagtaaaattccacacataggtacaacactgtggttggaagttgttggctatatgatagtagtcacagggtaacagagttaacaggccacacacatgtctatataggcacatgtagtatatagacaagtccatcatttttgggatataattaggcacacaaaaatctaaaaccttcaatgtgtgtacttttccaaaattagtttcattgatagcagttttctaaggaaggagccagaaatggggacagggatttacctgcaactatatacaactggacagaggactagaaagacctagagggttctgcaagagggactaattaagtaaatactgggatgaagtaattaaatatgagatagtagacagagacttaatggcattttcatagtaaataattaagtgaaaagtgcaagctattaaacagttgatatatttaatattttaatgaaaaaaacacatatgcatatataaatgtgcaaagttatacatttacttgtataacatatatacagaccctatatgtcatgcatggatatatacatgcacgtgtgtgtgtgtgtatatatgtgtatatatatatatatatatatatatatatacatgtatatttacagtactataaagcatatatcaatattattaattgtgataatagattatgtgtgtttattctttttctatttcattgaaatattaaaaacgaatacaaagaactaacttaaacaaaagcaaatgccatttaaaaaggagaaaaatggccacttgtccctagatatagatattctagagttagcaggaagtctttcctagcatcgagtagccaactgtggtggaagagctagcttctgggtaaggactcaaagcagttgggcatactatccatccatgtgggtctttagaatattctgttatgtgtcctcctttcttatctctacctctctacccttaccccattctccagggactctagagcaaacctgtcagcccctccatgaagctgacctttgagatctctctacaaagagtttccactgagagactgtacaaccaacaatgcttgccaccttggaaatgaggcctgtgtccagatgctctgtgcagatctcagcagggtctgtgtatgggttgagacaatcacaggcaccagagagggtttgacagggcaaggttcttgttctgggagcccttccctccagatcagcggtaccgggttgtaagataaagaggcacatctgtctgtctacatagcagcaatgcttcctgttaccttgttacttgctcccatggggaagcactggctacccaaacaaagagtactgcatgaagcctctcctctcccagctgtttccaaactcaatgtccctctgcatagggcttctacacggtagtcagagaaactcaacaatgataataaagcctagagactacacataatggtgggcatgtcctgagggttaccacacaaaatatttttaatgctcattgccatccttcaaaaggctgacgataacagccccaaagaggttgtgcattggtggggttaaagagaacttcagagtcaaattgagattgagaaggagagccgggtgtgggctgtatcctaaagtcttgagttaattcaccaagtcactttgccataccaaatctaattattctttgcagctggatcccagtaagaaaaatgtaacttcaggctggggaaatggctcagtgggtaaggtgctcgccatgaaagcttgaggatcggaggtcaatcctcaggagccatgctcatttgtaatcttagggactgggaggcacagagaagaggatccatggatttgctggccagccatcgtagatgaatcagacagagtcagacgaatataggttcagggacggagggagagaggtagggaaggaggaagagagggaaaaagagagggagggagggaggaagtgagtgaatgaaagagagagacagtgacagagacagcaacagagacaaaaacacagagagaaagggagacaaagagactcagagaaacagaggagtggggagagacagagagagagggagagggaggaagagagagagagagagagagactgaccttgcctcaaaagtaaaatatggagcaatgtcagcctctgtcctctcaacatacacacacacacacacacacacacacacacacacacacacacacacacaccctacagccaactttctttatttagcatacattcatacctctaatttcatattcactgtactaaatacttaagtaaatttgaacttcctaaatctacaagaaaatcagtaaaataaaatatgcttggaatttcactcaaaactaacatctctggatgttaccttttatttctctttctggtctcatccttagccatgcttcataaatataaggctgatatttgcaaggtggtttttcttcagtcccatctcttcttacacgctctgcttgtaaatatcagcagtgtgttccttgttaaaaccaagggatgcttatcggtccttatacagatgttgttcctcggcttaaggatggagtcagagcctggtcagcccatcctgagtgcgaatggcatttagagtacatttagtacactcaagctaaagtccccagctcagcagtgcactgtattatggagttatggttgcttcctctctcattgctcactgactggaagctgggctcttggctgttgtccatcgtcttcacagtagggaagcacatactgctagcccaagaacaaatggcaattgaaaatttgaagtgcaattcctgcttaatatgtatcactttcacactgctgtgaagttggggatgttctaagtcaaaccaccaccatcagcagggttactgtacatgcctaactattcttttggcccttcatgacattaaacatttcttctctggagacctccctgccctctggggttcctgaaaccatgggacagtcagcataatgggattgttttagctgatttgcaggttgacaaggttgccggctctcatttcatagatgctggcagaagacactagtctcctggttcagagatgaggagccttgctacttttgacaccacagtcagggagtgcttcattcttatgttcctgtcccttgtccctcatagggatattgggggtgggagtgggtgtaggttaaagttccaacatgggagatctgtgtcatagttgaggaacattatgctaagaaaactataaattagaatttattaataagcagtattgagacataggctataaacctataaaccataaaacccagtactttctctttctctctctctctctctctctctctctctctctctctctctctctctctctctctctcttgtgccatgactctgatatttcctgctttatcttctctgctgctcctcacctgaaatttgctgaagatcaacaaatagctcaggctaaggatgaaactcctagtagagggtttccctaatgtgtgctgaggccctgggctcagggtcctgcactgtgaaagatgaacagaaaacaacgtcatctgcgcctcctgttctggctaccttcctcctgtcactgtgcagctcacctttggccctgacaaactctgacccagaatgtctcccttgtctccatctctctttcctgctgtttccctgtgtcttttctcagcccatcctctgtgtatgcttttaggattaagcccaactgacctggttttctgcttggccggggagccggggtagatcagagagcactcaggaccaatctttgccctacccctcttctccctgctcccctgagttcaccttccattggtgaagatggacattgagcaaggcagctaactatttcatcacaaggtgagaatggtggggctgggggcagcaagatcaggaaggccaggagggttgcacgttcaataggagcaggaacttcagaggaaggagcctcccagtggagtttggaagggtgaagcattcacaatcgaaggaggctgttactggaagatggaaactgtgaaacctcttcccaacctgcttgtcttatctactttgttgtaggcttgaagccccccatggggcttacaccagtcctcttctgagtctgcaggagctctggactcaggcatcagacccaaatgagccgctggccatgaatgcagcgggcctttggaagggcttcagtacagctaatcaaaaatgatttatgtctacttctatttcttttaacttttaataaagaataatcaaaagctattctttagagagtgccaaaaaggtacaaatgtgctcttaagagaattgatgggcatgattctagtaagtttccaaatgtcatactgttgcagggaggacggagggtgaaaagaatattcattatgagtggattgtaggaatgtcacctaaatatttgctggctgggagactcctggagcaatcagaccatttcagctgaaaatgttggacctgattatttatttatttacgtacattttttttatatttacttctgaagctcaaactagcttgcaagacacagtattagaatatttcctatgtagtgagcatccaatttgttgtggagaacaagcaacattttccctttattaaagacagtattgtcttcatttctgccaattacaaatcatttgcaagcctggctcctctctctgaaataatgacagctgacagcctttttttttttttttaaatttctttgagctatgtcttatctctttgtgaaaggaaaaatgtcatgacacaagaaatgagtagagagggaccagtaaaacagtgaggccaggatagataccttgatagtcatttaggaagtgggtgaatgaagtctgctttatgagttaggtaggcctcttctctgggtggtccctagacagagaggtcctacttgatggtgagtgtgtacttggcacaggataccaaagtgtaaatatatctaggctgtgttcttcaatggagctgacttacccacatgaaataagccagaggaagaggaatagaagctgcttttacagggcagaacaagagcaagagtaagatgatagatagacagacagagcaacagaaagatgatagataggtagatagatagatagatagatagatagatagatagatagacagacagacagacagacagacggatggatggtagatagatgatagattagataggtgaagatacatggcagatagatatatagattatacagatagaggatggatagatagattagataggtgaagatacatggcagatagatatatagattatatagatagaggatggatggatagatagattagataatagatacatgacaagtagatgatagacatatatgacagatagaaagatgatagatacatatagataggtgagagacagagagacatttatttctcaggcaactgttacccttagagagatgctgatgaacatgaggctaagcagaaggctgtttaggctgtaagatccctttgttctgttcaggacatgtgtcccaccgttggataatctagaatatatgcccctctctaacccgatgcagcaccctttacctcagtaatcagacagaatgtccagtaaccttctataatcagaacttagttatcctaaggtcaggaatgtggctgtgcatattatctcgggctgtgtttagccttctcctgaagatgggcgcctttgatgcaggaacaaaatgctcagccccaggaattggtcctagatagaaggcaggcagcgtttaatttgtgtgttctagggtgttatttgcccacttgctttcctttgaagggctaagaataagattatctttcgagatcttgagccccagaccaaggtccgtggcactggcatcatggcatcatttgggaagctatgggagatgagaattattcaagtccaccccaagcctctggaatcaccttgtgtatgatcctgatggacactggaaactgagaaatatggatctagactgatggatttgggttcaaaaaacattttttgcctgcagttttatcagctgctataccttgatactgtgatacctgtacacacacacacacacacacacacacacacacacacacacacacacaccatgatccttcttacatgtgtgtttctgacttagagacttcaactggttccagaaaactagacggctctgcttttcacagagcagtcatttcctgcaagatgaaatgaggtgcttttcaaacaaacaaaagtgcccggaatttgcaaggtctatttccattacagagccattgagtctgactctgcctgttacatactggacagcaaacgggtgctgatggtgaatggcctgttcctggaataggtcagcaaggaggtgcagctcctccctcaggaaattcacataaagctgtgctctgctggggctcacagcccagcttcactatacctgggaacttgctaaaaaaaaaaaaaaatgaaggatgccaggccttccaccaaaccggacaattctaatctgcaaactttaataaggtctctctactcaaagctatatttcttgacttcccattcatctttaaggtggtttcaaatatattagagacagagtctcactctatagcctaggctagcctcagacactctgctttcttgtgtctttcttccaagcgttggggacagaaatgctctccattccttcacttcattgggactattagttacttatgacccatggcatactttatcaagcatcagggttaatctgacttcccaattgatgaggtctaaggcaggaacagagagcccatgtttctagtttgcaggggatggtaatgtaaaccagtctgagcagcagccatgagaaacactgtcataggctattctaaaagcaggcctctttccacgcccaccctgtttttcctctgtgaagtaggctatttcggagctccccttcatgtttatgtttttgcctttttgttgttttgctagaatctttactcagcctgcatattcctctgggcagaaattataccttccacaccccacagtctctcgttttctgttttgtaaaataatgagtacatttccagagtgattaataatagaatagggaaagaagagaaaactccgagtccaagtaccaataaacagcatccgaaaatggatatcagctgcaggtctcctacaatcttacactgctaacaagttccccagagctactgaggtggccagtccagggaccaccctttgagaacttttccagggattttaaaaggatgaagtaatccccagctagtcggtgaacacagtgctgagtaaaaaccaagccctcaaagaggctagccagggccaggggtggtagcacaaccatattccagggattccaggctagcagcctcatgagctagaggccaggttgggctatgctatgttaagaggctagcctgggcaatagatgaaatggctttaaggtcttaaaaacacaatcatatatttgcttgacatcagtgctcccattaatcataaattgaacaaaaatatttatccaatttagttgtgcaatttgtgtgtgcgcgtgtattaggaaacagtatttcattgtagaatgtttgttttctgtgtgatcaattttcctccacagtcagtttccattaaaacaaacaaacaaacaaacaaacaaacaaacaacaacaaaacacaacccaaggaagcaaaatattcaggatctaaggacttgtagatttcaaagcaatgtttattggaatccaggggcatcgtgtataatttactgtaggagaaggaagaagtaggaaaatgcctggtgccatggatgcttttactgtctttattagagcatctttagaagacatatttctcatcctctgagcctgtgcatgcaagctacctctagctccccttcagccaaggctaagttccctcatcttgttaggacttaaaattggccacaagttcaagtgttggcccttgggcaacagttttaggcagggacttctcttttcagtagtgacatctttttatcttgagaacattttcccttggtgtataggatctataagtcaggcacacaaaacaaactggcaagaaattaaaaggaaatattttaaatgcttggcacatatatgattttatattgaagatgaaagcaaatctgagtactaatcaagtggatatgcttaccaattatttcataaagaattaaatcttggctgaatatgtgaccctccaaaatggagagcctcttcaatacttttcagagttgaccaatattttaattttataaatgacaatgataagaactatgcattatataaatatatagtacaaaatagcagaagtgttttggggccatttcagaaattgttggatttaatattaaaacaaacaaacaaacaactccttaagtcagctacttgaacaacagttgtatcagacatggcatggtgacatgcacagtgccaagtattcacgccattatcttgaatctcagtgtctgaggtgttagcccatgggcaatgtctgtatacagaattgtcttgattgcctaatgaaggcccagtctgaaagtgggaggcaccattccctgttttataccctggactgcagaagaataggaaatccagttaggtgatcaacaggtatgcattcttttcttcctgctcttgactgtgaatgtgactggctgctttaagcttctgcctgtgactccctgatatgatgaaattaatacagagccagatagaccccttctctcctcattatgtcaagatgtttcgtcacagcaaaggagatgagagtaagatgttccctgtgtcagtcaagcccgtggacatagatttctgatttttttttccttgtttaaccaaattcccttgtgttatctcctttgcattccctatttggcatttatctggggctgtgacagtagctgtgacatctgattcttacacagtcactatgtttgaatcccttctccacatggccatagctttgaagacatccagggcccttctcattggagtatctatgacctgagtttgtagtacttctgtgatctcttcctctggagtcctcgcttcctgcttgtctgttttgaccttcagccttaacctgcccttccctgccttgtctgagccagtcatactaccatgctctgcccatcaggactcgtccccgagtctaacctccatttctccttgctcacagtccatcactgtactatttctgcctggactctgggccctcctgcatgtccctgccctgctgttacctgctcccaatatgacaagtatgattatccaaaggcctgttttcctgagattttataagacaacctgcaatttccatccttcagtggggaaaggctctcggttcaggagctgaacagaaaaaaaaagtgcaaaaaaaaaagtgaatggttcaggggaaggcacttaatcctctcaggtctgccagaacctgacatcattaaggagataagtaaataatatgggaggcaacatcaagataaaatgtaaatgtgcacaatgcagcttttgcacttaaccagccctttcttttagtattagtttcctatcgtccctgaaataaattctgcaaacctaacagctcagaacaaatttatttcttctgccatcatagagatgaacagtcacaaaggaggttcagtgagttctgcatatagtgttgagatgttggtaggctgtcttccttgaggatgtgcccagcctgtgaccccctagattgtataaggccaatgatagctatgaatgaaatccatcacaaaaatgtaaatataaaaattgtgaggatttcataattgttttatatttgctttcatggtcctctttttaatctcaaaatctaatcatttttatttcaagggtacaaggattttgccttcatgtatgtttgtgtattataggcatgcagtgcctgaggtagccagagggggcagtgaatgacctatagctggacttatggatggttatgatctgctgtaggggtgctgggaattgaaggcaggtcctcaggcagagccggtgttcttacttgctgagccatctctccaaccttgattgcacagggttttgaacatgaactttgtagatgatgatgttttacaatgatgaaaggttggacatgcttgtaagggtcttgcagggactctgttccccttcccttattatgttacccaggacctctgctttagctcctgactccctccttctgaagaaagggagtggttgcctccctctgacctacccttccatctatacctcactcacctccccatgactccaccccaccccaatccaacatgagaaccctgtgattaattggtcccaggtagataaccccaaataacattccaacctcaacatccttcactatgtcatctttcaagcctcttttgccaggtaggaatatatattcacagcttctggatattaggtatgggtgtctttgggagatatgattccactgacagcaattttttttttttgctaatttcatggtcaatttgcaaaactcttgtaacaccagaatattcctttatgtgttaagtgtttcgtgtgccatctcatttattccttgcagtgaccccactggtggtggatttttgacaaatccattgtgtatggaaggaaagagaggtgcagaagaggaaaagagataaaagtgttataaataaatcaggttggacattatctatctaatctttcctcacagacttatctgcattactatggtattcttgcactgccttgctgagaaatggggaacatggacccgttgggtaactttgtatcttctgaagttcattcctcaccttttcaaatcagggttcaagtctcctatttgccagaatcttctctacatccttatcaccctgatgtgaaagtcctgtgtgtgtgtgtgtgtgtgtgtgtgtgtgtgtgtgtgtgtgtgtgtgtttggtagcttctcatacctgggcctaagctgtgtcatctcttgcaaggataccccaaggcatacacaggtagttgacagctacagtcctcggtgccttctgaaccttgcatggctttattctggtcacgctgggtcattttatggcgtgggaggaaggctatggccacctctcttgctgtcctgactttcaagagtgaccttactttagcatttgaggtgtggaggccatacatgtttgagacagatgtcttaaggacgttaaaatagcaaaatgaaggaaagggttcctttgacgctgcagattagttggaagcaggtccctccctctggtgggggcattggtgactctgctctgcagattagtttgaagcaggtccctccctctggtgggggcattggtgactctgctccctaaatcttgcttcactgtatccttgtgatatcgacaatcctcagttgcctcatgagtcaccatgcagctgatcaggtggctggccctgcctgtagccatgtccccttcctaacatgtccccagtgggagacaggttgtaaaaatgacactaaaaatgggatatggacatggagaaattatttacttcattgaagaagcaacagagatcacatgtggaaagacttgggctctgggaatcataaattgccaggtttctctaaattcaaccagacaattaaaatcctccatttcactttagagataaaaattacattaaagcaggcaatggagataaagtcttaggagaaagtgttcgtgttcgacttgatgctggaaagcccggatgagggacgtgtttgctctgcatatttatttaacctctatgacatttgattcttctgagaagagcagcaataatacacacctcaacaaggctgcgaagattaaaatggagaattatataaaagcaccctgctcagggtctaccacatactagatacttagtaaatatccactcaaaatgcatccacatgcatgccttaccagttattatagcttgctactgaaagaatctatttagccctgaccatcacacctaaaactcgggttgctgaagacaaacacctgtgtgtatttgtcacgatcttgaaaatcttggtaaagttgtcacaggaagtgaatggggtcttatctcttggggacccatagtctcaagtggggaacagtcatgggccaggatgtgtgggaagtttgcacaacacagagaagcatagctggctttgagatagtggtatgaatgatgaggaaacttctcagagatgagggtgagctgaacacagacttccggggcaggggggctgtacccagacacatagaacattcgaggcagaggagagagcatgaggtaaagaggggaggtaggcaatcccctatctatagtgacagcctggtacgggtaggctcaaagtctatgggtgggtaagatattgatcaccagcagaggagttcaaagccaggctggttgctagtgctctgcatgggctggggtttgctaatgtgttgcagtctgtcttgggggaaataccgtggactctgctcatgagatgagaggaaataggagggaggaaggttaaaggaatgcatctaagtccaaatgtgtgccaaataaggagctggggtgattagcaggagcttttgtcccagctccttccaatcaagcatccctcttctcaaatcagcttccctctcccatcctttatatgttttgagaagaggtcttattatgcaggctgctctccatcttgtaaggcccctgtctcagcttctagagtgctgggctgacagacatgtgctagtgcactcagtggcttagatttatttatttttagtcagaaccatagttcaggagatatagaaactgtttgtcaatctgtttcaagaaagtcttgggccccaggaacatgcgagggtcgtgaggtctgttgatggtttccagtaagcctgtgatgctaagatttcttctccccttcccttcctgtatcctcagcaatggaatggcagagacacagccctcatggtcacccgggtggtcaaccacagacgcttctcagccacagtgagtgtggcagacacctctcaacgcagtatctccaagtatcgctgcgtgatccgctcagatggtgggtctggtgtgtccaactatgcagagctgattgtgaaaggtgagtaccgctgtgctacaactttcccgagtggctggttataggaccttctctattattacaaagcaagccccttctcttacctgttgcttccgtcttcccccaacagctcaagacaggttcgccatcactgatctccctaacactatccgcgtgcgcgcgcgcgcgcacacacacacacacacaggggcaacctccaaatttgacttaaatttatttttcagatcaagataaacacatgtcctttgtgctttagtgatgttccactgaaatgtttgtgaggggttttaaccggaaatgccgtataatggctatatttcagaaagccttttgaaatgatgatcctaacctcccagatggtcttaagtcgatggttatcagttttcttgtgcttgtttgccttgaaaacttgacttcaagtttctggcaaacttggtgtttgagaaggtcaaagaacctttaggaggcagagccgtaagtcactggggtcaggctttgagaggccatagcctcagccttagccaactactagtttgctctctctgctttgtatttataattaaaggtgtggtttctcatctcctggctctgggtgccagctgccataccccgccccccaccattcgggacaccccttctatgacctcaagcccaatcaaacttttcctttcttaagttgcctctgatcacgtatttatcatatcaacagaaaagtaactgatacaaataccatccaatgcattttcctccatttaaaattacttttaattaattaattaattaattaattaattatacagtccaatagttacctcctggtccaccctcccaaacttcctcattttattcctcctccacactgtctccaagaggatgtccccaccccctcatccccactcttccccatccctgccaggcctccctactcactgaggcctcaagtttctcgaggtttaggctcatcttctcctactgaggccagaacaggcagacctctggtatatatgggttgggggccttggaccagctagtgtatgctgcctggttggtggctcagtgtccgagagatctcaggggtctaggttatttgagatttctagtcttcctatggagttgctctcctccccaacttcttccagcctttccctaccggggtagggaaccacaggggtcaaccacagggaccaacaacttcagtccattggtgggctgtaagtatctacatctgccttagtcagctgcttgttgggactcttggaggacagccatactaggctcctgtctgtaagcacaccataggcccaacttgggatccatctcaaagagaggctccaagatctgacactattactgatgctatgacatcttcctcttttcaaatgtctccatctccatagttgtttaggcatgtccaggtgtttctgttttggtatttcttcccttgagtgagcaacaattattgtttctgcacagtccctccaccccctatatatatatatatatatatatatatatatatatatatatattttgtattatacagaaccagattctttccttagatcaatttctcaggaagttgagttggtaggccaaagcatatgaacatctttatggatttttcttctctgtactgcagtacaaagaagggcttgatggtttatgtaggcagcaacagtgtatgaatgtattcattttatcgctgctatgttcactgattaaaatttcagtatagcaatatttagtgaatgaaataatgaacctgttcatattatgccagctgtagaataatacctgctgtgttggaagggagggaaaaaattgcttgattctcagaagacgacgagtttctgctgttgctgttgctttgtttttgtttgagcgtgggttggtggacaaactttgcatcctcttggctgggtccgtttgactggtggctgtaatgggatccgaatggagatccctgtctggacccctggaccctctcttctgacctgtcttgactctaggtgaatatccaagtggaagatgatatagtgtcactcacatcaccttacctcctttcctgcagcgatggtttcaattgattgtcagttcgacaggctctagaatcatctaggagacaagtctctggctgtgcctatcaggagttgcctttaggatgcacctgtgagacattttccatattgagtcaacatggagaagatatgttattcactgaggtcctggagtggataagaaggagaaagtgagtcccctcatctgtttccatctgcctcatgactgtggatgaaatgtaaccagctgcctcaagtcgctgctgccatgactacatatcaggatggacctcactctggatctaaacaaaggcctcctttacattgattttgacagggcatcttatcacagcacagaaagtagataattcacctacatagctcatatcccacttcacaagagccacttccctctgcgtattcttcatctgtctcccttttgggacctaagctctggtagagggagggtgatatctggactccatgagttgttcccactcaagggttatccctagcataggttctgtgctcactggacccgggaagttgctaatgtttgactaatttcatctgcatgggtccatcaattcatgagtctcaaccttcagatttctgtggcccgattgatatgtgagtgaattattgacttcagcaggcatttatttctttaccagaatgttatgaacctttaagccgaagatcaacaaataaggtggtcatgaacaaaataataccaaaaaaaaaaaaaaaaagcacctttaagttcatccatgggaagtgccattaatgtataaaagaagccaccactttgatagtgttaggcttagatctttgccccctccaagcccccagcttcatgagattgattcatgtgacacagtggcctttgcaggcctttcaaatagtccatgaatgtgtcatttcctgagcggtggccaggaacactctgctcactgtgctttttcgtggttgatttcccactctgctatgagagccttgcagaggaatgccgcattctcttacatttgctaccatcttccaggcaccttgcatatacctgcttggcgttaagtggaggtgaggggcgggacagactccaggagtcactgctgcacccccaactttttatactaacagaaaaatgcttgctctgttcttttcccgagtcttctagggggaagaggtggggttggggagtgataattcataggctgctggggcagggggattgcagaagcaagaccgcctaggcctggagaggtggcagtgggaacagtgctctgtcgtctgttggctatgccaactgaggcttagttaaggcaaggtggcaggtatcagctctggccccagatgtattggccgagtacgtcaatgtgacccagaagctattgctacttcctagctccatttccatgctctctcctttgagatatgctggggagaccctatggcatccccacagcagacaatggtgcactgggactttctgtaatctgaacccctttaatgacaccttgatgaaattcatccacatttttttggcacaggatttcacatttttttagtgcctctttcccgcacattttaatgttgagtgggtgataagccatttgcttggtcccatgaatccagaagagtcccttcacatatgctatctcattttatctaaatatcaggtgtgcatactaattttatttcaacttctttgttttctgggaaagccatcccagcaggggtgaggagctgagggtcaccctaaggggaaagctgaggttagagttgagtctgaggtgtgccgccttacttatattggaggacctaggaattggggcctcattggctcccggtatcacaatgttataatcagtgccacaggggtgcaggcaacaggggaggaggtgatgtctctgccttcacacaagaaatgagaggcagggtcactcaatggtacccgtaggaagccagtcagcctgcagtgcttgtccagtagctacttgaaggcagaggatgagacaatttgaggccagagtcttatgaagaaggccactccccactaaaatctttagccttggctgagtcagtggcctacatgctgttggagcagtagtccacattgtcatccctcctcttgagcggtgacagatttcgctcatcacacagacagcctgaggagtcaggcatgaacatccagctgtggctttctttcacatacacagtaatgcctgagtcaagatgcctcacttggaatccctggcctatctcgacccattgccgtaacttggaacatgatataagcctcttaaggccttagcagatacatctggaaacagcgttatagcattttctccctgggaggatgttgtgagggagcagtgagatgatcaatgcagaagtgcttagagctgtctgacacttgtgctctaagaaatgagcaaatgaatggcacatgaggtcggtgtccccaggtaaggacttgaaagactcagtgagtgggactgggcatctcacccagtacctccattgccttggagatatcatttaaggctgttgcttaatccccatgtcgtaatacttgagcataaggaaagagggaagatgtattaaaatgtagccagggagcatcagtgttagatgctcttaagtcagagttctctgggtcctctctaatgtctacctttggctgatgagtcacagaagctcaggagatggtccttctgtcacgaacatcacctggttacatggggtaccttttatgctttatgtcattcattcaaactctgcaagctagcataccctcatgttgcctggctcacccagcatccgagcagagtgaaaatcacagccttggaagacgcagactaatcttagcggtgggtagtatcagcgttcactaggcaactcagcccgaaatgaaagcaaattggaattacttaattctgaagagctgtttattgagttgtgataatgtactggctatatgttagattactctgtaattgaggtttcactcagttgacagcccatcctgtgcctacctgttccaggccactgctcataaatgttcgtattctcccctacctgtttctgagcttgcctgtgtcgtccatgccgtggtattttgcttggctaaaggacatggctgtcctaaaccagagttactcagctgcattctaatagtcacacattggtgatttttaaatgtggtgtccaagcccatttaatatccttccaagtgctcagaacatttcactatggagttagtgtctctaaaaaaatgagaggtatgtgtggatcatcaggtgagtccaactgggacataatggttgagtcacgattagggactgcagattagaacacacctaaacttcaattttggccttagtttctgctgcctgtggcaacttcagttagaactcacatttactcctggccccattttccttatctatactataggatctgatgggttccatcctagtctgtgtcctattgctgtgaagagacaccatggtcaaggcaactgttataaaagagaaagtttaattggggctggcttacagtttcagggatttagtctattatcatgacaaggaacatgctgtcttgtagtcagacttgttgttgaagaaataaccgagagttctacccctgggtctatagacagcaagaagagaaagaatatgggcttggcttgggcttttgaaaacctagatgtccacttctagtgacacacattctctaacaagaccacactgcttgatcctttcaaatagcactagtcccttgagaccacgcatcaaaatgtatgagtctgtgggtgccactctcattccaactaccacagctcccttggccagagaaacaatgtcacatgtatagactctagcactaggtaagtacccacaatattatgtctgttattatcaacaattttattttttgccattttttaagagacattgcccaaaggctctggctgttgtttcttgtcctggcttaagggatgctgttccagactgtggagatttcaacttaaattgcatttaggactcactcttctgaaagagagaggaccaaggtcatcagatccagcttgtgggtggatgtcagaggcagagctgctttacctacaatgttcagtattgacttgtttctgttgttttcttctttaaatattgcttttcatgcttaaaagcatcttcaagatgtgtaaagattctccacatctgaaactaatcatcttgcaccctgggctggcgacagagggctatatgttctaagcatgctttctctgcagctggccgccctcttatcttagtctattttgctcatttactactcttgagtctgtgtgttagtcactgttttattgctatgaagagacaccacgacgatggcaactcttaagcagggaagcatttaattggggccttcttatagtttcagggattagaccattatcatcatgttggggagcatggtagcctgcaggtggtcatgatgttggagaagtagctgagagttctccaaccagatctgcagggaacaagaagagagacattagacctgggtaggcttttgaaaccttaaaggccagccccagtgacacacttcctccaacaaggccacacctcctaatcctttcaaacagttccactctctggtgactaagcattcaaacacatgaccctatgtagagaccattctgattgaacccaatctgtatacacttgagttcacagctatacttggaaatctgggatgactgaagccgttgactccttatcatcttctttttagttactatttattgagtcaagaacgtgtcagatgctatgatacgtttgtggtgtgactagacgacacatgcaaacttacagtacaaatcatggagtcatcaggcacctgttacatgagcttaagcaccttcacaataaccctctgaagcaggctgtcaataaccccctctacaaatgaaaggagcaaagatgaatatttctcaagctcacataactttcaagtgacaaatgtaagcctgcctatctctcccttctgtttcacatttcctacaaaatccagaatggtagaagtgagcaatgcagtcctgaaaagagtgggagggaggctctgagtcgtcccataagtgatggatcctgtggccttggcaagtgtgtggacagagataggctgggtcagttttgaaacacgacaagcaagaatcaaatgaagagatatgcaatggtggcatgtttgggtgtggcaatgaaagttctttgcatctgcataagagctggagctttattctaaaagaatcatgggactccagggcacccacatgcgtggttcacagacagtataccaccatgaagccagatctctgcgtttactctgcattcatctgtggacctgcctgtacacagtggctagcctttccagtaaggtgttctcaggggcagtgcaggggggatgggatgtctagagtaggattaggagcttgtgggtgaattcaagacactattgatttagcatttgaacagagaaatgccacccaataaagggggcattggcccctttagaaccctgggtttcagttttcctggagagagagtgtgggttttaaaggtaggacctgataggatgctggagcattgctattcgtcccaagtcactagttgaggactccttctatggatgctgatgtcctggatacaggtcccctctgcattttggagaaagtctggtttaattgagaatgagatgtgagagtgaataagtcagccgaacacacggaaataaaaaggtctgagatatggggatgggacacagacattctccagggactccacagtgtgtgtggccttctgaaacatccaaagctgctggctgttgctcctcagttagagcaattacagagaacaaatgctcgctagaagaggtaatgccaaatgcttccatgggtgtgttcttggagccactgaagcactacaaaacctcccttttaactagacattttcccccctgtggcagtagtcagaggcaacaacaacgacaataaaattatatagggtgtagtgacccagaggccaggcttggggttcaagaatttgggctggggtctagcttcattcctatatcagtatagaaaccaccaccctccaccacctctgttcttccatgtactagagcagattggcaagcttctggcatagggcatgctgctgactatcctcagattcttggggcatccagcctctgttgtaactctttccctctactgccacagtaaaagcagctatagggaatatacagatgaaaatatacaggcccgtgagtcccaaaactttctgtctagagacaggaagagggctggatttgttatgccccattctgttcagctgcaagagtatcccagccttcttgcttgaatcttacctgactgaggtctccttttcctgtagcacccttagtgacaatttgaaagcatattttacatccttgtaaagccttcagagttgaggagatgactcactcattaaaatacttgtcatgcaagtggcagggaactaagttcaaatcccccacaacatatataaaggcccacaatgatgacacctgtctataatccctgaatttggaaggcaaagacaggaggctccctggagcatcttggccagatagcctacctgaattggtgatttacaggttgaatgagaagactttgtttcagaaaatgaggatgagtgtgatggaggaagataaaggtgctgatcagctgcacacactcacacataaatataatacacccttacacacacacacacacacacacacacacacatacaggtcagaactggcttgttatctttcagtgaagagatgaataggtgtattagagaaggggtagggagactaatgtgcaactggggttcagaagacaaagaggcagaagtctgacctaaaggccatggcaaacagtataaactgtgttctgcgtatgatataaactgctaagggtgatgtggtgtttggtatgcactgtgtgtgtatgtgtgtgtnnnnnnnnnnnnnnnnnnnnttgtctgcctttgtcaacacagacaatgagctatctgggtgggttcctgtcctgagattaccatttctcccataactgggcccaacctagctctgacccaggctgaccttgaactcaggaatctgcctgcttttataacttttttgtatttttcttacaagctggcttacagtgcagctgcctctgttcttttaggtctgtgaaactcctcatataattcctattacatccttatattttacatagttgaaaaactatatattcttgaactcatgttttcagaattctttcccacagccttaagagctgtcctgaagcagtatttaccattttgctaaggaatatagacacacccttgccttctggacgcttgctgtttttgattatcatggagtcattaaccttggaggggagaatatttctcacaggaaaaacataaagctacacacacacacacacacacacaagccttatgtgcatagcaatcatcaactccagtggaggcttatgccctgctgtctctgttccaggggcagtaaccatgttgcactatcctttccacatggccaaacaagactcagcacatattgctcacttaatggtcaggaagtaagagcagaagagactaagatcctgtagttccctgggtgggaaaccctagatgaccttatagcctgctttagttacttttgtatgacaatagtcaaaggttcaactgaagaactaaaggacatatttgtcttagctcatactttcagaaagcttaatctataatttcttgactctatgtccttgagcaaaataccatagtagtggcagagcatgtggctaagggaatccttcatgaaagacaagagtcaaagaaaagaagctaactagagaaagtaagtaaccagagaaagataaagattcccaaggtcatgtctaccttcacatacatcctccaatggcccaacctttttattttccaccacttcttaatgtatgataccattgaattatgaatcctactaatccatttaataggtcacagatctctgatctaattgtctttgaactagggttctgctgtagataaagtagtagagggctctacctatcttctaggcatttcagttttcaggtcaacttggacagtagtaaccgttacagacctcccagtaggcttcctcttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagaccagcttattttaaagaagcgaaaatgtggataaataaaacctgacaagtattggttcccttgaattattttgactacttcatcagctgcatgctgatgtgttgaattaacagttttaacgcatttggaaattaaatcaaatggcagttgcattaaatcctcatccacttggaacattaccctcccgtgttcaaatggaagactgatgggggctagggaatgagctacagaggctgctctcggctggcacttgtggaccctcgattgtgcactagccactttgctggctatctgcacatgcgattttacttaaccttcactgtagtcttgaattgcacatgaagatgctgagttcctgctcgtcagtctcatgaatcacaaaatctaggtgtgcccacatagtggtatcatgacagattagatttccatacctgggaccggggagtcttagtgtctatgagtgcaattcatatatactatcaaatacctatctctcttacggtacatagcataactctgcagggacgaatggtgcagccccataggtctaagagacagtgggggaaacattggcccataccaactccatggggagatttctttatccctgatgttttggtgttgagtttcagttctgtggcctctggccagaagtggtatacagtgtggggaaaggacagtggagctggttacatataaggaagttattcatcttccttgagcccaagtctttctatttattctgatttgagaccttagctttcactttcccattttcctactaaatacccatgaagacatctgaaggaaaatgcggactaactctccaaggctgagatctatggaattttcctagtaagtctcaaactaatacaggtggctagataaccatcatttgactctgcagcacagctcctggaaacagtattccacctaagtctggaagagaacaaggagaccagcccctgtgaccaaggactacatttcccaggctgcttcactttcattagggccctgcatatcaaaggagcatcagtttaagagctgcatgtcctctcatgatcaatcagtttaaaagtaggatcactggtttccaccttcactcttgagaccttgtctgggtgatgataataagcccaagcttccaagagatgatggagtcaagtactcaagaagcctagttccttgaatcactttctgaagaagtgtctgctgagcagggctattatttaattattatttatttaattatttgtgtgtgtgtgtgtgtgtgtgtgtgtgtgtgtgtgttttcagctacaatgctttagggattatttgttacagtagctaacagtatcctaattaatacaagttggatcaagaaaagtcattaacgatgcccctaggcttaacctctttaaccaaatatttctagcctgttcagaaacagatggtaagatgcgtcttcccctagccacagacactggactcaagttcaagctagatacaactcaaaagatgaacaaatttttttttttttggcagggggatgtcgaatttttaattgctttattgcaactagtgtttattgatgcctccattccctcactgtaggctaattcacttctaaaacttgcagcatctcccctgaccactgcttcttaactgaggttactttcttctgcccacggtgtacacgtagtgatatcagaggcagatttggtttttatacgtgggaaatggggggctgaggggggggggctacaaattcaaggacatgaagacaaatactacatctttatatgagtgacaggggttagggatagcattggctatcatccatgaagctcaggaatcatggggcttaggtagagattgacctgatgggatatgttgttagctcagccagaagtcaagatactgcattaaaattccaagaactaatggtttatgcatggggcagggcctgatacattagttagaatgtccaattggtcatataagctgtccttgtgccggaactcaaccaatattctcattcttcagcccaggctgactagccaaccagtgactccatggagtatgcaatggtggggagaggaactagagtcaaatgctttacatttcttgctaccaacaacttagcaatgattcctatgatgtaactggcaacacgtggacatatcagcaacacaaaactgggagcagtcagtaggaggcagatgccacaaagcaagaatccagcaacttgggtgaccctgatggcttgcccatcaaaagaggttgcttgtactagtgtgacattattctgtctcctgcccaaggtatgctcattctcatccagggagcttcgaacctgtgcatagaggaggtttatctgagaagagatgcaactctcatcatgtggtcaagtaggcagggataacagtttctcaggtccatagttggggagctggattaaaatggtgagcttcacttattctttgtctttcttgaacaacagaatgtattcctaaaaccagtacaagaaacaaatggcacagctctgtggaattgcaggctcctggaatagtataaaatgcatgtttctttgccacctgggcaggtggatttctttgcttctttatttctttaacgccttcttctctctcttcccccattccccccccccccccccgttttatgctttcctaagcttggtaggaaagggagctaggatttggctccctctctttttacaatgaaatgtgcttgtgccaagcctttcattattaatcagagtggcatgcctgttgcttctatgtgtatccaggggcagatgtgactcactttccacccagtaactggattgtgtttctttctgatggtatgcagcctggtgtcagggagcaggcagttgctggcagagcagctgatcttctgctctcagcaagggagagcttcctcctcaagttaagcagcagcagcagaatgaagtctgcactttgctcctctgatcttgtacacacatgagcacgagatgccaggcctgggagacaggactgtagttttctatgtcttgaaagcatgagtacatgctcgttgtattgggaagatggaggctactcttttgtcaccagatgggctgttttggtccttgctcttactgtctggataatgtctgtgagtttcccagtttctccatctgtaaagagaaaatgatgttatctcaactttcctgaagtagtgtgggaatcactttttactagctaaggaaattcagagactcctctggcagcatcctctattcactgtgccattaatatgtttttttcctcttgcataggcaagtaggccttcaaagatccctgtctgtatttaggtaaggctacaacaatgtatggtcatgtgccatactttcctcttaaaccaaatatcagaaagatccttcattcatgacctctatttcatcacttcttctgttaggcaagccatatagacagaagttgggatgctgagttttgtctaagctgaccatcacagctctccatggtataactgcaatgaacttgacagtgaatgagcaacaattggaccaaacatggctcatctgattcccaagaatggtgcagatgggactaccgcagggatggctttgacccttgccccagccttgtgtatctcagtgtttgagtaaccgattctagtctcctttacagtagacagtgtctgtggcatctggtaagtgctactgtccctgcttaccatgctgtggaagcctaacagtgaatctgaattcagggaagggggacaggaaggtgctttgcttctgtcctcagctgttagtaacctctctcattcctgtgacagtgtacctgacaaatagcttcaggggagagaggtttgttttgccttgttcacagtccatcatgacagagaaaggtatggtggctcaagtggctcagtgcatggtgatgtgagttgcgtctccctcacatccatggcagcagatataaaacaaagagctcaggttggaagtgagactgccctgtaaacaagacccgtctcttctgtcccttgcactgcaccctggtagacaatttcttctagctaggcctcaccttctaaagatcgcacagtcatccaatacacctgtgccagatggggatcagctattcaaaagggagcttgtagaagccatttgacactcacgcccttacacttggcatagaggctggctgccagggtggctgttctttcttgctgggttcacccttggacacatttgcactcatctccaagactttcttctgtgagtctccctcttctggactgattacccacttttgtctaccaccagttttttttgtctttccttctgttcaacttacactgttcgttatgtgacccaccatacttacaggcctggagacaagggtggttctcccaggtaccttcccatcttattgctgagtcctggtctctgctgacattataccctaacttttgtaataagcagagatggcgtaaaatgcaggtccttccttttataccttgagctgcatccagcagttggctgtgccttgtgtctctataggctctgccttcatggtctcagcccaggatgctacttttccactctcttcattctgacatgactggacacttctgactgactctagttcctttgtttcactgatgattggccccactgtctctggaaaccatggagtctgccctgtggttacactaatgtctgcctttgtacgttgtggcccatgccaggagctcctttccaaggttaatctgcaaccagagagtccaccagaagttcttctggttgttaagggtggggattagctttcttttatattttagtatatttttgggaacttctattcctatggctgcatctttctttcatttctattcttggtgatctcaattagctctcttgccttatacttcctgtctatgctccaccatcacatttggaactcagctccatttccttctgtctttctttctccaacacacacacacacacacacacacacacttttgtattttactaaactttcaaagatttaaggcaatgagagaagtgtacagcagagaaatatcaagggcatgaatagttaacaaagagtccttgctttgacaggtgcctcagccactgtccactgtctgagtttgctttccattgctgtggtaaagcataattccccaaagcagcttggggaggaatgggttcatttgtcttacacttcccaatcacagtccgtcatggaaggaacttagctcggaaactcaaggcaggaacctggaggtaggaactggagcagaggtcatggaggatcatggaggcttggtcctcaaggcttgctcagcctgctttcttacattacccaggaccaccactggggtggcatcacccacaatgggtggggcactcccacatcattcactaattaagaaaatggaacacaggctttgcccatagtaccatctggtaggggcattttctcaattgaagttccctcttcccaagtgactctagtttgtatcaaggtggcatacagctatgtatcatgtgcaccccagcagcaagagctaggtggcccatacaggcctcctgctgtgctgctgtggcctcccccccccccccctttcctcagaggctcccaggcagagcagtctggcagcagagagttgccttgggccttgtttgcacagctcatttgtgccagcctcacttgccagttcctccctctggctttggattaattccctctggcagaggcacggctctcccctgcctttcctttgcatctcagaaacagaaccctatctcattgccaggatgagtccacccaagcctccatccctcgtacctcctggatttgcccaactctgcccacactctcattttcatcctgccaaagtaacagggctggggctagaatgcctgaacatggtggtaggatgggaaaccaccctgtccgcatcttgagtgtgagggacagcatcccaagtctagccggatggagacacagaggtcatggtgtagaccactaggctacctgggcaatggagtggcttctcagatagagttactttctagatggagttgcttccaaatttcatttcaaggctctagtgctagacctgagacttcctattctttcaccatttatggctctgttcctcattgatgctcccctcatatgtgctagggcaagtagagttgggacagttcagtgtctatactttctacttattgacctcaaagctaagaaagcttatgtctgttcatgtcagaatatcagtcttagcagaagttcttgtccattgtgcctgggatgagcatctcagattagcatagccattctgccctattggccagggttttgtagccaagtattgctaggagttgaaggattcaggttgtctaagaaggtaaaaatgggatacaggcgctctttctccacagtaaaacaggagggagcagctgtagaaggctgcagcggtattgtggaaggaagttcccctgggaaaagacaagcatgggaaaaaaaatgagaacagataaatagttgggaatttttgtgagttgtgtcccctgtactcagaatacttttggaaataatctgtgttacatctctgctgtaacaagtttcacaagcttggctcttgtggtaggccattttagaactgaatgtgtttattatttttaatttcacttatttattgattgattgatatgtgtgtgtgtgtgtgtgtgtgtgtgtgtgtgttttcacgagcccataagcttagtgaaaaatctccttttcttctcactgaattatcccactgcccacatgggatgtgtttagcactaagttttatgttcctgtcctcttgtaagagtcttagtcctggtctcttctggcttatgccagggcagagggaaataacttacagagataaagagcttttctctctccagagcatgtggcttgtagacaaggactgtttacatatagtctgtgacctaaaagcaagttatgggatgtcccctacttaaatcccagctctgccccctagtgtttgtgctggggcctctccccatcactctgcaacccccttgtcatgtctgcaaggtgcaatgagagtgtcatctttggttagtcataagaaatgtctgagatgacatggccacaatgatatctgtcagctcaccattgtctggcctcatcccacaggtggggcttattgaatctgagcacacctgcccgcaacttccatttgtgacctctaggacgcatgtacactcatgtactgggtttttctctgcccttctgtggctaggcatctctgagctgccaagcatggggctggcgttatgggcaagttttcttggcttgtgggccaattgatttcatttccatctctagcaccatagacttctctctgtgtgtttctgggtgcagatgtccctctgcttgcaatgaatgtagtcattgaattgggtcccttctgtctcctttgctgcatgccttccacagagacaacttccaaataaggccttgttcatagagaccctagggagtagaattcaaacatctcttcttgcgggggcacaattcaactcctggcacatatatgtcttattgatttaaaacccctctcccagatgcttgtgaattattcttgtgtgccttagcatctatagaatacagacaccttttcataatatgaaatgccagtgtatgccttcccaggtgtgtgcagaggccacagagcatcttggaggtgtgaacagtcagcagtgtaattgcctgtgcctggagactagttctttacttctttctcctctcactcttaggtcttgtcttccttcggctctattggattctgtctgtgccttgctgtcaggtagagctgaacccttcttcatagtgaccctcagggcagggagaccatccatagattgggccttgtgtctctccagctatagttctcaggaacctttcccaaaggctccctttcacagccaggctgactttagtcctcctccttgccactgctagatagtgacattgcttctcacagggcctagctttgggcgacttcttgactttttgaggatgcctggtccatccttgtcatccaagatgatctctgtcgtctgcacattgtgttgttatgcatcaagatccttaaattatgggttcaacaaagagaggtggttcggttggttctgtgttccctcattatccgtcccttgtgctggacacactgagaatactcagaggataaatgctgtatcaatgcaagatatggggactagagatattattgctcagtcactaaaatgcttcccacacaagcatgtggatctatgttcaagtcctattacccatgagtaagctgggcactgtagtgtgggcctatacacctagcactggagagtcagaggttagctagctagccaaatcagttatcttcagcatcagagagatgccctgcctcaaaaaataaattgaagggagattgaaggtgacacctggtgtcatccacatgagtgtggacaaacatgcacatctatctatagacatatgcacacagacattttcacacacacacacacatcgacaaaagtaaaggcaagatggttgtgtgtcgctgtctgtgttttggagaaggcaggcaaagcttgccatggtacttttctggcagacctgtacataacccaccccagctaaaagccagccacaggtattatagtcagcctaccaggctttgctctagaaagcccttccctggcacagtccaacacagacactctgcatccagagaggacttcctcctggcagccgtccccaccattacaagctatatgtgcacccagatctccagctatctgccagaaacctgtgctaagaccctggctgcgtccagtttgtctcttcttctgcaagatgtctatctctagggagaacactattggtggatgctctcttaaaatgaaatggttcttgcctggatgctctgaataactccaagttttgatacccacttccttgtagggaaaccatagagccatggttaagggcacacagttaaagctgtgggagttggcaaggtgagtggattcactatctagagggagtgcacaccacactcatagccacttggatggggctagcccccacaactgccgggggatgtctaagactggcctggcttccacccattcccttggagacagtagcaccaagagctgcaagctactacagacacctaatccaaggaaacttctgttctaattgctcttttcaagtggtatgcttgtagttccctggggaggggagggggagggacacatagtgtttgtagcaactgctaatgacagggctactgaaaaaagactgtctatttttagagtgaggcttcagcctaaaagaaataaaaataaacacgcagaagatttattttattttatttatttatttattttagaaaaagtatgttgaaataaatcaattccacctcaaaatttctctctcctggtgatgatggaatggggatttatctggggatgaaggtcaagatatatggggttaagtcatggcttggctgtagactgatagtgccaagagatggcacttcttctatggatcttgagggaagcttggatgggaccaggcatggcctaagtcttttccttcctataatctaataggcttcatgggctccagagtcagctttgtccagccaagatgcccgtgttttcctggggactgttcccaagattgtcccttaagtttatgcctcagcatttagctctttctgagttacagtaaacccttagcaaatactttgactaatgatgacaatcaacataatgtctgtggatgagacccaacagttactgagatactattgtctgtccagtctttgctgggtactcagggaacactcctgttttggctctgcagaagttttctcccttgatcccaccccaaaggtagagaccatatcttatttgattttgacaaaggccagatggcttgggccttagactcaaggcttctctgtggcagagggttcccagaaaaacttttagctgctgtcagatgtttctgctccctgcctcacctactgtgcatccttagaagaaacaagtgtcagctgatccttcagcccagttcctggaaggggcagatggaaaagcttttaaaccaatctggatccaaccttggctatgcctagctaagctgaaactgatccatagaactgaaagcaagaactgagggcccatgtccattatttagatttgtgattgcttctgtagcaaaggctgactaatagagtactttaaaagaaaggtattggacatggggagatgagtcagtggataaagctctcgtaagtatgaggtcctgagttcagatgtccagaatctacataaatctgtatgcaatatgcaatgatgggcagttccatagtcccagtactcctgtaaagagacaaggtgaaaggtgagaactggtacccaaggttgtcctctgactttcacaccatagcacatgcatacctggacacgcgcgcgcgcacgcggacacacacacacacattttttagattaaaagatttaggtaactttcataataactatgatattatttcttaatatcatattgtgaaatatatttcataatatattttatattatattactatgaaatattatttcataataaatattattaccacctaattatgcccatgaggttgtgttaaatcttcttatagatcttgccaagttctgaccttctcaacctggcaaatctacagccgtagtgttctgtggggttgtggtctataggctgtgtgagtacatctgggctgcaatattacaagtgatgctgttggagacgttctggagtcatgaagaggttccatttcctgtcttcctactggtgcagggaagagctaagtttagttttccagtcctgcactttacagagaagacctggcttttggaagtcccacctgcagaattgccaatgacagccttccacacgatttactgccccagaggcccatgaggaccacagtcccagagtcttgtagctcaactattgggatggcttctcaggaccttgggacctgctgaggctgtgtctgaagtcagatttctgggccctattggctgcattcatagtaactaaaagacagtctgacaccaaagggctcatttaaataatctcatcccagacttagcattctttttctactgattaaatatgttctatgagagcaacatagagtgtatcctgtctgctcctccctccctccctccctccctcttttatctccccatccttctgtaatctctccctcctttccataggtccatttcctatagtcatatactattttttgttgttgttgttgttgttttgttctgtgacccattagttatagccagatctatatttgtggccacaggtttaaaattagcctttggatcctgatgggcttatcatttggtacccagttgaaggcaataactatcccttccccagaacccataggttaccaatagttcagcaaggaaagttagggccccatgaacccttcctcaattcatgattggatgttgcttggcccagtcttctgaaggtccagttcaggcaaccggggctgctgtgagattgtttgcaatggctagaccatgccctgaagagtgttttgcagtccttccagctctatattctttcttcttactcctctgctctattttcttccttagaataggtggtacaactgtcctgcttggggctgaggattcagttatcatttgttctaagtatgttgttcagcagcaatgatctaactgttcatgctttgacccatagatgaaccctgctctcacccttaatcagagtagctcctccttgcagtaaaaacagacctagcgttcttatggacctgtgacctgatcatgtgcagatttggggtctggctaccacccaggactcctgaggtctcctctggacctaggagaagtatcagtccactgctacctcagagaccatgtcctgtccttgtcacctcacagcatgtggctgtggcctgaattcctattccaacttcaccccctgcagcctcgtttctccccagatctaggttctgctgtgctaactgctcagaaggctggcttctggtataactgcttgaattacatacaagcatggggacctaaactcaatcccccagtgtccctgtaaaaggatctggatggagacatttgaatccctggggcttgctaactagacagtctagcctaattaagaggcctctagacaatcagaaatctctgtttctaagtaaatagccaaacaccaaaacaacaacgaagccccacaaaagaacaaagtagatagtacttcctgagaaatgacacccaagattttactctggcctctgtgcatgcatgtacacacacacacacacacacacacacacacacacacacacacacacatgagagagagagagagagagagagagagagagagagagagagagagagagagagagagaacacagaggaccatgtggaagaatataatagtgttgcttgtgaagtgaagacctgtgtgttgataaacccagaaggttttccttagaagtcagcagcctccattggcagcaagggcagctgatggagccacagaaaaaaaaatatattgtattgatttcaaaaaagcaaccaaagtgagagttcaaaatgccttctggaaagcaggcagcccttggctctggtgaggtgctaatgagctccccagccaactccagccgacctgcatcttctcagagaaagacccagggcccagcatcaagagggcaccagcaagagggctatagaggccatgaatgcagagaggcatcctgggctcctaccacccccatgctctgaagtcttttgtttctttttcttttatcttcacaagaggaagcaaagtgtcagcatgcagtgggaattcctccctgtatcctgttctgatctgtttgcttgtataaatgagctcatctttcagaagagagtgggcctgctcctctgaaggagcagaaactggaggatttgcttattcctctcctgtggtccttgctacttccagcatcctgaggcgagatatcttttccatgtagatatcaagatacacaggtcaggacatggaacacaaatgccacctctggcagaagtgagcacgcccactctatgccggggcatgcacctgctttaaagcaacacttcatccccaactccagatacaagatttcattgtctgacttccacgtgacctgtgcatcttgatatcttgcctttcttggatttccatagtaagataggtacttggagctctgtgcaacctataacactcactcacctgtcgcacagatgtcagaggctcgagactgctggaaaggttgtggtgtctgtccctgttcattgtaatgtgagcatctacttttctttattcaccttgcatgttgaaattgatttattttttctaatttttgcaagatatatttcgccagcacatagttaaagtcttacacctgaggcagatatttctgccaagaccccctaaacatagtactttaaatcatcggaacctacttccaactctgaggcacaagaaacttaccagaccactaaacactgtggagctaagactaatcttttgtttgtttttttgtttgttttgtttgtttttttgttttttgtttttgagacggggtttctctgtatagtcctggctgtcctgtaactcactttgtagaccaggctggccttgaactcagaaatctgcctgcctctgcctcccaagtgctgggattaaaggtgtgtgccaccatgcctggctatgactcatctttagatgctctactttccctctacgctctgtgtcccttcaccttcctctcactgtcatactgcaaagctcagtttagcttcaacctgccctctgtagatttgttcaatcttcacaagcagatgagaacatcccctattctgagcttttccacaataccctatttaaattatatattcggtgttacttatgtattcaagtacttattgagtagctactatatgcccagctacccagagattcagagataagaggtgaggcaaccacatataccataccccgaaactatcagtagaacttttgccatgatgggaaatggtctaggtttatggtgtatgggagcagtcatgtatggataatgagtatttgaaatgtggttatgagtaaggaattttattttaaacttcatatgctttcaattaaaattgtttgtttaagcattcacgtctgttctttaggagtcaatagactgaaagtattaactgactgaccagaatagtgttacaaattgcggtgagggctttctgggaatcaaacagagtgagcaatgggaagaatgactttggacatgagagtcttcttagaggaagtatcaggagatcaaagatatcaggagatcaaagatgtcaggagctgtgggaggagcacaaagccaaccataaagggatgagtgagttggaattcccaggttggcatggccatggagagtaaaggaattgagggcaggcagcatgactagagaaggtgggtgtgtgacaggacggtaggctggagagagccatagaatcacatgactcttgtccttagaatagactgataaggacgtgctggaaattctcacaccaggcagagaatgagccagacatcaggcctgtacattggctggcagctctatgcttctacaacacatggtttccaagcttaatgggttcctggtgttcatacccaatgctgagtctggcgtcggcctcatttaaattccacgcccgtcccagtctcaggcctaactgacttaggctcctctaatttaccgagcttctgtacatgtcaggctagggggcctgtctgcatttgtctctgtgaaaaagaaatactaccatctctactggggctatctcttctggttgggcctccttggtagttaagattctagaagcatttagcacaaggaagaactgctgtaatgacaagtggatccttgtataaccttcacttaattgagtgaagggacagacactgcaaagacacaaataaaatttgggcaattagagtatgttgagccactggtaccagaccaatgtagaaatcatgcagctagtccatgcaacctcagaggagtctggttgtactcagggaggctgtgcttgcaggccacattgagatgtttgtatctttttttttcaactttcctgtcattcccatgagtgatactttctttttagaacatccttggtaggaagaggtggaaagtaccgagacagaggtcccctgggagctaaccctgggatctatgctctgctactttctagaagtacatgctgactaggtcaggttccttcttcgtgaccatgagggaaacagacatggatttgtgtgtttgatttcagacttgtctcattttatgcctctcttatctgtagaattgggataagcctacacacatatgagggcctttgatatgactcaatattgcatggcaggctccaaatctaatactcagcatttcttaagtgtcatagtcttcgctgttactgttgaaagcaatgctcgtgtcaacttggcataagagtggtcctggcaaaatgttggaattcagtcctaagtgtatggttcagtttttttgtttgtttgttttgtaggtatctatctatgttgtgcatttattatacatatttccacatgtgcaaatatatatatgtgtcaacattgggcatctgtttagttgctatccattttttttttgagacaggttttctcgttggacctagaatcaatggatttgaccagactagctagacagcatgtcccaggacctgctgaccttcactccactggagttacacgtgtcactgcccccaatttccttctttacatgggttctagggattcaagctcaggtcctcatgctttcatagcaactactttacctactgatgcgtgaagcctttagcactgatttttgatctgggaggaggcagccatatgaaacgtcattgtattaggcatgtttctgatgcctagataaaatgccatgaccaaaaccagttggtttttttgtttgtttgtttgtttgtttgtttgttttttggtttatgatttcaaatgggtaagaagagtccatcatagctggagacatgatagcctgagaagctgagagctcacacttggaaccacaaacacgaagtggaaagactgaaatggaagtggagtaagacctttaatctcaaagctcaccccagtgatgcacatccttcagcaaggtgacaccacctcaccttccacaaataatgccactaacacttgggtgccaagtgttcaaatatctagaactatataggacacttctcactcaatcatattatccaaatcatattatccaatcgtattatccaaaatatcatgagaggatctgtcatctggtctaagttcaaaccctgagctgtgaatgagcgagtcccttaagtagtctctcaccttttagccaaggcccaatcagcattcaatctactcatggtttattcccatttgcctacccaaatctctctcctcaccagcctcaaacccaagctatatgcgtgggagaaggggctgctagggttttgtctccacattctcttaactttggctcctgggaggtgtctttctgtctttgtatgcaaagagagctgacgtggagtcccacacattgcagtctgatctatccccattgttggacacacagcaggactccacaggcaaatggaaaagaaaaggcttgatcactgtttattttccttaattttcattgtgcctcttttatttttacccttgattataagcaacaaaaacgttcctttccatttgtctttctcacccccctccccttttgcagctgttggtttgaatagcatccactagactgaccccaccccccagactcagaatggaaaaaaattagctaagagggaaacaagaaatacatttttagttcagggcgggagcctcattttgccaatcctgcatccttctgtggaacaacccaccacttctagggacaaagagatttttgtcatcctgattgttttctttaattcctttttaaatttgaagacaaacttgattgctctatgatccagtcttagcttttatagaaaagccaaaggactggtcagttggttaagactttgcttattctcatattgtttatttactccctctggccttcatatttattcattcatcaaacaagcttgtatacctgctaattgcctgtgttttacagtggttacagatgcaatttgccagaatgaatgactgtctaagggcactcactgcctggctggggagacttctttgtgaaccaaagattgtaaggaaggataaatagcaaggcagtaagacaatggttgtggtcagtgcacagaaatgctgtcctatctcttcactcagcttctcattgactgtgtagcctttgttaagtgagcctttcctccatctgcttccccctctgttataatttagcagtggtgggcgtggcctcagaagagcctggggattatatgaggtatgtccaggtgcttaatggaacaccttgtgtagtaagtactatgagcgaatgtgcaaggctgtcacttttgttgttgagtaaggcaaacaaagatggtggcactccaaagatactggttgagtactagaccccatcattgatctatagccatctgcctaacttattattattatacagtgacaaccattgtgtcctctggtgagacagtgccaattcttactggtttgaaacctgcactccaacaggtttggctacttgtcagcaataagccaattagtactgaataacagagagaaaataaaaggagagagacagagggagatggagggaaggaggaggaagggatgaagagagagaaagagagagagagagagagagagggagagagagagagagagagagagattgattttcaatgtgattacattagaaagaaggctgtagagagccactgactcccccttctcgatcccgacatgagggtttagtttaaataaaatataatagacacacataactaagcagcccagaatgtccttcagtttatgatcttacctccaagaccaattcagaaattgtctctatccaggagacaagttcctcttctggccactcccagggcttcagactttttttttttttttccagcagggtatttctggggaaattctaactcctgtcagtcatcttataggcaaagagagaggaacgggtgtctctttggaatgtattcactcctgccaggcaggctggttatagtattcaaggtttagcagcattggcaatgcctggcacttgttagaaatagaaattctctgccgcacatattcttcttgattcagaatctgaggttagggtcctggaatctgctgtaaaaaccatccagattatttgagttcacactagagtttgagatgcacatggtaagaggtaaatgattacaggagtccagcatggaatctgcccaaatatcggtgcttgatagaggtatttatagctgttagccctgtgagagcaaaactaaccagcagcgaagaactctgccaggatgcagcagcttcttggaaagttcaatttgagccatctccaggaagatgattataggttttgaagaaagaagagaactgagtggcgataccatgtgagtggaagcatagtgatgtttggggattataaagtgtagtacttttcaagtatacaatttcaggagagaaagatgcttggagatatagcaatggacatgcatgactggggtcatgagatctgacttcacatcaaggatatgtgagctatgcaccagagacaaccaaaagctattaaacaaaacccacaaagatcaaatttggaataggttgaagtgtggtagtaaaaatattcagtgggcaagtagaaatgagactctaaaattgccagtctaaaactgttactgaaatcgagcagttactggtagaccagttgttcattttgaacacattctatcatctgcctttctataagcatatgctgatacctttagtgctctagatgttcagtattattcatatgaaatcagtgaagcaacacctttaccctcccatggtctctaatctcctgggaaatatgacaagtgtgacatgttatgtttaaaaaagggtgtaacccatgttaatctgttaatcacctgacatgctttaaatactatctctaatgtaatcactgcttttttttttttttttttaatctgctaacaaggtgcttagagtgtcccacccaagcatcaccttagctgtcaggaagtttcagagatgttctgtaatatcaggaatgtagcaaagaagatatgatgtagagtttagggattcttccctgatctgactggagcatgcagattacagaaaaaaatctggaagaacacattgaagagtgaagagatgggcccaaagccgccccaagttcaagacaaaaacagcctcccattgtgctgccaacaggaggaagaccgtcaaaggccattaaaaaggtggatgctgttatctcatggtattttcagcaaaatgtgaggcttctaggggagcagtaggtaccactctgagaaaggaattcacgcatttctcctttgcctaactttcttggaatctgtgtttgtcatggtctcagagggatgagtgtggattttctttacttctgtgtctctttagcctctaaacaccatatgtaacatatcatcagttgagccataacagccagcacatgtgtgccctgaggttggaagcaggaaaggctgaaggagatgtggatgaacaaggagacctactaggtagtaagaaggagacctactaggtggtaagatatccacattctggttcatatagtcccaccagcatagagaatagcagttactccagttttaaagcagggtacatgaagtttataaaggttcttaaccaggaatgatggtacattattgtaagatggatgcaggaatattagggttaaaggtgagatttggctatatggtgagtttagggccagcctagtctataagtgacactgtctcccaaaaattttaagataatgaaagtaaataaaaatttcaggttaagtgttatgctgttagatggctggtccattccctttctgccaaaggtatttgtcctcaaaatcctattctcttattgcagggagactcagcgtctttgatgggcaacattctagccagttctgagcttgaggccccagtgattggaagttaagtggctcccagagggggtcaggcctacatcctaaacaccagaaactgtaaatacattttcttagatgataaaggggacttggcagatgtgactaagtatttggagttgtgaggattatattgagttgtttggactcagtgtaatcatagggggttaataagtgagaacagagctcagagtccaagggggaatgtggtaagacagagatattggaaaggcaattttggcatcttaaagatggacaaaggggctaccagcaaaggaaaccagactgtttctcaaatttgaaaatgaaagaagtgaggaccagattaccatctagagtttccaatgagaacacaacctggccaataccttgaatataggatttatttcccctgctggaaatagcaggatgatgtgcttgctttctgctaagtccctaaatgttcagtaatttgttacaacccaagaggtcacaataaagagactacaatgtggactcataatgacctactttgcatacatggacaaggtcaggctttgttggatattgccaagctggtttatctgagactctcttttcttgtctgggaaatggaagtgcttggtttccattagctctgttttggctaccatgtccctaatctttagctccctcacagatgcatttgcctgagactctactccttccctagatgctgctggcactaaacatatttccgaggccactgactattcccttaacccatgtgtgcttctgtcaagaacttaatggaagggctatgttgacaaatgagagggaagacactggcatggcgggatatagcctggaggagcagtagagaaagctgctgttctctggagatcgagaaataggtgagtgaggaggggctccaagaccagcaagagcttgatgatccagtggggatggcataccaaaaaagtgccctagatcctccccaacaaattttctgccatagcctctcatgggctcatccctaccaggagacacaaaccaaaggaactcagagatgcaaagataggtttagaccatcaggtggctatagcaaaacagctggatgaggggtcaaacagatatgagcacaaaggtatagctgatgtgaatgcatgttcattgctatttaatattccctaacaagattaatgtcagtggtggcatacttaaataattagactttatgtgagtttctgaataaaataatattcttgctttgcctgttattgtctcccctgtggctgagaacacagtaggtggcccataaatattttgtttaatgaatcagtgaataccttgaaaatcacagaatacttacataatttcatttcctcatcctaggacctgcctcagaaatatcacataaccttcctaagacaaaacaatattatcagaaccagaactaaaattccagtacgctgggtctaagctcagtggtattttcagcccagctcagctgatcaagcctcccatggaggctcctcagtggcctcttgctgtgatgagttctgcctctaagacttagctgcccaagctagacaccttctgtaggaagacacaaccaatgtatctaaacagaggcaattggcatcttactggggaccacactgcacataaatgcatgcagcttggcttcagtaagtagaaaggggaggaagaattcccctaactacagagctaaagagggttatcactacagctcttgagcatctattgagtgaaggagcacttatttgtcagatactcaaaagagaacagagacaaaatctcaggagtatggtggggccttcattgctgcactctgtccatctgcccttgagcaaggtgtcatagggaggggtgtagccaactgtcccaagcctaggatatgtctgtgttctacagtggccatggtccccagagaaggttgccttagtggtagcactgcagcctctaggggataacagaccatggctgacctgctggtcacttcagagctggcagaatcaagtccaaagcccagttttctgtgttacgtttgctttcatgttagtaaaatgaagacatttgcaagaaaacatgaagactaaaaagtcaacatagtaatcagaggacagcatcaaggctgtctctaacaaggtgggggatgataacaaatacccaaatttccctctgacctccacacatgctgggcaggcacacatatgaacatatgtatgtgcatgcacatacacataatagaaagcagtatagcattgacatacactcattacatattaaacattgactttcccactctgtatgtgatcacttaattagggctcacagcaattctgtgatgtaagtatcattatgaccatgtgtcaaatgggaaaatggctaagcttttcagccaagtttgagatttttacttgctaaagtcactcatttagcaagtgtcagaggtgatactggaactcaggtcatctgagtctaattagcatgatttgcctggactagtgcttactccttggcaagcagttaaaatttaccatagttcagtggaacatctggcatatgatgacccatctctgagatatttgtcctattgatttttgctgtccaacatggcagccattggccacatgctgctctttaaactcaactctaagtagattaaatgtcattaaaaataaaataaagcagcactaaaaataaaataaagcagcacttgtgtgaggagacataacagcatagcaatttctggcttcacaacattctgttggatagtgctactagactagtggccatcccttgtttggtcagttagtagacaggctgaacttagatcccgcagaacttacagagggcattggaagaggattctagtcttaaccaggttacgagaaaacagaatggataaacattctctttgtggacaaagttcctggaaagatcacagactagaaaccagagactcatggaatccagatgcagcatcagatggcaagggaaggggctgtttccaggagtcaaagggactagtgtaaaaacccaagagatttatctgtgaactcagcaagagctgttctcgaagtctgctgtgggcgaatctgcttcaaagtgtgtgtgtgtgtggggggggagcagtaaagacaaagggtacccacatacttgtctgaggccagcactatttgtctcaccttagtattagtttgaaatgtcgaattattctttcctctgtctactaaagcagcactggaattttaccaaattcatcaagagatttacagaccctgcagcatctacgatactgcctcattgagtggttgaacttttcctggcagatgaggaagctcaagggaattacaagtctggagtgtaggtcactgttaagaaggtaaagaaaagggccttctgatatcacaggggtattggtagcctccaaagactgccccagtaggacatgaggacagatacaagattgtgaaccttgtgggaatttggaagtaatctctgaatggtccggcattggggcaggtacattaggcaagggttcatcaaatggagtttaatgactgtgtgaaatggatctacctgatagatggatgtgcagaagtgtctgtaaaaccaggagatagaggtaaagagtatgcctggatgtgtgtttgtttgagagagagggagaggaggagagaggagaggaggaggaaagagggagggaaatgagagtgaaaagaaaagaaaggagaggggggaagggaagacagagtggagagtggggaagaggggagagaaaagatgagaagggaaaagagagaggggaggggaagaaagggaagagagaggggagagaggaaagaggagagggataagaaggcaggagagagggaagagggagagaagagatgacagagacagggggagggggagggagaacttcatagggggtggggaaaaggggagagggggaagaacattcttgggtacacataactcaagtgtctttttccatgcaagtagttcatgataggaatgacataggaacatcagtgctgtgatgacagatccaagatcttacggagcatgcagattacatggaccaatcaccttgacaccccaacctgttctaactgaccctctttccccaggctactttcatggttgtgtctttcttgaattgctgtgtacctgcctgttcagatagaatcctacaggagagcatggctgctcctcccagtcctccacccttgccagtcactgatctggaaatttcccaagtgttccctgcctgcctctcagagcttgcactgacctgcatcaccgaggcccacagtgacatctatatcctccctactaaagcggatcaccctccacttgcttctgtcctagacagcctctgtcctagttccctaaacacgctgttcccgagaatcacctgttcttcacattgcctccctgatttctttaagatcactttcccactctccgttctagcttcaaccttcattacacatttctaagaaccactttgcaatttgtctctctgtccaggtcagagcaacatttcttcttgacatcattttacacttgcagatgctacatctttctgttgttcaaacagtgctctctctctctttggaggagtgccacttgcatagaagcaatcaatagttcagtcccacgttcctctcatttgatgcttgtcaacatttgtcagttgtgtattttcttaggtatcttctcacatagacaagctgtgagctcagagcatcaagtatagcatggtaggtgaacagtgtaagtctgaggtctctacctacctaagttcatcggtaacctaaggtcagctacagtaagtggtgatcctaaacctattaggcaaagtcagcaatgatcaaagtgtcctctgcatcagcatcactcaagaacataattgggaactccaaggcctgagaccaaccttagacgtacagaatcagaaactctggtatggctttgcagcctatagtgagaccagctctttaagtgatccctctgcacattatagttagagacatgcttactagaggcaactgccatagcataaaaatatcaacaaatatcttgcgattcaaatggaagaaagtttaccacttaatggaaactctcctctctatggtgacttggggcccaggctcttcttatcttttgtcctccaccaccttctctgctgcatcaaatatctagtgagcagtttatttctgttgtttgttttgataggcaaagcctgaaagactgtgtgtgtgcacttacttttcagtgtctggaactcaactgcaatggccatacccatttgcatgggaaccaaagaactcatgggtttacgaacaatgttatttcccagagagatggtatttatcacccatcgaacatggactgagatctcttaacagcagaccttatctgtgctatggtgacagaggagggtcttagtcacccaattaaaataatttagacaggggggttgagagataccagcacaatgcacaagagggatccagagaggtgattagaggctcctccctcagtgatgtatttgtgaggtaatggaggatgaatggagacagtctgttctttgtggttggcacttctgtgccaaacatgaacttatggtattttgaacactatataagagagaataaaggatgaagaaaacaaagcttagaaaggttaagtggcttgttctgaccatacagctagtttgctctgtgtgtgtgtgaatgtgtgtatgaatgagtaagagagtatgtatgtatgtgtgtgagggtgtgagtgtgagtgtgtgtgtgtgtgtgaatgtgtatgtatgaatgagtgagagagtatgtatgtatgtgtgtgaaagtgtgagtgtatgtgtatgtgcttagaaccccaaggatttgtattttaatcaacaacaacctagtatgctattagtgtaaattctagcagcgtcccctctgatcagcatgaggaatatggagctcagaactggaaggaagtctggaagtagctttatccatgtttccgttagaagctttgggtattctaccttagaatttgacttcttccttcagagtttctccctttagaaggaatcctggctgggcatgatagcctctgcagcacacagatgtcagcctcccaccaggtccctttcagtcacattcatctgttttcatttgctctaacaaatacctgaggctgtgggttttgaatgaaaaagcatcatttacttcacaattctaaagacttggccacgtggttctgaacagctctcatggtggctgtcaatgtggccaggaacataagcaacgagagataacatgctgagtcaggaagtcaaagaccacagaggggatagtctttctctttatataagaattcagtcctaaaggaaccaactcattgcctgagaccagcattatcccgttccttgggcaacatccttaatgatatgagggcgccttttcctctaaaaggtagttagcctgacaagactcaatatatctggagcctcctgtgctcatatcccactgtgaagtccagttcccactaaagggatgaaacatcctccacttaaagtagggataaaagatagaggtaattttggccacatgtgcttgctagcctggcttgggtttggggacaccttttttttttttttttttttttttttaaaaagaaaacaccttgttgaattattttttccatgtgttccctgtgtacaacaccaacagtattcttttccaacaattatccagtcatctcattacaactcttaataccccttcatccgttgaggcctgtgcttctggcatataaactttttggggaacacaaacaaactgaatataaacacctagggacacatttcagctccctttagaagctgagtcttctgtgtcaactgcatcaggcccacccacaacagggactcctcatcatttttgaagttgcacagccagagaatgagctcaagtctacacaaacccttcgtcaactctagctgtgcctggtcccttccttaagatgcatgcatggaggctccttaagtaccaactttcacaactcaaagctgcactgttaacaggcttgtctgagttccctctgagtgccaggtagtcccaatcaacattgagctaagagaaatccttcattttggttaaaaaattagattaaatgtgctttttcaagtgaatttagatattgcaaagctgtccttgtcttgtaaggcagttacttctaagttgaaaaaaaaaataaatgaagtattttcttggctgtttttgttttttaaaaaatcagagtcttaaatatttcagccatctgttctctattatttctgcaactctgtgctgaatatgtagggggtggggtgggagagatttaaatggccattgaaattgttttaagtaattaaaactgataaaaactgtaagtttttacctaatccctggatgatttgattggagtcagccagatgtaaaaatgcctgcgacaaattattctgtgcctatatgacatgcaattttgacaaaatatctttaaaacagctgctaagtatgcgatctggggatttgacagtgcagaaggacaattccgtggactcaggaaagcttggcaaaaatccagtctaactttggtcattagaatgaattgtgttcattcaagatgaaaccatgtgtggataatgggaaagcaagtaagactcctgacttttctgtgtgcagctagtatgctgttggtgcatatggctgggtaatacaagagttctggtcaacctcttcttttctaatccgtatggcattttcctcattgagctctctataattctaacaacagccggtgcatctgtgacacccatcttactttctgcaatttcttgcttaaatgtgactctattttccaattattggctttgacacttactgtcatatgaccttgagtttgtcatttagctcataaaggatgaatacacacacacacacacacacacacacacacacacacacacactaaatgtctgttatgcacataaactcacagtttgggagagagaaaattatcaatgtatattagcctcctcttatgttctctgtcaacattctagaggaatgtttcctttcaaggatactaacctccttaagttccctgatagaaatttgatgtgtttctcaaatatgagagagtaaatggttggcaagtgaagaaatgaaacttattttctcagtatctctcctaccaacactgattgtcccaaacttaaggatctgtcctagttcttgccagtatgtggtgaatgtccatgatagggttgcacccatcctatgcagcatccaccactttgtcagaggacctatgcccatatctgttcttacttgtttcagcgtatcacgtgacttcatcctctgtgctcctgaggccttccttccctttctgctttctcctggccaggccattagtgatttcatcactgtccctagcctataactcatccctgtatccaccatcctgagaaagaacactttgcttggtttatcagcatgaggattgtggtggctataactcacagctacttgttatttgctaagcactttaaatgtgccattctgtttagttctcctgacaccctttaacatagatgctaagtatttccctctatagtactgaagaaactgaggctaacttgcttgaggactacagcttagatctaactctgtgccttccaggcaggctttgtgaggaaatgaagttcacagaccactctttgcatcccttcagaactgggaccccacgactgatgtcttttggtcttgtccctgtttctccagttgaaacttgttgcccctacacatggtttcttctttcaaatgtcagatccccagagtgctggctccataccagcagttgatgatgctttttgcttcatgatttttctatgacagatcccatccagtctcattattttaattatgactagagttgctgatgaatctcatagccatctctcttgcctggacaattccgccaaacttccagttaattacctcccagagacattcttgcagatgaccacaggcacctccagctgaacctgctcttcctgtagttttgatttccattaatgatctccctacttatttcacctctaatactagaaagaaatccgagattcattttaagttcctacctcacctcatcttcacatctaatcaatcagtgtggtcctgacattttctctcctatcgctggacagaattctttactatcattacctaatccctacactgacacttgtcagccctcaacttcattcttgcagtggatttgtagggtggtgtatgtctgaaggtaaatgttgattttgaagctgtatgtaagtacataaaagaacacaaatcataactgaattcacaaaggtagggaacacttgaccaaaatgtgatatataactggcaccctgacaaccttttttttgcatactttctgcattaattctcattctcaataatgggatttttaagagtctctcttttctgtttttgaatcttatgtaagtagaaccatagtgtatgtatgtgtatgtgtgtttctgaccttattcttcattaaaaatagtatttgtgagtttagctcattgtatttggtattctgagcattcattattttattcttgcataggtggcattgtgtgtacatacaaaacatgttcactctcttctaaagacttgtcttgctacctattttagttttactgaacaccgctgttatgatcattctatacgtgtttgtctgtatagtactgtgactctattcctttagatatataatcaagaatggagctattctttgagttaaacaggtaccaacagatagaatgggttattgttgacagtcttgcaatgttaggcattctaatgttaggcatatggagagatctcactgtgattttaactgcattatactgaagattgttggattcaacaccttaacacagacacacacacacacacagagattatgtattttctttctttctttctttctttctttctttctttctttctttctttctttctttctttctttctttcttcctgtctgtctgtctgtctgtctgtctgtctgtctgtcatatatatatatatatatatatgaaacaatgttcttaaaatattcattttaatatttcctagctatattctgctctatgttttggtcacatttaaaaaagaatttattcattgaaatgaaaatattcttattttatttgagaagatatattattctacattccacactaagcctatgtaatctgtctaaggtgatttttttaaagtgagatgttatgtggagatgatgatgacccacttcatccatatggatatcaactgatagtgtatgatgacaaaagtattgttgcctcaattcattgtacctttgcaatgtgttaggtgactgtaaatgtgtgggctcatatctagctagatcccccattcttttctgttgatatctttgtttattaatattttgataactcattgtcttggctatgataaatgtatattacattttgaaatccgcatgaatgctaagactctttaagcataaaactaaacaacggctaattattatctcaggtatctgtgagtgtgctaggcgctggcagagagttgctgagtttggcaacttgtctctatttaagctgtgaatcaggccatttcagatctctgttctggaaaaagcatcttccagaattaaggattctcataggaagggcagaagggtaataaggcacatcctgctgtatatggatttaacaagctgagtgttgagagcagtgctagaggcacaggaaacatgagcaaaaggtgctgtgctctgtgctgaaccccactctctctttataagttttgtactaactgtttaggctcctgcatacttctctatacatgtagacaagcatgtcaactacttaaaaagaaaaaataaactttgtgattttgcccccatattttcattttctatataagaatttcgagaaaacttgtcatttactgaaaataaaatttccagtccatgagtcttagttaaagccttatccattgaggctttataaaaattaattaattaacatatatatagaatcttaatacagtgccaagactgttttcttaataaaaacattactgtatttttatttgcatataagtaaatgtgtgggcacacatgctattgtgtacatgtggaagccataggacaacccatgagaatcaattctctcattctaccatgtgggttgtgggcattgctctcaggtttcaactttggtggcaagaaccattacccactgatccatcttgttggtctacctggactgttctcagattctaggactcaaacgagcttcctgcctcagcttcccacatgtctgaagcagaagacaaaggctgctgtaccgagccttccagtagtgttttaattcatttacttcatttttgctttctttgattttcatctttggtgagactgttttgtttttcttcagtactggggattaaatccagggcctggtgcacaccaggcaagtaaactactaatgtgctgtatctgccccctcttatttcttgatatactttttctacctttgtttttttcagtttgtctccataacataaaaatactagacaactgtactcattagatcacatgatgctgcctggcacattgagtctcattatctttttatttttcagtcttttttttttttcttcactccatggtggtcagattaagtaatttctactgatatttaattactttcttttttttttttccttttacttaccgttaacagcagaaaaagtgctactaacaccagaacaaagtttttgttttgggtttggcacattttagtgatggaattgtatcaccaatccactcatccatccatccacccatccattcatccagtcatccatccatccatccatcatcaattgatccacccatccatcagtctatccatccatttaactttctgttcctctcctatggctcccttttgttctttcactattttgaatttcttctcactccctcattacatatataatagttattttaatgtttacatctgcaggttctaacttctcaataatcttgggggaccatttatttctcagtatttttgtttattattattttacttcccatttcttcacaatgagcccagacaatatgctctaggcagtctgatttatgtcaattttctttaaacggtattgaattgtatcctggcaggcagttaaattgcttggcatgtcctcctgaacctgtcaaggttgttttcttccttgttaagatgtatctattttggtttttgtcagtcatcttcacatgcggttctcactttcagacatggtacccatgactatggcttgttctttctggagcctcaactggagtctctcccaaagagatggagatgcttacaacgctcccaagcacctaacttctgatctttctgatcagctatcaagtctcctttacctactctttgttagaactgatagaatacttctttgcatatatacaggctagccattgtctaaagaatggcaaagaaactgttttctgatgattgggctttgtaagctacctccccccaccccaaaacacacacaccatctctcagattccagtctgtctctttagtgctgtgagaattgccatgctgggcttggacaccaccttcctgtgttggatctgcagaattctcccaagcagggagttaccacaaatccaaatgcatttgtatttttcttccattagtgaccaaaatcccatgctgcaatattaaaactcagattgttttgtagcttattaattgttttgtcaggggatcaggcctagtgcctgtcagccagtcatggccagatgcagaagtccttgtcatagcacagagaagattgaagtcatcatgtttgccatctgccgttatacagtgtgcactatatcaaggtgggatttgtcctgtttatggttgtaccctcgttttctagtacaacacctgctgcagaattggtacataaacaatatgtattgctttgatccatagccctgccccatctggacattcactaatccactgaggatagatatcatggttcgttgagtgagcaagtatgcgactggtagctggccccagtgaatcttgcttttctcctattctatgaactaacttttcagaatcataaaaagaaagcacaagagatgcaggttgagatgccacccatcccacagctgcctctgatctagtggagacattgaggccttaagatgccaatggtgtgctcagcagccacatgctaacttgagctcggcttagatcccattcctgcttccttctttatagtcatcatttttctaatttttacattcatcaaaatactttataataaaacagtctaagagtagaaggtaaggcataggaataccaaagagcagaggattgtgggaagtcaagttgtacagtgtgcattgagaaggagtttaccttatataccacagttttgttaccatgtgcaatgaatgaggagtgaatggctcagaattccatccttattacagtctgttgctgatatgggcttgaatccaggcatcctaactgagtggtgtagatcccagggtaccctgaatgttaagagtagttggcgcagtctgccatcctaccttgcatccttaactcattatggcaatatactgagcctgactctgggtacacagtgttcttaatagggccctctcgtaggcagctgtgctgttttccattctttaaataacagagaacctgcagctggcaagtcaaagggagtagtaagacaccaaacctatattcagcttgcacagaatctgtggcctgagcccatggaactttgggaaagagactacaacgcattgtgcaacgggaacctcttcagaggacagagatattacttgggctcttttcctaatgatacatctatccaggtgtccttgtatctcccatgtctcttctgactcattagtgcaggtgacaagaggcatattgtgcaccttgttgtgaagtgggattcttgtcacatccctgcttctaataacatcacattatctagacatcaagaagtggagttggggagggatgcacaaaagatactaatcaccagggactctgggccaattgaactgcatgcttggccctatccataccagctttgtagatttcagctaatgagtctatcttagacttatccccctccttaggaagcagaagtgtcacattatcagtatagtagcaggatactgtcagtgtcataatagtaaccaagaccccaaggtcagagatgaggaaggtttaattactgtttgaatcccttggtcattggcctacacagttccttctatcagagcccaagatagtggcacatccactatctggaacccagtggtgaccatgatgaagaatcaagacagtttcagtactttcacttgaaaactgctacctcttcttatctctttgggggtggcacaatcagcattgataagtaggtcaagatggtaagagggcagagtcaacagcaaccacctggcagatggaggctgccaggtggagccatggaggagggagctgccataggtcaggtcactaagagcctgaataatgcattgtccaggtggactctggcatgcaggcttctgacttgctttggttatcaaagttagtaaaatatgagggtgatgaacttttgctttgctgaatggaaacttgaacagctactgggagagtaaacaacccttatcttcaagatcataaagtgatatacgaagattaaagacaggtctgtgtgcacgtgtgtgtatgttcatctaagtgtataaaagtgtaaggaaggttcagaggccatgccaggtatcttctattatattttttgccttttttttttttttttttgtgaaaagtctctcactgaacctggagctcactaactttgctaggttggatacccaatgagctcccggcatcctcttattcctgcttcttctgagctgggattacctatgtatactactgtgcctgacttacatgggtgctggggattgaaactcagctcttcatacttctgtgatcaacacttccctgactgaggcatctctgtaacctcaaagacagctttaaacggacaatcctgtcatctagccacatttgaaattcttctgtcatttgtttgtataggaatttggtggatactccaggagaagagagtatccttctattttacatattttaaggtaatgttgcatccacaatcattttgtgtattcctttatggtcttggacatatttataatttaacagtctcataaaaattttggcagtgaatgtgcactcctgtgttggttttctcatgctgtgtaagaaatgacttcaaacttggcagctgaaaaccaaacatccattatctcagagtcctgtggtccagaggctggggcacagtgtggctctgggcggagtcccaagtatcatcagggcaaaattgaggtgctcgccaggctgaattcccatcttgaaacttcagagagcaatctgcatccatgtgcatccccgtgtctggctgaagtctattcctggtctctgtgagacggaagaactcattcccttgctggctgtcagcaaggtgtcacccgtggctgacatgcaaccttgttctttgtcattagtcacctttcatccttggggtcagctttagagcctctaatttgactaaaaacctcctgacttcaaatatttctcatcaggacgagcctggattctttgaagggctcctctgatggtcagttcagcttagcacaatcactttcttagagctaagtgtgcccagggagatagccaacgcagaggagtgctgcccggtatgtgatagctgggacttgtattccagctcactgtccttcattgcaaccctattcatttccgagaatggccacagcacagttacacaaaagccagtgtcctatcacacaacagacagtcactcttaacacagtttagaaaatgcgaagcctctctagtcaagttaatggagcccatactccctgtaaaatctgggtgtgagaggaaaccttatctttccttttcctggcttttagtggtttggggacataagttcaaacttatatatggaacggtgtgtccattcaccttcacctgctgctctctctctgccttcccttccttaaggacactagccatgttagattaagatccaccccgctccaataggatgcctcaccttattgtattagaggcagtcttatttcttgcaaggtgacctgcggtacggggtgctgtggcatctgagtattcttaggaggaagcatgattcaagctgtaatagcagtcgctttaaaccgtgttcttaggttgtttcacaattctgtgtgatagatgacttctaatcatcacattgactaatagttctgttcattgttttctaataatggagtccttgaactgagacccctgagcagaaagattctttccagccagaaaagaaactcaaaacttgaagtgactggtgctgaggtggctctatgctcacgatcttcttctttaaaaaaaaaaaatgtattaattctttgagaagttcatacaatagaatttggccatattccctctgttcttcacctaatcccagatttaaccatcctcctcgttccccacccaaactcctgctctgctgctctctccctctcttcctccctactaagtttaatctgtgctatccacatactctttggcattctgtgtgctccggagcataattgacctatcagaggatggactctgtcttagtcagggtttctattcctgcacagacatcatgaccaagaagcaagttggggaggaaagggtttattcatcttacaattccatactgctgtttatcaccaaaggaagtcaggactggaactcaagtaggtcagggagcaggagctgatgcagaggccatggagggatgtcctttactggcttgcttcccctggcttgctcagcctgctctcacatagaaccaagactaccagcccagagatggtcctacccacaaggggcctttccccattaatcactaattgagaaaatgccttacagttgtatctcatggaggcatttcctcaactgaagctcctttctctgtgataactccagctgtgtcaagttgacacaaaactagccagtacagactcctaaagaaaactggctctcttcttgtagctgtcaattgtcagtagctccccagctgggatggagcttcacacccacctccctggacctccacgctgggattttgtccatctttagcccctgcagattttgtgcatgcattatgtcccattccccattcactgtgtttatatgtgcaatgttcctcttgtgtgcagactcttctctgtttccttctagccatccatagcctctgacttatattttactgttcttccaagatgaactctgagccttgcggtaagggcttgtggaatagatgtctcagttagggttgaacatactataagctcttaatctctgcctcaggaccatttatgatctctttgtaatacttgccatgtgctacaagtaaagcttctgtaatgatgagacatgcactaatctacaggtgtggtcatgtcatcaggatcattttaatactgcatccttctagcagattagtaatattaattctcccccagggcaatgacctttctagccatgtagtctttggcattataatagtgcccaggtatgggttctaccccacagagcaggccttacacatcttataaatcttccatataagtaccagttccatgtgattctgtggttcaaataagtggtgtctttaacaatatagtcttatggtcaagttcttaaggataacagagagcaatggcagtaatctataatgtttggagctctattggacctcagtagccaacaactcaaaagaggtaacctattactgattgtctttgttagggttttactgccgtgaacagacaccatgaccaaggcaagtcttataagggcaacatttagctggggttggcttacagttcaggggttcagttcagtatcatcacagtgggaacatggcagcatcgagacaggcatggtacaggcagagctgagagttctacatcttcatttgaaggctgctagcagaatagtcactcccaggcagctatggctagggtattaaagctcatacccactgtgacatacctactccaataaagccatgcctcctgacagtgccacttcctgtcccaagcatataccaactatcacactgatactagagtttttgtttctaccatatggttttcaatagggtcatttatatgtgtgtatgtctctgtgtgtgttcagggttggggcacatctgtgtgtgatattttaggaggcttctacagtagtaggtttccatatgactttcaagaggcatttagtactagctattcctctccatattccctcctctgaatagaaagaatagtagcactagaaaaagaaattccatttcttaaaatcacaggtcctgaggtggctaattgtttatgtttttttttttctttttaagttttatgttgtacctgcagaacacatttttgagatattagcaacatttcatagataaagcaactgcagtacaggaagaaacccatctagtgtatttgttaataaagacccagcaggaaagacagtctctagatacttcaaatggaaatggtttcctataggaaagtatttgtttatagggatataaaaatgaagaactcctagtagctgcttgggtccttagactgggtaattgaagatggtgactttgttactgggtcagggcattgggcaattctgtgttgcactgttttttgtcaaccccactgagaggcatggtgctttgtggggtgactttcctcagttctcaccacaggaccggaatgaaagcctttctcttctgagttcaattttctccccaatacgtggaaggagtggggagagatggtctctgagcttcttcctcaaaatgcagaggttgtatggttcactgtgtgggaaaataatggagctgtggttatggtatgaggaacaggagcagtcattaaagccatctgttacctcatggttttccatgcatccactttgttcccagaaataataactctaagacttaatatctcgtgagtaaatgtctaggtcagaagctttgcttattctctgattagcccataatttaattacccctttattctttatttttctcctttagtctattctaagttatgtcatgtggctggttacctgatctccagtttaatgcaaccatcttcttgtatgtctggggcaaatctccaagcctgactatcccaggaatactcactctgcaccagaatttctacttccctactgtgtgtctaaactaacaggccaatagcattttattgacataaagtacaagagagtctctctacaataatcaactggtctttgagaactgtttgtttatgggcccattgcacattgctctgccaactatagcaagaccacttgcagattgagagtggaggtataggtatgtcacctggatttgatcttagatttcactcctctcactcctggtaatgatttctcttcatacccctcttttcctcccttccccttattttatttggggtactctatttcttctggtttcattccatggacctacagaatgggctgtaacagtgctagcctcgatggtattccttaaagtctttgagtatataatctgtgtgtttgcacatgaatacgcataccacagcaagcatttagaggtcagagagcagcccttagaagttggtccttccctcctccttgtgggacccaggtatttaacataggttgtcggacttgatggcaggtacccttacctactatgctatctcactggcctactgaccttcttcctcagtggatgaacagaatagttttttaactgccactgagcagcactgggtcctttctctgttggtctttaaatgatgggagtggaatggtggacttgctgcaggatttagatagccagagctctgcttggtgttaaagggaagtcaatccccatgcctgtggactggctgtggggcagggcttcccagtgttactttgtaaagaaatgtcattagaagaattgtcaactgaagccaagagtggtgtctttcttcctcagagtgctcatgaaagtgtcagctatagtgagcagcgccttaggattcagaattgctgaccaagccacacctcttccaccatctttctaaggagccttagacctggctgtcattgtccatgtttctttatagagagggcagtgctttgtagagtgggggaagggggtctttattctaccaattataatatacaaggcagccattctggggcaaatggaagtccttttttcacactctctccaacctggggaatccagggtcataccctctctgttaaacaagaagggatctggatctgtagagggttcagtatgtcaggagagcactcatgaggtagagaagagagaccacactcaacactctgtggacaaatgagccttcatgccggcctcttacagtttcttcagcaggcatggctgctttcctcctaaccttgggttttccgcctgtgcttcagtgttttggctgacttcctgggggatgttattgagcattccatgctgagaggacgaggcccatgctgtcttggtccagtggcttgaagagtctcaaagtgattcaaagtgtagctgtcagagtgagcacgtagtgagaacacgtagagtagagagcaaaaggcacttcattcagagttcagcaagactcccacggagggtaggagaatctttagcaaggcaggtgggtgtgactgttgaatgggcatggtgattggcaggtgtacctaggtgaatttgggataaaaagaatggagtaccaaataaattagaattagggacaaacgcagtgttctgggctggcccacatttgcatccttttttgctgtgcaatgactgtgtggcttcaggcatacacttctgacttttactgtccatatctgtcaagtgaagagaaaagaagttgcagttctaatgccctggggatttaaatacttgtaagtgtggcatggccttgagccccatcacatgctgcttcagataggggctatgaaaacagggacaggaaagataataatgccgtgtcttccatctgagtccctccaactctccctgggttatgaccatttcagggcatcctgtcttttcaggaactcccaggtctcactgagccatactcatttctttttcttttttgaagcaaggtctgacgatgtatcccaggctgggctctgtttgctatgtggctaagaatggcttttaactttttattctcctgcctgttatctccagagcctgggataacaggtgcttgccaccacacccaatttttatgctgtgctggtgattaaaactcaggagcatttgggacaagcaccctctgccacgttctttgttgtacaacttctggtcccaaattcaccattgccagctcttgcagaagctgcaactgtcaatctaaagcccagggaggcgtgatccttcagcaagactcctccccctggctttgtgtattctgggctctggaaggtgtgtggagtctaaggattcaacaaaggaataaaacctctgaacccgagatctgaaccgaaaagcatcctccaattctatggccccatgatttgttctgagtaacgcacttagcatcccacggcaacgcccatcgatgctgactaattccatattgtgtgggtcatcaacacctgctgttccatcatgaacctcatctgccttcctcctattccggtttggataatgtaccttgcacctacaggactttctccagaaagagcagaaatgactcacattattgccctaaaaccccatggaaatgtattaccactcgcttcctccccagcgtgataaatctgattataacttgcagacggccactcgtggttgcgcagcggtttaaaatgtacgaaaagattcattcggctaaactgaacttgtcaggtggagagcccgagggaattcttgctgcagacacaagttgtgttctgtctgctgtagccttgtggcagctttcaaattgctgttaggaaataaatccattcatcagtatggaccgccccctggctctgccagactccaggctccttggaggctaaatgttcctcctagtgtctcacctgtcttacaacgtctgcaataatatgcccttgataatggatttctttttttttttcatttttaacattccagtcttataaaacaaaacaaagttggccaatatgatagatagaaatggcccccaatactactttgtctgatccccagatatgggttctgatagtcagacaggaacagtgacttcttctgggtcatacagatagaccatcaggaaacatgcaggggtagaacctaggcccctatgtatatgtagcagatgtgcagcttggtcttcatgtgggtcctttaacaattggagtgggggctgtctctgacttggttgcctgcctttgtatccctttcccctagctggggtcttgctgcagcttgaagtgccagggtgggttagaactcatggcgggggagggggagctactccttccctgaggagaaggggaagtaggagggaaggggagagagaaggggttagaagggtggggctgggaggagaggagggagggagctgtggtcaggatgcaaaataaatacataaatgaataagtaaatacagaaataatcaatgaaggaaccctgacttgagggctgggaggtggctcagtcggtcaagtgctaactgctcaaggatgtgggtctgagttcaaccttatctcctgcttccacatgaaaagccctagtgtagtggtgtgtgccagcagtccctgggatggagaggtgggcacagaaagaaccctaaggcttgctggttggtcagccagctagtcaaatcagagctacaggtccagcgagagaccctgcttcaaaatgtaaggtggagggcagctctgtctgtttccatacaacaccggctaccaacagtcttctgagcttttcttggctgctcctgttagagaaaagtgggaggggttccatttaggctttgctctcctgttttacagtctcttttgaataataaggtcggcttgtttaataagttcaacttcaaagtaggtcagggactttatttctgtgcatggtccattagcattcttaagtgagaacttttttttcttttaactgagaaaacatcttctgcaagctgagatagcccacgcctcctatctccccagctgccttgtcagattcttgtactcactgtatgacccagggggagaggggaagggttcccctaccccagagcttccctgcagtggcagggctaagttggaggaacctgaggagaccctaggagatacagcacatgaagccaaggtcacattaaatgaggtgtatattttgttttcgtcaaagagaattctgcaaaacccacaattgctcgagtagagagggtcgatctctatgtcaagaaacttctcaaaccatttgtgactaagttgctttccaggatctgtcacccagtagccccacaggtagaaaacaaaccagaggcttgggcttagtgctgatgccacagaggaaggacagggagatgacaccttttatataggtcggttactaaggatatcaattttgtatttttagcatggcctgaattgttgtgtgggctcattcctttatcaattgcctttattttttcttaaccctacaagggtgttagaaacatctcttaaaataataataataataaaaaaaggttggttcctattcagaatccctgtgtgagacactgtgcttggctctgtgaagggcactggcatgactggcaattgtccccataccatggtaactctattgtcagaaggacacagacaagaatgatggcacctcgcagaatggagcagggctagagtgggctacaaaagcctccgaaagaatgctccacgcttcatttgttctgtgctccttgattcaaggttttccccatttctattctctgatgtaatacctttgcttgtaaaaaaaaaaaaaaaaaaaaagacaaagaaccgccccctaatctttcagatgggactttatatcattgtaatgatactactgtagaggaaagaaatctggtagtttttcctttacaagttctcatttatctttagctgttaaaatagtggatgactaaatggttggccataacatgctgtttcagaacttgtcaggctggtgggcttcaggattttttttttttttttagtggagagttgaagggtaggctgttttagctgggtatcaggatcttgcatatttcagatatgatttgatacgtgtgaacatctcgatgtcaagtctgacttgctgcgaatgtgtgaaacatctcggtgtgccgggattgttttgggtgagtatgtactgattggcccctatactgttctgattcctgctcttcctgttgtttgcaaagaaaactgtgagcttggatttcttctctgctcttactctcctccctggccactacatcaccgtgactgtttaatccttgcagacctatctgaaagccttggaagcatcattgcatcctgtggtgatttggatgagagtcatccccttggctcaggcgtttgagtacttggtccccaggtggtggcagctactggtgaggtttaggatggtcctgggggaagaaatagggttctggagcaggctttaggagtgtctagcctggggtcatagggatggcttagttgttacagtatttgctgcactggtagaagatctgagttcttttcccagtacttacctggcacccctcaactgcctgtaactccagttccaggcctttggatactctcttctggcttcctcaggcatggcgcatatacgctccatttatatacatgtgacaaacactcatacacataaaataaaacattttaaaaggagagtatataggctcactatacttgcagtcactccctgcttcctgcttgctgttcatgatatgagctttctccttcctactccagctgccatgttcgccttgctgctatgcctccttagccctctggccccacaaatgcgaaggaacacttccttctgtgagttgcatagctatgctatcttactacaataaccctttcacaggtgctgcttaagaccttcggaaaacacagatacttttattatgattcataacagtggcaaaattatagttctgaaggagcaaggaaaataatttcatagttggggatcaccataacatcgatgggtggcagcattaggaaggtaggtaaccactgttctagagttagtgatgttaagttcacctctgtgtatctaatgccagtatcagaaccagcagtggatgcacatgtgaatgaatgggtaatgggatggtctcctgtctcattctggcttgggatttatagtagttattttctattttaggtcaaaaaccactggtctagcaaaaggtagctagggactcatggaatcaggtttgaggaaggatttggatgaagaaaggaatatgaagcctggtgctacattttctgcatattggaaacacttggggaagttgaaaccattgttagtacctgggtttaatttcagagattctgagtgacttggtaaagggtaagagctaagcctcaggacctaaaacctctgcagtgtgatcctaaatacagccaggttttgggaattactggtgtggccacaaaagctattttctaagtatgatgttttactacaaggacctttcatgaaagaagtctttattcttatgtaggggatattcttgaagggacctgggtgttagctgtatagatctgagaataattgagtggccttcacctacaggaccaagccttgtggtttcaatgatgactctcccattgcttagataaacccagtgtatgcttcccatgtctcacgaagatggttacttaacttcggagccgaccacgaggccaaaatattcccacagcacctttctggatagaaagggtcatggttgaatacagtctagctttcctgaaatcttcctggctctccagctagtagcatggaatctaagtcacatttgcttcctttaggagagtaagaagtaggtgagaaaattcatgaggcagtttgtagaggccataaagtcctccaggctggtagaaatgatgccattaaagaccgaatctttaaaaagtgttaatgctttgggaaagtcactcccatgaaccagtgtcccttcatgtgtgtgacataaactgtgttactgattaaaatctagttgtgtcttttggcaagactaaaaaaaagtacacacctttggtttttgtatgtgatttgcttctgcttctttctctgtgtgtgtgtgtgtatgcatatttattctaatgtaagtaaatatatatactatataagtagttacacacatacatatttacatatatatatatatatatatgtatatgttttatgtatatacattcttacattagattttctgttactttcccatttttgtgatatactgtgtgccctagacaacttaaagcaaggatgacctttggcttgtggttcaagttcattgtgaatgggagggtattcaggaagctcacacagaagaatgtccagtaagcattagtagccaatcactttctccttgttttcttccatctgtgacctgagactatggggcttgccacccacattcatctcccttggtaaaacctctctggaaatccctcagagcccccctggagtgtgctttatgaatctccaagcaactctcagtctagttaagttgacaacggagatctaccacaagtttcatatatcataagcttattcctgtacctcatttgcaaacttttcaccagttttcttcctttcaaataatttagaaatcaattccttatgagtattattgaatattcaaaaatacacaaaacaccggatgttaattcccacatgtgttttcctcagtgggatacaaacacggcttatcaagtgttcaagtactgttttaaatgcataaaaaataaaaaccaaaaaccaactctttggatgatgtccttcaataacagtaggctgcctctttttatttttatcccaaaaagattcaattgtgtcttttccagtctttgcctgtttgtgagactcttctttaaaggggattctgaaactgatcttaaaagaagtgtcaagctctctctctctctctctctctctctctctctctctctgtgtgtgtgtgtgtgtattgtgtgtggttgtttttttcttcattgtacataaatatttccagttaagattttgttttgtggctacaaaaaatgtatgaatacatacatctaaattattatatgatatacccatggaatatatatgatatattagtcaactaaagcttgaaacagcaaaaacatgatttcatatgactgggccagggatgctggttcaggctgattagtggttctgtctgaggtcgctcagaaggctaatttcagaagtcttttaactatctctgtcacaaagagtcattcagaggtcactcatattggtgtggtttcaacactgtgtgttcctttctatcacaccacttaaaaagtgacatagaaaggagagcagaaaggagaagagtagaaacacaaaggatgggagagagaaagaagtggggtaaacatagaaggaagggaggagtgggagaagaggaagaaggagagaggtgtgggagatggggagaaaagaaagggaaggaaagaagaaaatgtgaggacgggaagcaggaaggagcagtagggatggaagatggtggcattttgtgacctgatctcagaagtcaattcatggcattctcactgctcttatgtcccaagccagttgttatgttgagtccagtctcaaggagacagggttacacaaggctatagatgccaaggacatatgtcaggacctttctagggctgtccacatctcaaaagtgatggccttatgtattgtttaggattttcatatacaagagacaacaattttagcattctacatctctgtcttaatgcaaaatcatatgtcaaataagccctgaaaatgtgtcttacactcttcaggtccacagctcttcgtggaatcactcattagacaaggggttgtactctcatttttcccagacaggctcaatgatgggatgccaaaggacaagattgtattggacatttgccttcctggttgtatgctcttcagagttttactgtcttatatcttatttagtagtctttgaattcccaattttaaacaactatctatcatcctgattgaagccctatctaaagaaatattatacttgtaaaaaataaatgaacagaggcactggaaattttaaaagagttcaggcttatttttttactattctgtattattgacaaaatctctagggtacaaaatagaaccatgtatagttgtgtttgtaactggatgcttgagcacatttttattggtcagggatttgtaagcattactgaatttaggtgggaccaaaatttaatgtggacttgacatcaaaagcatgccatataaaaaaagaaattgataaattgaaccttaacaaattaaagctttttctctctgtgagagctcattcaaggaagataaaagacaagctatggagtaagaaaacatatttttcaaacccatatatgacagatgagtcctatttagaatatataaagcaccattaaaacaacattaaattaaggcaataagaaaatagtcaagatatatcagcaggcatttcagtgaagagcttttgtagatgtaaagtaaactcttaaagtggtcagtcactggcttttaggggattgaaattaaaaacgctgtgagctgttattatatagttaccagaatcatttgcaaaactaacaccatgatacaaaaataggaaagggcttgttgagaaaagggggtccaacaggagggcaatagtggaggataatggggcaaaaatgatgaaaatacatgtgaacatatagaaaaatatcaaagagcaaaagaaagattaagtgtgacgaaaggatggaccatctagtgattgccatatccagagatccatcccatgatcagcttccaaacgctgacaccattgcatacactagcaagattttgctgaaggacccagatatagctgtctcttgtgagactatgccagggcctagcaaacacagaagtggatgctcacagtcagctattgaatggaccacagggcccccaatggaggaattagagaaagcacccaaggaactaaagggaactgcaaccctataggtggaacaacaatatgaactaaccagtacccaggagctcttgtctctagctgcatatgtatcaaaagatggtctagtcggccatcactgcaaagagaggcccattggacttgcaaactttatatgccccagtacaggggaatgccagggccaaaaagggggagtggtgggtaggggagtgggggtgggtgggtatgggggactttttggtttagcattggaaatgtaaatgagctaaatacctaataaaaaatggaaaaaaaaaagaaagattaacaacaccagttgtcaagaagctggatccttcctacaatgttagtgggaatctcccatgttctagcctctctggaagtcagcttggctgtcccaaatttcatacaaaccaggaactggccttcttagtatctattccagaaaagtaaaatttgaagatcacagaaaaaacctgaaacttgctcctaatggcttcacgcatcatagacaaagactgggaacagttcaggtcaccttcagcaagtagactatcagagtgtgcactcagagcgtgggaatctgttttacaataagagggaatgcacacctgaatccatcttgcaggtgtgatgctatggagaaaaaaagattaattccaaaaagctatgtatttcttgagagggcaaagttgtagaaatgaggaagagattggtgacccctgttgattgaagatgaggtgggaatatggagatgaggcagttgtggttttaaatatcagtatgagacccctgggatccaagttcatcagtaatctcttttttgattaatttttaaatgcctctcattttattttagtttcttttttaacctcatagttagtcagatactattttataaaaccctgactatttatttgatattcaggcctatcacatacatgaattgactttgtacatgctgtgaggaagggctcaacactcaggtttatgtcatgcatcaatgttgcactgagcaccattctcctcccaccacagagcagtggcaactgcactataaatcaactgattatgcatggatggatatatttctgggttctactctcttctactctcttcctcgatctattcttataactgttattgaatttgtttttgacaatgccttacatatataatgtacattctgattactgtaatccttcccacactctctagtctctctcccacctactgcctagcataaatctttttctacattcatgctatttaactaggattttctgtgtgactataaatttggaactatccactggagtctagtggattcttcaatgggcacacagtgaagatgatggttgcctactctctagaatctattagtagccaacagtttatcaggggatgataaagcctcacgagtccttctctaatctgtgattgactgttaataggcccagtcttgcataggttcactggagacaggaacagatgctgtgaggtcatcactgcactgtgtataccaagtacagaggaaactgtttcagagcctgtcttctgctctcccagtttctacattttattcttccctgtcttctgcaaagactcttgagccttggcggaagaggatagagcaactgtcctgttcagagatgagcactcgactgtcatttattttcacactttgacagtcatatgttcctaccttcaccgctatcattggaaagcgaaattccgatgactgaagttgagagtagcatttgtgtttgggtagaaacataaacattttgaaggcagctcaggagcattccacaagtaattttgccccctggtcctaaggctctcagccatgggtttttaatggctatattttaaaatatgtatttgtgttttaatggtattttatgtatgagtatgtaagtgcaccatgtgactatagtgtctacagaagacaagagagattatgagccttcatttggttgttgtaactaaactcaggtcttctgcaagagtagcaagtactcctaacccatgagtttttcactggatttgcagtccaaattatgaatttcttggtgtggaagtggcctcaaatagggtcagagtagttggttataacaaggataactgtgcctctattatacttgcctggaaatttggtatttgtcttagtttggtttctgttgctatgataaaacactgactgaactgacttagggaagaaagagtttattatatctacagaaatcaggacaggaatttaatcaagaacttggaggcagcaactgaagcagagactatggagcaacactgttcagtgccttgcttctcctggcttgctcaacctcctactcagagctggcactccctacagtgggctgggccttcccatatcaatcattaaccaataaaatgcccacagacttgcctacaggctaatctggtggaggcaattccttagttgaggttttctcttcccaggtgactttaatttgtgtcaagttgacaaataaccagcccagtattatagctgatagggtcagaactaggtgaggccgtcgatgctcttcatcttatttctctatttatagtcagtaccatgctttcttaatcacgagagcttgatggtaagtcttgatattgatccgaaaagataaactttccagcttttccatttttttcaatattatttgaagtattttaagctttttccatttttatataaatgtcagaactcatttgtcagattttctatgaaactagtataagcaaaaagatctcatgtagttcaactcaaggttcaccaacatggaatttttttcttattcaaacatataaaacatatttcagtaatgttacatagctttaagtatagagaaatatatgaatatatataaacaaatgcatacataaatatatatatgtacattataaagtatctttgttgaaactttattttattgttgaagcataacacatgaaataagtgatacttataccatttgaatatctcaatttttctgcaagaacccattcatatgcctgtgacaatctgctcataaacattttcagtagtctatataagtagaagtagtcgatgctacttctgagtcagttacctctaccaaaagtgagcattagtacattttctgttattcagtaaatgatatcttgtatgttcatttttataatattttatgtgccacagatattaatatatggaacctcgctaaaatattcttgcttatcatattttgagatttcctggggagtggtttctacatatacaattctgtggtctatgaataaggaaactatcgtatttgcttcccatctttatgttttctccttgtttcattgcactggctagaacatccagtaggaacagcaaggttaagggaaaactttcagtaatgtactgtcaattatgatcttaggcttctgttttgtatgtcctttactacaataaggaacttctctcctataactttattatacatgagtggatattgactttcatcaaatatttccttggcatcttttggaatgattgaataaatttttggaaaatgtcctgcatgtatacaaggtgtctttgttacacccatcctaccccatccccagcttcctcaaccttgtaaaacatagtagcctcaggttcatctctctctctctctctctctctctctctctctctctctctctctccctcccccccctctctctctcttgatacagtttctctgtatagccctggctgtcctggaactcactttgtagaccaggctggcctcaaactcagaaatccacctgcctctgcctcccaagtgctgggattaaaggcgtgtgccaccatcgcccggctcactctctctttctctcttatcaccctaagttaaattagtgcttctcgtaattattattgagtcatccactgggacatgggcaaactaccagtggctatcacagccccaaataaaatggctcttccttccccaacagtcatcagttgccatgagctccacagccaggagagcatctgattccccttcccagttcttggttagctcttgatcatgtggggatcttgtgtgggtaactacagctgtactgagttcacttatgtaacagccacttcacatccagaggcctttttagcgcccctcccctccctctgtcttttacatcttttctccccttttcttcagtgattgtgtgatttttcctgacagctttcctggtcttaagccagtcttgtttttctcgttataaaattaacgtgatcatgaactgttctccattttattaatcgattgcttttttttttattgtgtagggtatcatttctgtgcttatcagagatgcttctcagagttactttttgtgtgatacccttctaaagagttggtaattatcctggattactcaaatgaatttggaagtatattatctattcatatttctagaaagtattttcatgaagatagaatttcattgaaattttttatgtgtataaaaatttgaaaataccctccctgtaccatcatgtagaatttcttctatgaaattgttctgcctaaaactttgttattttatataacttggtggaagccaatggatatctcattgagctcattgtgtctatgttcaggaaacacttttctctgttaggaatatctagaatattgaagggtcatgaacactgggttttcacggagctatagaagaaagactgtgggagatgttagcatgaagttatcgtttctgctcttggagtccagatcatctatatgtttaggacagagtggtgggggatgagactgctgtgcatataagactttgccgagttttgcagaattcttttgttttgaagtctttgtgatatgagcagttgcttaggctctgctggctcatctctcctggcagaatatggcagagcacagagtcagccctatggggatgagaggagatttggaagaggctaatttttcagttcctttacataaagggggcaatcatctcttaaactctccatgcaaactgagcagctatgtggataagcttcttaatccatctggacaccccttcctgacacttcagatgaatctatacttttagtcacttctagccatttcagcagcttagagactaattatgcatctcccccttgcacatagggatagaccaaggagagaaatttgcaaaataacaatatctctaaagccccagcccccactctgtgtaagcctttctctctgtgtctggtagcatagcaactgaggaagcctcctgatctgtagttgctctagactgcgtgagtcttcccttgctctctacatctccttttcattgggttttctcagacttattctagtgtgacagcatcaatttttctcctggtacttgttgactctgagttgcagatccgtgtgggagagaagttgtttttttttcattcatggacgtgaatttgacattttcagttccgtccaagatgctttgagtatccagatgctcagactctagacagcaggaggcttgagagcctgcattattagatgaccattgctggcctcagaaagggctttggaatggagagaagagccactgtaggaaacaaggccatcagctttgtccggtttctgtaatttacatttgatcttcactaagacctatcaagaggtaggctctgttacccagttttacatatgaggaacccaaggctcaaggtcatgatgtagctttcccaaagtgacataactaagccacagtgatagcaaaccaacctctgtttgacccagtgatcattcatccgtttaattctccacactgctctttgaactgcaaagaaatgatatacagggcaattgatatagagtggaaaagctatcacagaacattagaacattgggatggaaagtggataaataccagcaatatgaaccatgcaagcattatagaagtcaaagatgtctgtaggaaccgaggaccctcaaaacatgttcttatattggttctgtttcctttatttcttttatctaatcagtggccacatgttatctccatttcatctcctgaacgtacaacttgttcctctcactcagcccatccaacttcaggaactttatattcctcagacctcttcatttcttccctccgtaactggcagctgatgctgacttccttattgatctccaagtctaatttccttctctcagatctttttttctaccccacattcaaaagagttgtcccagaggaatgggcacctgtgttatcccaatgcttacaaaactttgctataatgaatactctacttggttcccattggtctctctgcttcagtttttgctgccttctcatatctcctggatttctgcaggatatgcagctccagagtaacttagacttagctaagaggaacccatgtcatacctgtgcatcctaaagtgtctgctttcaaaaatgtacccatggcttgaactcactgtaaatccctctatgagcgcttccatccaattttggcacctttgcttgtattaatagcctgtctatactataagaagtgggcacagactttgtactctaacccacataaatttcttatctatagcactagaggttagatgtctacaattctattgggctgtgttcatttaactcacagtatttattccttgacttttaatagtttctagaggtcactagaggcaagagtcttgtaggagaaaaaatgtttcttcattcatgggtctgaatttgatgctttcatttctgtccaagatgcttttgagtatccagatgctcagactatagaactcaggaggcttaagagcctgagctagatggccattgctggaaaggactttggcctgcatgcttgcctgtctgcctgtctgcctgccaaggtctctgttcctatcttctaagtcatagagaaatatctttcaatctctttccaatttttttaatctttcttcttcacttaaaatgtctgtaagtgattatgctgagcccacctacatgaaccagggtactcaagtcaatatctgtgtgtccatcatattgacagagttccttttgttctataagtttgtgaataagacttggacattatttaaggactatttttctgtatatcacagtcctttgtaagccatacagccctggtcctatgaaccactgtccattgtataacttattttcattccacttggtttaaatatattatacgtgctactctcaggttcctccaaagcgtagatagcaatttgctctgatctattttactgagaacaagtagatgtggttttcagtaattgttttttgaacaagaaagtttatctgcttagctcttatctatctgtcttgttctgtggctggttagagggttagagcaatggggcaatttggtgtatcagttaaaaccataaattctaggacagtgagatggctcagcaggaaaaatgtacttgccatcaagactgtccacctgggtcagtccttgggacttgtttggtcaagttttagaaaggtttggttcctgtgatctacatggtagaagaggacctattcctgtaagtaacccattaactttcacttgtgagctatacataaaaaatgtaattaaaaaaaaaacagcacaaaaatcttgagcaaggcaatctggatatcttggcattgccatgtactaactgtgtggacaaattacttatcttctatgcctgaactttttgatgtggaacatgaagatgattataaaatctagttttgttatgtagggtttagcaaactgcagaccacacaaggtacttgattgatggaggagtttttacacaaatgatagaaggttaaccaaggaaaagttagaaatgatagtagcccaaaatgtcagaaagcagttgctacatctaagtgttggccatccaaagggaacaagtgttgttatggggactagaagtctagaaaaggagccctggagggctagttgctgggacctctgaaggcggagtgcctttcagtagtatgtcagcagtaagggcatgatctgtgttttgctgatacttccagcaagatgctatgctattgtagcattgaagactggaagaaataaaagctcagagatgctgctgccttctgctacaccatcaatgagataagacaggagcatttttatcctttgtctagctccttgtagggcagtagttctcaacctgtgggtttcaatccctttggaggttgcgtattagatttcctgaacaccagatatttacattatgattcataacagtagcaaacttatacagtagtaacaacataattttaagtatcagggttgtcacaacatgagggcctgtgttaaagagtcatggcattagaaagtttgagaagcactgttctagaatctactattactaggcacctggatatatgatatgaagagttctagtatagagtcacagagctgatcattaaaaagtgagccaaaagaccagagatgaatgacaggcacattcctttagttttctcatctttaaaatgcacctaaatagtatttatcttatggtatagtataagaaatgaatgggttcatataaataaaccctggattagaaacttatacatagcaccaggagattattagttgttcttgccctgtagtatgtctctaagtgtcacatgaatgtatagttaagtatatctggaactcagagatccaaactcactaagatgtgagttctacttactcatttctctataacaagacttctgggcaaaagtggggcagaaggacaaaaggatgcctgtcacatgacccctgctgctttgagacaagatgcctctgcagagtagcctctgattgcaaagattgacaatcctaggtctcctagttcctcctctgagggagacagcctcttgattcatgcgttctgaagacttctgattagcaagtaagttttaaaaaggctcttctagcataattattctgctcttaattttgggaaatggcccagcaaagagtaatcttgaaaattatgaggcactgagggacaaagaggagccaggggcagacaagaggattgcagatcataaaatctcatctggtgctaagttgttactgaattatgcatttgtagatgacttcataggtttcactgtgagactgtgttaagtagattgagcctgggctcctgaatgtatttgtgtgtgaaaatcttttagaaaacacagagacattgctattgattctctatcgagagataggaaggaggatttgttgcgatccttctgttctacagggttagaaaactgggagcactgtactgactagctcactgacaggtagacagatgtactgataaaaatggcatccactttctgtgctaggtaggagtggcctgtttgttttaaatatattggtttatttaatcctcatggcatttcctgtaaggagagtgacattgttaatctattttataaatgaagaatttgaatgtctattttttgtggttttattgttgttctttagaggttttgcttatttctgacaagatttcacattgctgaagctggcctcagacttgttaactactcaaagaagaccttgaacttctgatcctttgtgtctaccttttgagttctaggatataggcgtgaaaccaccacccttaatctctgtgatgattggattggatccaagtgtttgtgtattctagataaatgttctaccaactaagctacatcttcagctcaaatgggaatttgagatatagatattaaataatatgtcattgtttttataataatttaaattatatttctcccaaaatagactgtaaactatatttacaggtagttggtctagaagttgaaaggaattctagtggggatagggaggtgaggcagagaacaaagtaccctgaagggtagattcaggattttgtaatcttgctatgtctctgatgattagtggtttgaatatgcttgacacagtgaatgacactattaggaggtgtggccttgttgggaataggtgtggccttgttggaggaagtgcgtcactgtggaggtggactttgagatcctcctagtcacttgggagatagtctgctccttgcttcctttggatgaggatatagaattcttagctcctccagcaccatgcctgcctggatgctgctgtgctcctgccatggtggtaatggactgaaccaccgaacctgtaagccagccccaattaaatgtcctttataagagttgccttggtcatggtgtctcttcacagcaatggaaaccctaactatgacagttatgacagtgcccctagggggccatctaaaagataggaaacccaccacgccgtcttactacttataaaagccagcaaactaggatatctactctcatccttccttgggtgaaagtttgaacctgggagtatgatatttagtcttggtatatctgtatgccttgtcatgatcccttcacaatactgtgacaacattgtccaagagagaacccaggtgctagaggtaggatgtctctagtgtgcagaggtgccaagcactgtccaggtgctaccaatatctactacatatggctaaaaatagcagagctgggtttcaaagtgatttaattctgattatagcttaaacagccaaaataagagatattcaaatgtcttacagtttggttaaaaaatacctctctccaagactcatctttagaaaacttgttacaaaactggtggcactatttagagaggccatgctgttcatagggagtgtgcttagcagacagaactgggttggcctttgaaggttataccctgcccctagttcctactattttgtttgcttcctggtccactacactatcaactcatgcttttaggaactgaactgaggtgctgtgctctgccttcctcaccatgactgactgcaaccctctgactcatgagtcaaaatatacccttccttcttcgggtattctgtcaggtgtcgtggtcacaactgtgcaaaagtgtagtagttcaagagtggggagatcacaagaagagatggtatagaatcctaagacagctccaatcctcagatatgtaaagactaccacactgaagaggaggaagattcaagagtgcctatattatgtatatatgccctttaagacttgaattctccactttttgcagatgatatgatagtatatataagtgaccctaaaaattctaccagagaactcctaaacctgataagcagcttcggtgaagtagctggatataaaataaactcaaacaagtcaatggcctttctctatacaaagaataaacaggctgagaaagaaattagggaaacaacacccttctcaatagttacaaatagtataaaatatcttggcgtaactctaactaaggaggtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaagtcttctcaaggataaaagaacctctggtggaatcaccatgcctgacctaaagctttactacagagcaattgtgataaaaactgcatggtactggtatagaaacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgcgaatcgatccatacttatctccttgtactaaggtcaaatctaagtggatcaaagaacttcacataaaaccagagacactgaaacttatagaggagaaagtggggaaaagccttgaagatatgggcacaggggaaaaattcctgaacagaacagcaatggcatgtgctgtaagatcgagaattgacaaatgggacctaatgaaactccaaagtttctgcaaggcaaaagacaccgtcaataagacaaaaagaccaccaacagattgggaaaggatctttacctatcctaaatcagatagggggctaatatccaacatatataaagaactcaagaaggtggacttcagaaaatcaaataacccccttaaaaaatggggctcagaactgaacaaagaattctcacctgaggaataccgaatggcagagaagcacctgaaaaaatgttcaacacccttaatcatcagggaaatgcaaatcaaaacaaccctgagattccacctcacaccagtcagaatggctaagatcaaaaattcaggtgacagcagatgctggcgtggatgtggagaaagaggaacactcctccattgttggtgggattgcaggcttgtacaaccactctggaaatcagtctggcggttcctcagaaaattggacatagtactactggaggatccagcaatacctctcctgggcatttatccagaagatgctccaactggtaagaaggacacatgctccactatgttcatagcagccttatttataatagccagaagctggaaagaacccagatgcccctcaactgaggaatggatacagaaaatgtggtacatctacacaatggagtactactcagctattaaaaagaatgaatttatgaaattcctagccaaatggatggacctggagggcatcatcctgagtgaggtaacacattcacaaaggatctcacacaatatgtactcactgataagtggatattagccccaaacctagttttcccaagatataaggtacaatttgctaaacacatgaaactcaagaagaatgaagactgaagtgtggacactatgcccctccttagaattgggaagaaaacacccatggaaggagttacagagacaaagtttggagctgagatgaaaggatggaccatgtagagactgccatatccaggatccaccccataatcagcatccaaacgctgacaccattgcataccctagcaagattttattgaaaggacccagatgtagctatctcttgtgagactatgctggggcctagcaaacacagaagtggatgctcacagtcagctaatggatggatcacagggctcccaatggaggagctagagaaagaacccaaggagctaaagggatctgcaaccctataggtggaacaacattatgaactaaccagtaccccggagctcttgactctagctgcatatgtatcaaaagatggcctaatcggccatcactggaaagagaggcccattggacacgcaaactttgtatgccccagtacagggtaacgccagggccaaaaagggggagtgggtgggtaggggagtggggttgggtgggtatgcgggacttttggtatagcattggaaatgtaaatgagctaaatacctaataaaaaatggaaaaaaaaagaagaaagaaactaaaagacaaaaaaaaaaaaaaaaagacttgaattctcaaaacaaaatagcttcatttatgttctgaacaccttacagtatagtgaaatagaacctccctctgataatctatataaagatatagaaattctgcaatagaaaggcatcccaaaggtgccaaggagggccctctatgatgtagctgtagaatttgctgttagtgcacacattaagactttatccatgccagaacactcatctctgtcatgacagctgaaacctcatatttgcctcttgctatgaattgaatggtgttcccttcaaagtcttattcttcctagaaactcagattctaatatatttagaaatagattgttctcagttatgatttatgtgaaaatgagtccatactggagaagagagagtagcctatgctggttgacttttgtcaacttaacacagcatagatatatctgggagggggaatcttacttgaaaaatagttaagttgggtctttagccaagtctgtaggggattattttgattgatgtttgagagcccaggaggaacaagccagtacatagcattcctgcatggattccacactagttcttgcctctaggttccttccttgacttcccctttcagtggactataagcaaaataaactctttctttcttcaagatgcttttggtcatggtgttttatcacagcaatagagaccctagctatgatggacattgatctaatataaactaagatttcatacaaagagggaaattcgagtaaaaattccagccacataagaataacatataaaggcagggcagagggaggcaagactcatgcacaaagcacagaagctcagggatggttgacatgacatgaaagacttggagaggtgatcaaggagtctttcctagagcctctcaagggaaaatggttttgttgacaacttgatgacacatgtctagctgtgggaactgcaagttgataaatgacagttattttcagctgcctactttgtgccctattgtttcagaaggtcctagcagattaatatttcttgtcctaagataagtacctttagttacatgggagctacactgctgaggaatcgagggagatagtggtacctctgcatctagggagactgactaattaatactgtgtaattttggtgcctctgcctaaaactggtatagttcatgttcagagatcctgtaagattaggctgaagctagtctgcaatcaaaaaatcacatccttatttagcaccatgatttcctgtatcctgcatcctgagaattcatctctaatcttttgcttcttcagaaaccttgtctcaggctctgcctctccacctgggctaaggtagcagaactcacagagaacaaagtgtaaggatgagagcatccaggagggcactccacaggagagctaaaatttcaaggacaaggaaaagtgagttagctggagaaaaggaagagggatctagcagagagaggaggacacgcaaaaagatgtctcctgccatttctgtatcaacagtgtgtaaagagggcaagggtagcttaatgaactgagagatctagagagaattattctcttagagttcaggtgtgtgctttctcagtataaagagtgtagacgctggagagatggctcagaagttaagaacatgtaatgctcttgcaaataacccaggttaggttcccagtgctggcatcaggtagtttagactcaactactcaggtagttgctgaactccattggcacctacactcacctacacacacacacacacacacacacacacacacacacacacacacacacacacacagagtacatgcatatgtttatgcacatgcatgtgtatgtgcatgcactcccataattaatgaaaatcttttaaaaaccttactacttgtatgtactagaatgtgtagttcttattcctagacatcttcaagctgagctatgggtacataatggggtcctctgtttcaggcaggtgaaacaataagttcctatatactttctgtatctacaactacataattattgactcctgttaatctgatggtgtggggggtagttctggacctgacttctcttcttcaccatcttcggtagcctggacaggatcacctgatcttttcaacagtgaagatactgatagacttgtctgtaaccttctttggatagaatcctggtttcttcttgtaattgtgatcagctgatcatcttaaaccttaggttttctggtggacttatttcacttataaagtggaaatggcatcgtcatctggctgaaagatttttaatgtccaaagcctggtactggttgcatagaaagtcatctgtgaacacacccattctatgttcttcacaacacatgaagctgaaacagaagtacatttgcatagtacacaggaagagatggttcagtactggggtaagagaagaagcagcagaacactatttaggtaactaccacctgtgtgtcatgggcaggttatattttatgaaaaccagagccttggtatccatataatgagagaaattttttctcattgcatggatcattgtaggggagaaaaattnnnnnnnnnnnnnnnnnnnnagtgatttaattctgattatagcttaaacagccaaaataagagatattcaaatgtcttacagtttggttataaaataccccactccaagactcatctttagaaaacttgttccaaaattggtggcactatttagagaggccatgctgttcatagggagtgtgcttagcagacagaactgggttggcctttgaaggttataccctgcccctgttcctactattttgtttgcttcctggtccactatactatgaacaacctctactatcaactcatgcttttaggaactaaactgaggtgctgtgctctgccttcctcaccatgatggactgcaaccctctgacttatgagtcaaaatatacccttccttcttcaggtattctgtcaggtgtcatggtcacaactgtgcaaaagtgtagtagttcaagagtggggagatcacaagaagagatggtatagaatcctaagacagctccaatcctcagatatgtaaagactaccacactgaggaggaggaagattcaagagtgcctatattatgtatatatgccctttaggacttgaattctcaaaacaaagtagcttcatttatgttctgaacaccttacagtatggtgaaatagaacctccctctgataatctaataaagatatagaaattctgcaatagaaaggcatcccaaaggtgccaaggagggccctccatgatgtagctgtagaatttgctgttagtgcacacattaagattttatccaggccagaacactcatctctgtcatgatagctgcaacctcatatttgcctcttgatatgagttgaatggtgttcccttcaaagtcttattcttcctagaaactcagattctaatatatttagaaatagattgttctcagttatgatttatgtgaaaatgagtccatactggagaagagagagtagcctatgctggttgacttttgtcaacttaacacagcatagatatatctgggagggggaatcttacttgaaaaaatagctctctaagttgggtctttagccaagtctgtaggggattattttgattgatgtttgagagcccacgaggaacaagccgatacatagtattcctgcatgaattccacactagttcttgcctctaggttcctgccttgcgttccttccttgacttcccctttcagtggactataagcaaaataaactctttttttcttcaagatgcttttggtcatggtgttttatcacagcaatagagaccctagctatgatggacattgatctaatataaactaagatttcatacaaagagggaaattcaagtaaaaattccagccacataagaatagcatataaaggcagggcagagggaggcaagactcatgcacaaagcatagaagctcagggacggttgacatgacatgaaagacttggagaggtgagcaaggagtctttcctagagcctctcaagggaaaatggttctgttgacaacttgatgacacatgtctagctgtgggaactgcaggttgataaatgacagttattttcagctgcctactttgtgccctattgtttcagaaggtcctagcagattaatatttcttgtcccaagataagtacctttagttacatgggagctacactgctggggaatcgagggagactgactaattaatactgtgtaattttggtgcctctgcctaaaactggtatagttcatgttcagagatcctgtaagattaggctgaagctagtctgcaatcaaaaaatcacatccttatttagcaccatgatttcctgtatcctgcatcctgagaattcatctctaatcttttgcttcttcagaaaccttctctcaggctctgcctctccacctgggctaaggtagcagaactcacagagaacaaagtgtaaggatgagagcatccaggagggcactccacaggagagttaaaatttcaaggacaaggaaaagtgagttagctggagaaaagtaagagggatctagcagagagaggaggacatgcaaaaagatgtctcctgccatttctgtatcaacagtgtgtaaagagggcaagggtagcttaatgaaccgagagatctagagagaattatcctcttagagttcaggtgtgtgctttctcagtataaagactgtagaggctggagagatggctcagaagttaagaacatgtaatgctcttgcaaataacccaggttaggttcccagcgctagcatcaggtagtttagactcaaactactcaggtagttgctgaactccatcggcacctacactcacctacacacacatacacacacacacacacggtacatacaaatgtttatgcacatgcatgtgtatgtgcatgtactcccataattaatgaaaataaatcttttaaaaaccttagtacttttacgttccctagaatgtgtacttcttattcctagacatcttcaagctgagctatgggtacataatggggtcctctgtttcaggcaggtgaaacaataagttcctatatactttctgtatctacaactacataattattgactcctgttaatctgatggtgtggggggtagttctggacctgacttctcttcttcaccatcttctgtagtctggacaggatcacctaatccttttcaacagtgaagatactgatagacttgtctgtaaccttctttggatagaatcctggtttcttcttgtaattgtgatcagctgatcatcttaaaccttaggttttctgctggacttatttcacttataaagtggaaatggcatcgtcatctggctgaaagatttttaatgtccagagcctggtactggttgcatagaaagtcatctgtgaacacacccattctatgnnnnnnnnnnnnnnnnnnnnactttttagtttttttttttattataagcattatttgaaagtcaaatctcaactcacagtggaagcctttggataggatcggaagtagccatatctctcaatgagactgagatattggtgtgaaatctacaagacaaatgatgcagccatgcctcttgattcctggtacctggatgtctgggcagatggcaggagatgaaccccgctaaaggacacactgtgtgtgaaaacatgagatacagaaaactgtgcttttctttgttcatgaagttattgtttttaacagctgagtagtactccattgtgtaaatgtaccacattttctgtatccattcttctgttaagggacatctgggttgtttctagcttctggctattattattattttttaaaactgtgcttatttaaacttgcatctttacagtatccaagcccatgcaggtttattagaaaatatctgcccaagagaagggatgggggaacagggaatggggaaaatacctatttcctaacagctatataaagagaacattgagcaccgacattttggtgtcagtagtttgttttgtttttgtgttttctccagagagtctcgcttctatcgacaagtatgtcttagaactcatcatgtctaactttcctgtcaatgccttcccagaactgcacatcgaaggaagcatgctctttcatgcccagctctctggcgttttaataggcttaagtagctgggacttggttttcttgtctgaattagttaaacatatacctctagatgtctgagagagacttttcccaaagcatttggggtgtttaatgaaagggctaacattttttcacaaaatggcttattagaagcaccagataaataggcctctcctggaactgtgggctctgtttggtctagtctttcttagagtagttttctttctttgtaaaagtaagtttttgagaatttcatacaatatattttatcatattcacccctaactgctccccctaatgtctcccaggcccatccctacctccctaccccataatttcattttctcttcccctctcccttttaaaatattccatcaattctagtaggcgctgcccatacacgatgagtatggagtcatacaatggagggtgctgaccatacacataaagaaaactggcatgctcccagacactaccagctggtcctagcttctccatcagggctgtggattgatgaactcctttttattctgtgctaggatgctgattagcttgatcttgtccagacagccattgctgctgtgggttcatgagtgctggggtcctatctggtctagaacacgctgtttgcctcttatctcttacccctgcttctcttctgtgctggtccctgagcattaaggagggaatgtagaatttagtattctgttctagactcttctcctagagagaaagatcttgtaacagctagtcctctcctggggactggctactggcgtattcaaatgccacatcccagaaactatgatactgatcatctgaaggcaacattgatcatcccaagatgcactggtgtaaactgtcaagttgtttttctttaaggaacacagtgggtggttcttttcctatgtatgagagtgctcttctgttggatgtgcaaaaagaacctcttttctggctgaaattctgggcacatttctgaggagtactctattctgctctgtgttggtaatgctatccttgtattaaagcttgggagtgaagccacttaggcaggtgcctcggtcccaatctcagttctttgaatgactaattatttgacattcatcttgatatctcttcttcttttcagaaaaagaaagaaagaaagaaaaaacagagtggatgttcccagttgttacccatagagttgctatgatactaaaaccaaatagtacacttttagtgtccctagtacactggcaggtatctacgactgtccagtctgtacacctcctactgctagcatgagttatttttaccattttgataaaatcatcatttcaaattgaacagacacagtgtggtgattgccatttaaaaaaaaaaagtttttctgttttgttttcagtgaatagctatgctttcccccactagatccttgggatttttccttaggtatatattttcaggacacacctctgtgatcctaagctcaaaaccttatggttggctctgtctggatccctctgtgttcttcacagtatgaaaactggagactttgtttaaagttttcttcatctgtgtttgtgaatacggtttcgttccagtttttaaatgtattcttctctcatgtattacatccagaccacactttcccctccctccactccacccagcaccctccagcctggtctcctctctcccccagctccattcctcttctgtttcccttcagaaaagggaaggcctcccagtgatagcaacaggacctggcatagcaaattatcaaacaactaggcccaaaccgccatatcaaatttgtttgtttgttcctttgttcctctccaaattctgttatgcctttgatagatacccacacatggctctctgcaatgcccctcccgatgtctgcgccttcatgtcactatactgaccttttctttaatgagaatttattaactactttcttacccacttaaacaagatcctaaacatttaagtcttcacttttaaacatgttgtagacaggtttttcactaggtaattcacaccagcctagaacccactatcctcctgcctcagccttctgagtactgatatgtgtgttttgccacaacccagctaagacagcaagtacttattcaactgtgaccctgtgctgatttgattggatcaatgctcacagtattagtaaagcacacctcaggatgcatttgtatggcttttccacatttccagggaggtttaactacagagggagccccacactgaaagtgagtggacatcatctgtattgggtagagacccacatgtgaaaacaagacaaagagaggtagtaatattctctctctctctctgtctctctctctctcctgtctcttacctgctcccatattctctctctctttccttgccctgtcttcctcctgcccccatattaccttctagttattaatatgataggagtacatctgctcccccatggcctccctgccatgatataatatccataatcttgatctaaaataaatctctccccttgagttcttttgctcattgttttatcttcatgtcaaaagttcaagacaagggacaaagagtaattccagtatcacctgttggtgtgttgtaagtcatctgactgtcctcagagactgcatggaccccagtcatggtgggcatgagaactcaggcccactgttggctctgaaaggcagggaagatcagtgaaggcccgtggaatccctgtggtcttacctggaaattttcaatatttctgcaatttaagtcataatgcaattttccattcttgaggtgagaaaatcaaaccccacagagatcagatgaactgtttagagtcgtgcacatggctagtgaatgcagggcaataaagacttggactctgactgcaggctagctccccttgggactctggctgctagctaactccccttcatcttttggtccttattgtactattttatgcagcagatttgcctaagcatgggtttaattactagagtgactttgagcacctttgcagatgggtcagtggtctatgcaataaaagttgtattttagcaaatttgaaaaacagagaggatacatggctcagttaagggtaagaggaaagacaactttgctgaagtgaatagaatatataaaggtatgaaagggatgatagtacagcaaattgtctccctaggtacatatgtatacgtgctgttaaacctataaagtggtacccctaagaccatatgaccagtaaattgaagttaaatgagagctctgatagaataaagaaggcaatggcatgtgctggaggccatgctatccctacctgaaccatatcacggatgcctgcacttcttagtgacatccagttttcttcagaacacttgatttttgtccaaagcagacaatgcatatacacagcaatccatcttcagctatttgaagcacttttgctctccgtaggaatttctgggagtcaaactgttacaagtgctcacagcagggaaaagaaaggcagaattggtctgaagattgctgcctgaggatgaggctgaattacattaagggggtcacagcaccatctacacactgaaggagagctttggcatctcgagggcagctgtagcccagggtttgcgggtggttcacacatctttttcctctgtatgctttgatgtctaaaccagaggggaccaatgccattttccaagtcaggctgtagctccctaacagcaggcttttctcccccttgatgtggtttcaaactttgtgggcagagatgccatcatgtgtcaatcacttgtctttgcatagaggatgctggggatcagagaggggttgattgtgttatacacgggagagctccttggatgggagctcactgggtctgagcagctgagcactagggaatgctttaaagagtcaggatcggatggtaaggacagaattgcttcgagataaatgacacaggattggaagctcacctctttttaatagaaatttcttatttttaattatgtatgcgtgcacgcacctatgtgtgtttatgtgcacatgagttcagatgcctttagaacccagagttgccagatccctggagctgaagttaaaagtgattgtaagctccccaacacgagcgctgggcattgaattcaggttctctgaaagagcagtatgtattcttaagtcctgtgcctcatctcctataaacctcttgggattccttccaaataaatttagcaacgtgtccctctgtaaacattctttctcctttattgacccaggaatagcaatatttttgtttgtttttcgtgatttataaatatattcatctctctgtgtgtttacatatgtggaattcagaagacaacttgaggcatctgtttccccctccaccttgttgagtcaggctctcttttgctgctgcattgctgaactacatcctccaggctggcccaagagcattcaagcgattttcctgtgtctgtctcccatcttgctacaggagttcagggattacaaaactgggacgtggtgtttgacattataacatgaattctgtagatcgaacctaagtcaacaggccttcactggatgagtcatcatgtcagcccagttttttgtagtgcttaaagaggccatttccctacacagagatggctgtattttaaagtctgttttgatgagtgttactgtgctcgttagcagtttgtcaacttgacacaagttagggtcatctgggaagagagatcctcaactgagaccatgcctccatcagattggtctgtgggcatgcctctggggcatgctcttggctaacgactggtgtgggagggcctagcccactgtgggtggtaccatttctgtacagatggtcctggcttctataaaaagaacagacagagtgagcctctgggagcaagccaggaagcagcttcccttcatggttccttcccagagcttttgctttgatgccctcagtgatggtctggaactttcaaggtgaaataatttttttttcttccccaaatttctttcagttatagtctttatcacagcaatagaaagcaaactaggacagttatgtaaccatattcaaggcacagaaaatttccaaactccagaagttttccttatggccccttccagtcagtcagcccacttgagggaataatattctcattttcatcatttaattgtctgaatcaacacatagaatactccaacatctcagcaatatttgtagaatgagggcttgaaatacacagctttagttgttgactggactagccttggtgacttgtacctaagcaataccgattttggggactcccaggaatgtctgactgtaatggttcctctcccttaaactttccctggaagacattatctgatcaataggctgcccttcacaggctgtcccctgcagtatggcccacaccactgttggtcattgctgcttttctcagctatgatactctccaattccatggcacaatgtctatgtttatctccactgctggattccatgttcaggctgcttcagctagcagtgagatgcacacacaggtctgtagaagttgggatttctctcatagggaacttctacctgccaagttgttcatcttgagaccttagtggagtccttggtggaagagaggtggatttgaaaacattttttttcttttttagtgatggggtctcatgcatctcaaattggtcttgaactcactatgtatctaaagatgacattaaacttctggccttttgcctctacctcttgattatgtaggtatggtctattatatccagtatataatagaatgttggggcttaaagtctgagctctgtgttagataaacatttaacaactgagctaacatctctagccctggaagcatgcatttgtagaagtctacatcctgtgtcatggatcaacctcatgtctttgtgctttagatgtggttgtgttggctgcgtcattttcatgggacctggacatttactcatcgctgtcgatggaaagctttgcacactttgtttctacccaaaggttggacacctggggaactagaaatggtaaaatgtaatcctgcttctggtgatgttcccagaccctgtccctgtgacattgggtagtctggagtgtcatcgaagtgtaagatatgggcatgtggttggcgagtagattctctgatatttcctgtgttcgatgcatagacttgacttatacttgggtttcagaagttgttttatttttttgttgttgttgttttgtttgttttcatttatttttgtagctgtggcaaaatacttgacaaaacaactgaggagtggcaaggtttattttgccttttgtttaggagcttgctgtcaatcagaacaggaaagaaatggtggtggagcatgaggcagcgggtcacattgcgtctgtcctcaggcagtagaggcagatgaattcttctgctgtctaactgctttcctctccctacccttcttaataagccccaggaccccagaccatggaattatgtcagtcacattcagggtaggtcttccctcagccaaacctctctagaaaccttcagctagatatgcccagaagtatgtcttgtctcctgtgtgattctaaatccacttaagttgctgaggaagattaactataaaagaaggattcacaaatttctgaaataatgcatagaactctgggcagtgtacttttccacatttctctgaagaatacctagtttcttgttggagttttagggtctctgtattattcaaaattaaacacccctggtatactcatttttaatgacacttctgcttaattccataaatatctaaaatataaaaatgagaaaggaaggggtaagaatctggagccgagttctaatgctccatctgccccatttcttttaaatatatctctatgccccttgagactcattattcctctggatgtctctgagatcttaggatggctacatctaagctggactggatgtccgtgttcatctcttgcatggtcttactggagagttcatcttagatatagaagaaactcctgataagaatcaatgcaaatatttttattcatttaaaatgacatattgcttgttaacaagaaagtctgatctctcatccctgcctctttctccctttaacacttgcatacatgcctctgttttaaaccagcatatcacaaaaggggggggggaatcaaaatgtaaaaactgaaagcaattctctaatgctataagagacttaaacatcaggaaacaccatgctgaattttcctgatctactttggaggagaaagagagatgcaggtatgccacaatgtctaggctgcacatgaacttgtaaacctgcccttggagatggggacatttatacactcaagaagatgtttgttattgtacttccacctaccattagaaatacataaaaagagagtaaatgtttggaaagattaatactgtattttctttctggtggtcagaaattgaaaactgctaatgcctgaaacaggaaggcagtagagcatgggagaaagtcgatgggagagcttaatgcagccaccactcagcccccacagcgtcagagtgggttgatcttcgtcctgtccagagccggtctgtgaataatgatattaaggaattaggcagagtcatcacagagctacagaatatcacccttgaggcctcactggagactgatgggagctcctgggggttgataatggcagtcggaggctctatatatttaaaatgcacaaaggatgagcccagaaattatctgcctgccaacttaacttctctacctggaacaaattatcctaaaatcaatttgcaaacacctttgagataacaaggtcttgagtaataacctccttggctttgtaaagaaaagcacctagcttgactaatctgcttaattcctttctctgaccaaatggcgagcaataatagaggcaatctgaagttgtccctccagatgagcttagagtcacactgagactgtattgtccatccctgtttcagagtagatgattctgcttctggaggaccttttagtgctaggtaattaattaaaagaaaaaaaaacacacagaatgagccctcctctattccaaagtctccacctgagtcccaaattaaactcagacctccatttattcacctaggaacccagaggctctccatggtaaagagtgcttaaataaatctgcatctgacttctcaccctatcacctcagctttctgctggaggattcaaggacttattcattcctcttggcagataaccccattcctggcctttggtcatgtaacactaccaaagccagacaggaaggcctgaaataatttgcatagagatgtcagtggcagaattatttaccatattagagcttagaacagcccaagtgtccagcaatgggagagtaattaggatgataccttggtcattattcagtacctagaaaagacagtaaaccccttgtatcccataaccaaaactatgcttaacgtgaggggtggggcagaacacttctatatctggcccgtgtgtcactgaaaccagaggaaatgatgtaagtccatgaatgagaactgggttggcatctgcagaaatgtccaaggctgtcacttcggctcctaaggaagtatgtgctttctctttcattccttctgtgacttttgttccacttctgtgtttgtcacagataaaaaatgatgaacagaccaagtttgttttaaaaaacaaacaaacaaacaaacaaacacaaaaatgaacaaacaaaatggggatggaggtgctggagagatttcagtggttaggaggatttcttgttcttgtggaaagcaagtgtttggctctcagtgcccatatcaaatacctcactgctctctgtagctccaatattctctgctggactttggcaggaacctgcatacacatgtaaatatttacacccttatgcacaatcaaaacctaaatcctttggattgtctcagagtccacatccctgaaaagaagtgactctcactctccctgtggatatcatgctcctcagagaggggtggtatgttcccgatccatgatgggtctctggttgatcttggggaagtcctgtagaaatactatgcatgtgtgaataataagtataatatttaaatttaaaagatttgttcattttattttatgtgtatgaatgtctagcctgagtgtgtgtttgtgtaccacttgtatgcctagtgtccatggaagttaagcaaaggtgtcagagccctggaactggagttacagatggcaataagccaccatgagggggctgggtctgggtcctcttcaagagcaaacaagtgctgctagccactaagttatctaaataaaatagttttcagaaaataaaatattttcagaaacaaatggccactagggaaagtatggtgaggcatactggtaatccctaaatttggacagacaaggcaagagaatctggcatttgaggccagcctgagatacatagtgagcctaaggccaacttggccaacatatgaagaccctgcatgggggttgtggatttcattctacttcactatgctgtgagcttagctaggtctgtttggttaagtatatattgcctaaggaaggtgccacacagaccagttatctggtaacttggcataacctttcctttggctcttgattcttgccgggttcctgttggccaaggacactctctgctggtaggaacctatcaaggtgagggagaagctgaatttttgttgccttatcctttttcctatctgtgtttatatcatcatctgcagaggatttctacaaatagtgtgttggagctgcaggggaactagccagaaacctcctctctgtgaatgacttctgagctgccagaggttcaccctgcacgatgcaccagtagaaaagcaattggctgtttcacccagctacctaccatgacaattaccagcatggcaagatgtggggcaatagtgtcaatgaaagcttaggcttaactatcaactgactgattggactaaggctccttaatagaaggaaatttaatggctggtattgtaaaactattcagctacccatggctggtgagattacggactccagaggagaatctactacaactgcatttctagcccactatatatagatagcttaactatcttctacctacttagctttatgctctcagacataccttacacattgctcttacaccttatcaaagagaattctttttggagtagatggagctgatcagttactcttgctatgatgaaacaccatgatcaaagcaacctatggagaaaagggcttatttggcttacacttccacattgtagttcatcactgaagaaagtcaggacaggaactcaaacaaggcaggaacctggaggcaggagctgatgcagagaccacagacacatgctgcttagtggcttgctctcatggcctgctcagtctgctttcttttaaaatccaccacaagcctaggactggcccggcgccctttggactgagccttcccacagcaaacactaattaagtaaatgtcccacagacttgcctacagcctgattttttttaaattaggcattttcttcatttacatttcaaatgctatcccaaaagttccccatacacccccccccaactcccctacccacccactcccacttcttggccctggcgttcccctgtattggggcatataaagttttacagcctgatttttaaggaggcattttcttaattgaggattcctcctctctgatgactctcacttgtgtcaagtcaacgtaaagcaaatcagcatacccatgattggcaaaatccagaaagcaattcaatcctattggtatatctatctataatacaaatcctataactaaggctcagaatagaacttggaagaggaggtgaaaggctttaagagccacaggttgggggcatatgatgtgagatgatgtcttctatatgagacagctgtacccatgacatttcaatagcatggtccttagacaagaccaatataatgacaacaccagagtagatgggaaaaatcttacaaggctccactcctaaataaagagatacaagcaagcacttagtggttgctgagagagggagaatcagcccccgagaggggctcaaccagtcattcctaaacacatattcactcaagttaacacacacactcacacacatgcataagcatgcacacacacatgaatgtttcacataatacaagtggaggtcactgtcaactttctggagttggttctttctttctttctgtgctgtggatccatctcaagatgccacttaaggctgaaattcctttgcttgcctgctttctttcagagcctcccacgcccattgctcccccggaactactggccgtgggtgccacctacctgtggattaaaccaaatgccaactccattattggggatggccccatcatattgaaggaggtagaataccgcacaaccacaggaacctgggccgagacccacatcgtggactctcccaactacaagctctggcatctggaccctgatgtggagtatgagatccgggtgctgctcacacgaccaggagaagggggcacaggaccaccaggaccacccctaactaccaggaccaagtgtgccggtaaggatgctgttcttctgtctggccctcctcttgccttttgggcacaggtcattcctagtttctttggtgtgtatctgcttgcttccttttatggaaagacaattaagggtttgctcagacttgagagacactctcagttctggctgtgattctgtgagccttctgcctctggttggttaatggagatgctcatcatgttgaaagtatttctgatggaatattggctccatcatgttgaggaatcctggtgccatttgcatgtctttgagggggtcttagtttggtgtcaatgagggattttgcctctgactgtccagaaatccccatgtagactacatccctgcaggcttctggttccatttgtatatctaacatgtatggattgtttggctcaggaccaaacaaactggatctggtcattgctctggtggttcctggttctagttttgtctctgaggagatcctacttccagctatttctttacagctttctggctctgacagtgtctcagagctgattctgaaattgtcttggtccctgagaactacctaactccaaatactctaggggatgctggtttctgcttaagagtctgacttggtactaggggcctctagattctcctttacctgagggtttctggctccagttgtttcccagctgttcctggttaagagctgctggctgtgggtatgactagggtgtgtacacctgtatctatgaggccttttggctttgcctgttgactaagattggatctctgaatggaagttatgaaattaagggagtctgatgttcatttttctaaaactcacattatcttcttagcatcctcgaataccattccctgaaagtgcttttgttccatatatacacaaagggagagagacgctattttctaactttatacaaagctcgatgaattggccagtggtccagtcaggttctggacttgggttttgggttccagagctttggatcattccttactccatgatgagtagagaggtgtgtgctgctgataacccaagctcagggctgctgtactgagttgacaggggcttagtgaagcatgcagcacagacttctgagggaaaatgcgccaaagacgtttctgaggtagaagtgaagaatctgtaggtacagcaacgtggactacatctgagtatgttgcctctggcctgttataatttgacagctgtgtccctaaacttgttggcttttgatgtatcatacaataaagaccacagggcttaggaaagtaggggtagaggtaccccgtgtatccttagtaacacagacgcaggagagcacaattttagacatcaagtggatcagaacatgcaaaacactataatgcagatagccaacatctcaggaacagcttgttatttgcttttacacaagtggtagggtgttgcagcctgtgagtaactgggtagcaggaaaaggccatctgaaatagatggaaaggaacctccaggtacaaatggatgtgtcttacaatggtggtgaactgaggaattagtcaggtggtggtggcggaggcggtgggggtaggggtggtgtgtgtttctgtgtggcttaggtttttgacttcacttctgtctttggtaggcacagtcacagatgggcagatgtagcatgtgctctgtgcttacattgctccctcatcgatcaattgtttaggagcaaacttgagtttccagttgtttgtgaaccgatatgagtggctgagttgacagtggccaatcttaggcgtctcaggagtgcagccgatagtgtgaaagccaaggagcttcaacatctcatggctcagacttactccttggaaagctattgaacaactatgatgaacagagagtccattttcccaacgatttctctaaactggtctttggtaaaattccacattgaaacctgattatgaagctgactgctttcagaggacataagggtacattattaagctgggtaattccttaactcagctctgcactgtaatagtcatccataaaaataattgatttgaacctgttgacaagacttcccctttttccacaaggtaaatggaaggctttggagggggttctgatctttagaaatgatattccaagcactttcaaagcccctgtgggcttatttgctcatgatcatataatgcagttagaaattcaatcgcgagatgatcatctcaataaaaatttataacctattgcaaacagttgccacgactgtagaaaggactttacatgtgacagacacagtggtctgactaccactataaaaattatgagttgaaatgttgtttgtggtattgtatttccagaaatgttggtgtttaagtaagttaggcttaaagctcaaatagcctacattttacaaaatgtgtcataaagaaaataatctttttttcccatcaccactgatggtagaatgttctttgcttcataattaatttttcagagaatccagggctgatatccatttgtagatgctctttattaccgttggtattgggagttttctcccctctccctattctattattaatcacactggaaatgtactcattattttgcaaaacagaaaatgagggtgtgcagagtgtggaaagtataatttctgcccagaggaatttacagacttggtagatattctagacattttttttttttaaaaatgggtaagatataaaaatgaagtttgagtgttaaaatagtgtgctttgtgagaatggggtgagcaatgtccatagaggcatctggagcagtgtgtctcagtgtggggttcctggaccagtagcatcagtgttgctagagactggacacttttgttacctcagttcttaagttgaaaaccctaggtctccctaggatggggtaggacatggtgcctttggagtgacttggttataggtagatttggaccatgtgaaagaggccccaacattcatgctcattcaccatgtgcgggcacaatgagaagactgggctgtgagccaacagtcaggcctttcccagccctgtacaaacaaaggttctgttgtttataaataacctattctataatattgtgtcacagtaacccaaaaagattaagttcttaattagttaagaattaagtagatccagtcctaatctctctgtacccaatgaatcggaaagtataagagtgagggctggcaatcagaagccctaactcacacagggtcacatgcaaactgtggtgcattggcttgccctctgggggcagagccactgactgtgtgacttcatctttaagtcagctctgaggtagacaaggggaatactgagactcagataattggctcaaggctacacagtgtgtaagtgcttaaagccaagtctcttgactctaaggatctccccgcaactgatgatagagtctctagccctgggttgggggtggttcctctgctcacaagtgtcctctcaagtatggggttgggtagtaactatggagacaagctaaaaatgaatggctgtgtttgtcctttataccaaacagttactcattctcttctgtgagccaaactttgctctaggcagtggtagaagaggccggcttggaaaggacaggacaggacaggcaggggagaagcttggccatgggtaggtataactaagcttcaaaaagatatcagggcaaccaagtctgtgagggcaagtaagggtatattcttgttctattgtgtataacaagtcacaacctgattgatccttggcattataaggctgagacttacacttgagggtggaacatttaggagtttatctgaagagtgccccagaccaatgagtcaggagctcagagcacacttttagctaattataccatagacagattcacaaggaattataaatgtggggatgggagaaggggatctaaggtgaaacctccagcttgtggtataggcgactgagacacgagaggagaactgtattctgagatgggaagtactgaagatggctataggagtgagtaggatgtggttaggtgaagatgaatagcagccaatggggatatattcatctggagcttaagaaaactgagctctgtccatgaggactcccccaacttcacctggacattaaggtaggggcctccttagcactgatgaaatcagttttttaactctctccatcttcatgctgtccccttaagatgcttcattcattttttaattcatcattttgttcctttatctcattttaatcattcatcatcctcctgagataaaggcctaggggcaaagacaatgatgtatagcaaagtgtttttgaaaagctcaaaatacgcttttagacgcctgtaatgaaaccaatcactatctgttgatggtgttatgcatggtattattgtgagctgttacatacagacaagaaggctggcctgtttatttttagcatgagcacccattgagattgtgggtcatgtactcttgttctttgtcctctcatagggagtaccatttctgaccatgatgctcacagtgcagtctacattatgggtagccttcttatctagagcattgggtgttttcctctagcatatttcacacagcaggcatctaggcagggatgggaggttagggatgctggacaatagatagctcactttaaaccttgactctaaagggaaggctacactatcctcacagaccatttccccggtgaagcaactgagctattactattttctctacgtactcagtgataacttaattgccacacaattcatcttgggggtcacaccctttaggctccaagtacaggcagttagccattgtggggcatatctgtaactccagcatgctggagattgtggaaaggaagttgtgagttgaaggccagcctgagctacgtagcaatatcttatatcgaaaaaataaaaagtatgactaggaggcagactcttgcatgaatcatttggagtttttaaagaaccctgaagacaatggcactgagaaatgttacccaggtcattaattgggaaaaacaagaggtaccatatggactcaacctggcttggcagctcttctgtaggtatcagttttaacagcctcaccgccagcatgctggtttcctgaaagaatcatctagcaccacacagaaaagactccaccacatgtcactcaagatccacttccccacaacagccacatgtaggccttggttttgctgtctgccagcatttctcattatctcaaaatcagggtgttgggacctagagttgtgtctcttctcctcttgaaatctctccccttccttctcaaatcccagctgaagccagaccccaagcaactctcttcacactcctgttataggttcaccaatccgttcagtaagctgaatgattgtcccgccctaacgtgattgctggttcctgtaaatcaaagacccacttgcctgagagcccacttcactgtagtccagcaaagttccaattccccaagtggaaactcactccacccacgtggttggaattgcctgctctgcagctgatttgaagggctctctttctgttcccttcacctgagggctgattgcacgctatattttatttacatatttatgggtttctacttgaaatgatatgtgtctagttctctcttttctccagagggataaaatggaggaattcaaattgctgagctcaatgaagtgagagtcatcattagaatttagtgaaaaggatatgggccttagagccaaagagaatctggtttgtatttcaagcgggacatttgctagctggatgaccagggatgtattacctcacctctccatgcctccacttcctttcttccattaaaagaagattatatcacatcaccccacacccagagcttcagtaaggcctgtgcctagcagagacactaatagagcctttgataaacataaattagaatggaatctcagacctggaaagagggtttttaaacgtggactaattttgttccttgagcatgatagatcctatcataagagcatttctgtagtactgtgcttaacatagagaatttgatgtctttgggaagatgggatgcttgtagctgtgcagttatctgtggtcctctttgagtagctatgatggtacctgatggtggggatagagtgcagaggatgggaattggtcttactctgggttctgtccagaagcccaggcaaggtagacacacatgccatttagatccctttcttttctagaaggtcaaggaacataagaacaaggccttgccagttcagaaagaaagggtcagggagagtcctgaaaccctaaagatagcatcttcaggggtctcttttctcaaagaggacactagggtcagtgtagaaaggtctttcattctagagaacaattctgcatcagagcagagtgagaaaggcaaaaaaatacttaagtgtcttcaaaaataggacaagttcatttcactatgccctgggaccttttcttttttcttttcttttctttttttcattgctataagctttgctgaaccatctgtaatgtgatggtgtgtatttgtcagggagcagatgtggcataatttggctcagggcattgaaccaccttctgagtgaatgttataatgaatacattctcttcctcactgtggtcctgctctatagtcaggtgaaatcatccataaatcttaagggaacatggcaaggttagccaatgaaaaaaatcaaatcctcatcccatccaaaatgaaataatagaatcaacagactttaaagatcagtgacaaaaacttcagacatgccacagcatgctcaaagggacattgctgctgatacaatgcaaactcagactggagacaactgcataacatatattatgaccaccgtttcctcagaaagaggaaaggattggttatgtcatctctttgttttgtctagtgttcctatactgccctcttcgcttgtggtataaccatgccctgctatttcatcatttctagagcctccatgagaaccaaaggtgtcttctctggggtccaagaggtctatcttctcttcttgcagactcctctcctcttctatcacatgttgccttggagccttccttccttggtttatgaaagaggtggctgtaaggttaaagccctttctcttaaaacccacacttcataatctcagatactttcttccccctactccctcttcatattgtataaagagagtatggtgttgggagggtgtggtgagggtccaactgggtacctctttgcgacttctggaaaggatggctggtggtaccttgctcttctctgtagaatgtcatctttttaaatctgctccttagtggtcataaagcaaattccagggcaacaacaacaagagcatcattctgcattctcccacacttacatactcctgccagcctgtcctctctaggggcttggggcttcctagaagctgaagcacaaggagaagttgaccaattctaccccaatctctctcaatcctaaaggttcagatctgaggaaaaactgagccacacagacacacacagacagacacacatatgcacacagacacagacacacatacacacacacacacacacacacacacacacacacacacacacacacacaatggtaatgagagctgtggtcctgtgagtatgcctgtcccatgggaagtgacactattaggaggtttggccttgttggaataagtgtgaccttgttggaggaagtgtgtcacgatgtaagtgggctttgaaggctcctagtactcaagagagtcttctcctggctacatatggatcaagatgtaaaactctcagcttcttctccatcagcatgtctgcatggaagctgccatgcttcccaccatgatgacagtggactgaacctcagaaactgtaagccagcctcaactaaatgtttgcctttatatgagttgccttggtcatggtgtctcttcacagcagtaaaaccttaattaagacaagagctaatgctatttatgtatcaagataattcagtaaaaacagcccctatctatattaaagttggggtcaattactcctgaagctctaaaagcttaaggtaataaatacagcagatggatggttgttctaaagcaaacagtggctgtcatcatgaatatctgacacctgtagcttgtatagcatgaggttggcagtgggtagcttgaaattcttgccacagccttcagggcaggtataatttcttccagtggctatgagacagataacatgaccacggtcacaatctgcccaagtggcagagccaggaattgagcctttaatatgtagctatgtcttgacttccttcctgctgttgtagtcaaacacctagcaaaccctgcaggaggggccagtatgagccccttgctgccaactctttacacctatgttcattccccggggctcaaatggtggaaggtgagaatagcaattgccacaagttgccctctggcctgtggattgtgtgaacacacagaaaataaattagaaaaattaaaacaacaacttttaaaaaacaacctaagcaaaggaaggcttggcttggcttatggttcaaagacacagtccatcatggaggggaggttaaggcagcaggagcctgaagcaacttcttccatcacactggtagtcacaggtgggggtggggaaaaattgctactcaatcccctttgatttgctacagtcaaggattcccataaccgcaatggacctgattaatatggtttttacacatcagttatcaaagaggatatccacatcctcatctcccaagtgattctagatcctgtcaaattaacaacaaaactaagaccaggagctaccaagctgtctaatgttagcctcagaattcagtgtggttatcaaagcatcatataccatgaccaagtggggcttctctcagaatatggtgagatatcagaaaaactactggtatgatatttctttctagtggtcagaggataaaaccatatgatcctctcaggagaggctggaaagtaatttgaaagaaattcacccttcattactgatcagaatccttagtgagccagcaatgggaaggcgctttcttatttcaagcggaaaatgttcttatagtctcaaagcccaagagactaaagcaaactttgaaaaaaaaaaagggagaaaaaaactagtagaaatactaatgtatttcggtcttgtagttggaccaagcaaataaataaaaatcaatagttacatgccagtagtaagtgatacaaaaataaaatgaaatatatcatattcccaaacacaattaaaatataaatgcttatgaataaagtaagaaaggctcagaatctgtatgaaaatacatacacctctgaaatgttattgaggacgattaaacaagactggaataaatggagccatatatcatgccactggattagcaaatttagtactgtgaagatatcactgttcccaaattaatttataggtttaatataatttgcaatcaaactcctaatgtgattctttgtggaacttaacaaagcaatttaaaaattgatcagaaataatagccagggggagtaatccagaccactttgaaaaaatggcaggaggaggagatttctctgagataaaaatatttataatcactataataattaaagccctccatagaatacaatctatggagagacagtgtttagagatttatctgattgtgtaagttcttaataaattgcacgtgcttaataaatagtatacaatataaataatttgggaaatggaatttttggtatatagcatgatatactaaataaattgcagatagattagacactcaaaagtatagataaaggtaataagtaagagaaaataaagaagggatgttcttttattaggcaggagtctcatttccttaaatgtaagcagaaacaccatcaagattgtgcttataaagttcactattcaggaaaaaatgaaggtcaagggatgtctgtggtggatactgacagtactcacaaatcaaatgggctaacaggctacaggaaaagctgcggcaaaatgagaaccaagggcaaatccccctgtagaaagtgctgtggtcactaaaatgtgatcatgttgatagataaacagctgaatggcacaaacagatccatgcaatgaaaatgtcaaaggggcaaggcttggcgatgagttagtaggtgaagtgtcactttgcaagaatgaggggtagattcccagaacccacgtaaagtcctagagtactgatgatgcccatctttaacaccagcactgtgtaaggtggagaaaggcgcactcctagagctcattagccagccagcttagctgaatcagttaccgtcaagttcagtgagtcactgtctcaaatattaaggtgaagagcaattgaggagtatgcctcatgtcaaccactgtcctacatacatgcacatgcacacacatctgcacacacacacacacacatctatatgcaccacacacatgcacatacacagataagaatgctgaaatacccaataaaatgtccagtgttgcagttaattaaatggtttcttttacctgtaatattacaagagtctatgttttgattaataataaccagcatggtgaagaaacaacaaagtgagctcttctttttaacattattttttcttcattaattaattagtttatgtattcactttacatccccatcacagatcccctccctcctctcctcttagtcacaccctcacaaaccccttcccttctagagccttcccttctcctcaggaaaggggaagttccctataggtatcaacccagcctggcagatcaaacaggaggttctgcaggtaggctgactggcactggtgctgaggagagttccctaatttttttcttaaaaaaaaaatcagaactctcagaaagagttctacatcaaggccattgctgcattatttataagggcaaaaacttgcaaatcatgtaacagaaacacaataggaaaatacttaaataatgtgtggaacatgcatacagtacaattttctgctaggttgtacaaaccacattcccaatgatagtattcaagccataagatgaacaattcagcttacaaaaatgctcttctgggagaccatggtttggttcctggcttctttatggtggttcacaactgtctataattctagtcacaggggatccaatgctggcctcttccagtaccaaatatgcacatggtacacagatacacacgtaggcaaatcacccttgcatgtgaaaataaatatgaatttaaaaactatatatgtaaacactgtcccaatgtggagtaatttatctgagagaattacgaagtatagaagatagccccactgtgtatcctgccagagataaccagactacagggctctccatcataccagcccaggagtttgaacctatccttttaactatagtttccaaaagaagaacaaaaagccacatctatgataaagatttttatatggttgattgactgattagaaacatctttgattatagcattggaaaattgcagaattagagccagtctatgttggacttcctctttatagccactcattacctatctcactgtctgcatcatccttgtgactcacatgagacccctagggatgtactaagagatcactagcttccaccagccacactcaaatagtgttatcagatagcaacccagtcctgtcttagagatttcccctccttgttataacctggctacctggtctccccacagttgaatttagagaatgtcttcattattttactttgtcttgttttgtaagtataatagcttcaagaagcagcttatatgttagaacacaatatttgagataaactttatctgtattctggagttctggtcattcatatttgacaccaagataaatgatctctttttccctttgaggtaaaggctgtgtttctacattgacagttttcccagatcttagcaggactaaccgaccatagatggggccattcctccactcacccagagctccatgaacacagtgtttcttcttcctcagtgcatgtcttggtgcttgatggaacaagcaagagtttgcttagcaaatgaatccaactattcctgaacctggaaagtcagcacacagagattagattttcatctcccatgttccctctcccacatcacaacacagatatcaaagttttttttttctcagtgccgattattgaacatatggatttgcatgtactaggcacatactcttcctctgaactagatttccatcccccttatgtattagttatctctaaaggaacagacccgatagaatgaatgcatacatattaaaaggatatttataagagcaactcgcaggctgaagcccaagcaatctaacagtggctgtctcctggtagacaggccaagaatacacgagttattctgtccatgaaagtggatgtttgagctgtcctgatttggtggtagagtccccagagaattcctacagagccactggccaatggtccctttggaatccttaagctataggttctaataccagcaaaggaatgcctcagccacaggagagatgacctggacagcagtagtggaggcaagcaggcaaaaagcaaaggcttctttttatccaggccccattatgtgagttctcatcagaggtgtggcccaggtgtaggtgggtcttctgacctcacatgatcaatatttgggatgtgtctccccaatttaggtgatccactcagggaacctctgaggtatgcccaggtatataggttttatttgattctagatgtagtcagtcaagttgacaattaagatgtcattataccttttgttgttgttttgttttttggctttttttgtttttgttttttgttgtgtgtgtgtgtgtgtgtgtgtgtgtgtgtgtgtgtgtgtttgagacagtatctcactacaaattaactctataacccaaactgattttatacttggcatcctcctgcctcagcatccccatcccaagcaatggagagttcaggcataatatgcctggtcagactgcagtcatgttgtgcttgatacaaagcaattgacttgctccatgctcaaggtccaatgttctgtgcatagctcttgcattgagttgaacaatgggttggcatagggtggctaattttgagatgaaaggtctaagttggtgaaaactccttaatatgttttcagtataactgtttacacaggcatgcttgcacgcatgcgcgagcacacacacacacacacacacacacacacacacacacactcagatattgaaattataggtcactataaatgttttatttttgattcactaaactgcataaaacttacacaattaaaagtaccttccccttagggtcaaatgtgtctataaaggaatggttataaaccgtaaaacactctgtacaaatgtgagaggcttatttctaattaaacttaacaaatcagtggtattgtgagaaagctacaggctagttcttcattgctaagtccctaagctgcaaatggagcaagagctggtccactgagggctttgttttcaaggttcatctgactttggacccagatccattcatttgcgtgctgggtgacctagcacaatttgctcgactgctctaaatcactttaccacttgttcaccaaagatactattgccacattggaaagtagtaagaggtattggaaagggctaagaatagacttgtgaacttacctccttgaacctgcttgtacccctgcaaggcatgaggtagatatgctgtcactgtcactaccaaggccagagagcttaagagatttcctctgagtcacacagcctgaagtctgagtgcagaagaccctgcttttagtctccctgacagtattactctgacattgagcatcagggcctgagtttagtaggagcttagcacaacaactctctgtgggcttgcagtgctttaaaaccctagagatagtcacttctatccacatcccctcaccagttagctcactgctgtgagccaagggacaaagggaagatgaaagatgactactacatccacaaaggaacctaccgtcacaggcagggggacatcagactagaaagaaaccccagatacgttattcagcatggcacattctgaaatgttaagtccctatcacacacagaaggatgggagagttgttcaaagtatgagtctggcttggtatggagagctcttccgtgggttccatttcgcaggcaccaagggtaacccatgtgtcattctgagtgtcaggaaggtgagtgtgccaggagctagcctgaggaagcatgtgcgagaaggtagtgggtctataaagcctgagggacaggacacccatcctttactgtcatgtagatgtcccctatgaaacacagcagtggcagcagagggtgagccttccagccagctgactaaggtccaagagcaaatacagccactctgggcttctcctttttacctcttgcccttgaaataacaaattatcaaattgttataagctgaaaacaactttatttttttagcgaactaaaatatatcccatattccaattagatgagtttttgcttgtgagcatcccttcatgtcactgacataaatctcatggcatcatggcctgtgtgccatatgtgatccctgcctgtcactcaacatcagaaaagtaaatattttataggtttttgtggaatttgcagcctgtttgaatggctctttggtgacccaggagtctaattaccccaatttgctaaatgattcctatgtagcttcatatttaggcatctccaaaaccttgctttactgccatcctatagccttctgcttgaacacttttccttaaacaaagtttcaaggaagatattataagacagagacatccttatggctcttgctgtacttcacagattgcttccaatgatatgagcagttcagtgtacgcttgccaggattgtgtactgtcaatttgtttaattttgcccatttcacaggcagaaaactgggatcccaagtttactccaatttacctttatgcctcagaactgagggcttgatgtgttctaccacagggcaagcattccaagtaactctcctgcatctctcctatgctttttattttgagacaaggtctcactaaattgcccaggctagctctgaactcacttcttagcctaggctgaccctggagaccctcctccctttactctccccttacctccagtctctttgtctacattcttcttcttcttcttcttcttcttcttcttcttcttcttcttcttcttcttcttcttcttcttcttgcttacatgtgccaactgcttccatctttttcctttccctcagaagtacagggtagaagagatcactatctttcgtatgtcagcttgtggtctaagcacttaaaacactgcccatctgctcatttgtgtgtcagcttgattatcatatgtcatttccattggatggtgcatctccaaggacagagctccctgctcttttctggctggaattgtatgtagacactcaacaaatgtgtgtcaaatgcatgaattttgtgaagaggtctgtgcatactgtaaccaaacttgtaaagacagaaaatacacagtcagaaatgaaaatgggcccatgtaatatcactcaatggaaatagatgttgccaaggtggcatttttttaatgggtcttgccattcactgaacttattagtgcatgtgggttcactttggtctttggtgtgtggtgaggtctctactttgcttctcaagtatttgacaagttatccccgtgccaatgggaagagatggtaagacagtcccatagaagacagataagatggaacactggaatggaaggagccattattgtaaagccagaggttttgcaaacacagaaccaacacagtaggagcttgctttaggaggagaggacagccgtgtccatgtgtggcagcactgtgagtgcagagcattggcctttctaactttccattgctctttctgaaccagatctcatgaccttcacagtaagctgagattaactcagtgatccctcctgatgtatacaggggtgatcctgagggtaaaaaagatttagtaatagtcttattattccaactggaatttcatgatggttatgaaacagccccttctagatctacattctccttcctctgccctccacctactacagaggtttctgtagcctctgaatcatggaattaaccagatattggggcaggggtggaaaccatgggttaaaggaagcaggaattctgattaattgaaacttctttttatttgaaggttaagcagcagatgcatttaaacttgaccctgaccattttatatgggataatatatgaactaaagacaataaaactgagcccagaggactagctctgagaaggaagaagtcaacaatatgactctcaaattgcctcttacagttggtatgcatgtttgacggctcccatacccactgaaagaatttgatcaaggccttgtgtcttagacattcaaagacactagacacttcatggatattaaaaagccagtgttctgtcttgaacacactaaatgctatgtgtgctaaagatggacctcagtttcttactgcacatctggtagatttcagactagatatatatacatcctcagttaggcatcattatcaagctgttctgtattgtgaggagttgggggttctaaaagagtgagcaatgggacccttgtaatatgtcatgcaaaataccctaagaatatagcacttgattctggccatatattgtcaaggacataggataagagattttacgtggaatagtaatgggccctgtggggctgggctgtgaagtctggatggcagcctggggtgctgactatgatgttttcttgcaagctagagagcctctagcgctcagagctgttcagacatctgctgcacagagcagaaaagcaaaggaaggtgtttacatcttcctggcgtggtggtggtgatgaaagaaatatgtcttcatttttatcttggaagacacagaaaaaaaaaactaaagtagaattcaaaaatagcccataaattccaccatttggacataccccttctgaatttcagcacagttctttgcattacagcttttgtttgtcgttgtgttgtttcttggatgcgaacacattcatcttcttccccaagtttgagccaatagatatatattctatgactggaatttttttcttaagcagtatgtggtgtggtggtagatcttccttgtcaacttggctggatctagaatcagtatagaagcacacctctgaatatagtcttcagaaatatttatctgaggaaggaaggcccatcttgaatgtggcatcgccatgtcatggcttgagacacagaactacattcaaaagggcaaagtaagctgagcaccaatggtcattacttttgcttcctgactgatgacctgctgtgaccagcttcctcgtgttccagatgccctgcctgccctgctgtgatagactgtatgccctcaaattgaaacaagataagacttgggaggcagaggtaggtggatttctgagttcgaggccagcctggtctacagagtgagttccaggacagccagggctacacagagaaaccctgtctcgaaaaaccaaacaaacaaacaaacaaacaggataagtctttcctcctttcagttgctttttgtctgtatttaatactttagaatgttttacttatatagaaaaacatacatttaagaatgctatgtgtcaagcatggaaattgggattgaaggatggaataaaacaaacatagctggattttggttttgttgtttttgtttttgttttgttttgttttatggatcctaaagaccaatggaggtagcaaatatttcattcaaacatggaaatactacccattttcattatttctgaattctatgtttgcacatttatttacccataaaatgtacctgtaaacagcaatgtcaatgttatagctccttctctgtcattacatcccttgtaagtacacaccaaacattgcaaagtctgacttgtttaataaatatgttcccaacacaaacccagcaaggtatcaagcctgcttcttattgtagcttaatactgtaaaaaatatcattttggtggatccctgtatgtcacattttctctattttggttctcttcgataggaactttattgtttaaaatgtagtggtgaagttccatcttatgtcccagaaggctaggacgtgccttccagagacacgggtatactgaatgagctctgttcaggcatgagctaaggtggtattgtctgtgagttcagtgttaatgatcagcaatgtctcttaaacatgatatccataagcagaaacacacacataaaaggggacatatatccataagttgacaataatgatgtgactagaggaatataacccagcattttctctaggtaccaattctgtaattcagggcaactttattgaaaattgccttgagcatcaagaatcagctatatgtctgtgccgttcagtagaagaggacattcaggaatggggacatatgtttaggttttttggcttcagttatttaaaactattagataagcataattttaagacaaaataacatcattgctgtcatagagatgcagagatgagcatgattttatttaattcatgaatgaggaaactgatgagttagtcagcagagaggataacttgaagaccagaatatctgcatatcaggaatactgaaatgaatatgcaaatcaagcaaaactggcctttttctttgaggggaaagttgtccctcttccagaaagaaccatttgcatgtctatagacaagaattatgctgtattgctctcagttagctacagtttccagagtttccacagctctatagactcagcatcagatagcagggaagcaggattatagacaaagcatgtgtcccaataaaactttttttcccccacagaattctaataaatgtacttaacctatttagagtatgtggaagacaaagaagctaactctaaggaaaaccaacaccataagggtgggttgaagaggcagagcctgaaaacaaggactttcagaagagggggacaaccaggacacagccttagggtcagctgcaaggttgaggatggaaaactgtcaaccatctgaggtaccacactaagatatgctcaaaacacccctttggacctggcagcatggcagtactgacttagcacagacagctcttataggatatagcaggcacaagtggtgtgagtgggtagaatggaagcagaaagaagagttattttaagttcctggtatgctgtcatatggctgtgcaattgattatatggctgtgcaattgattatatccctggatatatgatttctggatatttaggtctttttaaatattcaaaaattataatttatatcttgatacacacacacacaaacacatatacacacacatacctaatttttccttgaataaattcctagcagtagctgagcctctgagcctttcaatactttttttttttttaatggatcagtttacacccagcccaactgtggacaacgagtctttggttggttggacacatgcatcatcgttattgtgcgttctctctttgctcccttgtacctcctaagacaacaactctgcaaataagtagtttggtgttcagagctgataaccaatggctcttatttcttatcactgcttgcaagtcacagcctctaatttggttatttggtgccaaatcaattctttcccttgttggccttcattcaggttaaatattggcaggttgttatctttccttttggctcaggttagccaggctctgactgagcacatgacatcttcctttctttctttgtccatttccttcacagcctcccatttttataacagcttgcttcctcttaggctatgaccactgctctatatctaagaacagtcctgtcttccatggagggatagagggactttctacctttatgtccctaaggttgctttctctctgtgttttcaaaataaagattttgtctgtagttgatttgccttgaagactttcatagagttgcatgcttgttttcttgtcttgaacttctgttcacagttgtgtatgcagaactgcactttgcacaattcttattataaaagtcctcccaggatgtcttaccagttcctgtggcttgaacccatgggcttgccctccttttgcctaaaaccctgcctatacaactaagtgctttccctatccatcatatacctacctcaaccgaccaatccgatgcccctttcatggtttctctcctttacccacctcctgccgacttctctgtcttaattctatttggtacaaaagcgatttgtttctgccctgttcagaaatctggggtcatttggaattttcctctttctctctttcccttcatgcccatgttgggaaaacactgtgcatttcccctcctcatccttatgttggtcacttcttctttgattttactcttccacccacagacaaagcctgtggaccctgttgtcacaaggtattctgtttttctttttatcttacatgtattaccaactgccttaccaggtttgaggaaccaggaaagtttctaaggtagatcattgccattttttgttcattttctagtaaattaggttctatttcaaattaatttttattattctgatttactttattatatcctagtggattttctcaataggaggggaatttatataaccaatagattcaaatacaaaatggtgctattggatctgctagattgtcacactgaggtgaccctcagtattactcaatggcacacacacacacacacacacaatnnnnnnnnnnnnnnnnnnnncaagaagagatgtctctccacttatttccttagtacctgtcatcatgatactctgtcctggtgtggtggcttgtgggactttcggttttgaagtgtgacctagattcatgctcttgcagcatatcagtggtatagccataggcaagtttactggactttgtaggacctcttctgttggcttggagtgacagtctgcctcttatgaggctgtctgcacataagcagcttcgtgaagagtggcttagacacttggaacatgacccatgacctaagaagatggtgagtctggagagctgtttttgatgagctgttctgaaccttgtggcacctgtaacgagctactctctggatcaacccatagctaatgccaaagaaaccctttggaagaataccttcaagcttgtagtgcgcctactccaagagggagcagcctgacatatttgggacaggattttctcaactgtattcagggtcactgtgttggatgtcctccctcagtcccttctctgcctgcttgtctgttttgggaggtgtatgttttcactgccattcatcttcctgtgcaaggaaggagccttccctcccctctcctggaccgcttcatctgccttcccttcctattgcttattgggaacctgcttctctctattccaagtgctaccaccctccctaggacattcagtgtaatcatgccaacacatgtattgcgccatatatccccactttacataaatgcagttctcccccacttttgtctttactgccattcaaaggccttcatgagattttccaactttccctaggccatccagccccctttctcattcagctccatggccaggtgctttctgtgctcacagaaatgttttagagcctgaagggacaagatatgaactcaaacatgtattgaaacgctgtattatcaaagtaacaagcatttaattttatccataatatactgaattttcttcatatattgtgtatgtatatatgtgtaatacgtaaactcagtagcacaaagaccttgtagggatgacagtaaattgcaggcaccatcaattatcacagaatgatagggaaagaaaaagttaaatctcctatagtttacaggggcaaaggcatagcaaggggtagctaatacagacagaggcagagagcaaagacaaaggggtcccaaggttgaacctgatcttcaaggccagtggagctttgaaactctctatcaaaccataataaaacacattacatacttcctccaatactaactataattttgtcatagttttgcaatgttcataaaaataaatttgcttttaatatcatttggttgttcataatttaagcagttataagtgcctattgatttttctaatcactttggattttgagaattctttgtgcaagaaaaactaacctatagtttactgtttaaagaaataaaatttttgaacagtaaatatatatatgatagtaaaagcaaatttatttttatgaacattgcaaaattatgacaaaattatagttagtattggaggaagaatgtaatgtgttttattatggtttgatagagagtttcaaaactccactggccttaaagatcaggttcaaccttgggacccctttgtctttgctctctgcctctgtctgtattagctaccccttgctatgcctttgcccctgtaaactataggaccatttaactttttctttccctatcattttagtgctgtgataattgatggtgcctccaatttactgtcatccctacaaggtctttgtgctactgagtttacgtattagcactctagttaagagtacagggctttgacataatgtagattgttcttattattaattagaaaatatgggtttgtcgaaagtgactgtcattaggaagtagaatgtggggggatgcagaggtggacttgagtgttgcccatctcaggttgccccaccacatgtactccatgggaaccaaaagatgacctattcaggaaatctgtgcagagtcacgtggcatgacacagagatagggagaagacagggactgggaaataacccttggcaagtggtcagaccattaacattgaccttaccattaacattgaccttacccaggatgtcatggctatcaccttcccctgtgcattccatagaaggtaggagaggctatggtaggcaggatcagttctaacagagtaaatagggtttctaagcaccatgagactaattggtggggaggaactcattgttccaagaagaagccagggtatgatctcccaatgacagagcaacagtggtctgggggaatctcaaggacaaggactcacaaaatctctaaaacattggtagtctagtatccagcatagcctggcagtaagcaagtgcccagaaatgtgttcctgtaataaagggctgcttgtcacaaccatgtacatagcattgtgcattcagagcagatagttcccctgaaagactttctgcagctgccctgatttcttaatgaaggtttaatgggtatttttttggtcattagaatagaatagaaacaggatatatggcagatctgttacttacattctctaagtgtgtattaatagcaaccgaagaatagaaacatctcttaaatatattgcatttatttatttgtgcatgggtgagggaacacatgccatgcgaaatcagaggacaacttgtaaggttggttttcagcctccagtgttgggttctaggaatcaaactcaggtcttcagacttgacagcaaggcctttagctactgagccatctgattggtccaatatcatctctcattaatttatttcagatgaagaaaaagttcagagaagaaaccctcttcctgttggctgcagggttgattaggggcagtgcagaggacctgagcctttgcctaaagctcctgcttcccctccccccactctgtaaggccacctcacttgaataccatcagaggtgttctgaaaagaggagacttttccttggtgatgagaaacctccctgggcttgtagtcacaccacacagatctcagatgtggccctctctctgtctcataatgattcttgctacagatttgagaacctctaccttctcatctgcaaaatgggaattttacctgacaggcttaaaatagggagatggataatttcactacagtgttctaaatagctgttttaaagttagaagttagtatagtatgcccattgtgttttgttttctatggttctgaggttgaaccctgggtctccacacactaggtgaatgctctaccactaagccacagtccccgacccacacgtattttcttatatttcactttggtaagtgaggaggtttgaccatgttcattaattctatctgatccaattaagcctgtgtctgttgtcttgtttaatctctcaatttgcaaacatttctctataaatgctctgttctatcataaatcaaacccaggtttgacagcatctaaatataaaagccattctgttgcccgtgtgaaaagacccacttggaaactgggtaaagtactctttctccactgtgatttttggagggaggggcaattttttttgaagatcttccttagagaaatggaagtttatatacttccccaatagctggagcatctctgggatttctcagttgtgttattttcttgtggtgcgcacacaaggctcaattacatctgctctctcttcttgtctttctttgtcacagtgacagagatgaatatttcctgctctatggttattttcctgagaagctaaaaatattggaaggaaattagtttttctcttctgccttatctttgcataagtgttctggggggggaatctcagagcagcttaggagatgacctctgctttattgtcactatagaaccatgacataagcccaagccacacagagtgaaggcccaggctctgttgatgttgaatctctcagtaagggctggcctctctgcctatctgcctgaaagaatcaagtgatggtttggatgagactactggtcaattccaattgagtctcatcccctgatttgacaaggttcactcccctgtagctgactgactattgttcatgactgatagcggtgactgatacatttttgaaaatagtgtgatcccagtgagaaaagagatatgtgtgtgtatgtgtgcatgattgtgtatgagtatgtgtgtatgtatgtgtgtgtatgaatgtatgtgtatgagtttgtatgtgtgtatgaatgtgtgtgtgtgtgtgtgtgtgtgtgtgtgtgtgtgtgtgtgtgtgtgtgtgtgtgtgaattagttgggagggagaaagcactgctttgctcctggtgttggggagtgcttgatgcaaatttctcagtgcttcagttattgccttgtcattgatagggtaggggactgagtactggttagggactcctgggtcttggttttgttattttcttgaagaagtttagtaatgcctctgcacttctttcatcctaatttttaaacttttttgtttgagatttgcatacatgtctaaaatgaaatatggtcatatatattctccatttgctccttccagcttctcccatagtccctaacacgtctctttcctaaattcataccttttggtaacccatgaactaagtccaatttgtgctactcatatattctgagtgtggggctgttttgtgggaccatgggaagcctgccagtagccacgccttcaaagaagagtgattttcccctagtagccatcaactgccatcgcatctcagtaaggagtggagtctagagatcgtctgcccatctaggagaggattttagcttggtcttagtgtggctcttattcaagtagtcaaaggcactgggagtttgtgcatgtgatacctgttgtcatagctggaagacagcatttcacaaagcactccctccctccagctcttatattattttcacttcctctttcaagattttctttagccttggcagtatatggcatgcaaaacatgtccgatttaggactgagcttctttttcacaaagcaaaacaaaacaaagcatgccattcaagagatatctaattacctaattaactaatattttccctcaccttttgtttcttttcttctctttcttcctttttcttaattgaaaaggggtcttatatattccaggatgacctagaacttctaatcctcttgtcaccaactacatgatactaggatgacctgttactaccatgtgctactaacctggtaactgtgtacattttcatgtggtgctgaggatccaatcccgggccatgtgcatattagacaaacactccactaacttagcaacatccagagcttgccattcttaccttcttattaaggttggatctttatctggtaatggctaaaagactacatttcccaggaccccatgcagttgagtacgaccatataactaagtttttatcaatgagatataagcaaatgggagcattctttgtaaggggccaacagttagttatggccacttactgctttcattcacatccttctgcatgacaggtatagacctgaggtaagtaaaccttgcctgcatccaggagcagaagtaaggcactcactgctttgtgcttcagacccttgagtgttaagtagattctcatactaactcagcttggttgtctctaacttcagaggaaattaagggagcgctatatctccttccactcaacaaacactttttacggtagataaagcccttggttcctcagataattacaaggagcaagggcattattggtttgtccagtgatcatatccgtttgattctgaggattctagtgatctttgataaagatggactttgatcaggttaagaatatgtgtcaatgaattcagtttggaggacatggcgagaccacagcatgagaaattctgtttagatcactctagtgatgggtgaataacgaggggacagagtgttctgcatgacccgtgtggtaaggttgtaacagtgccccattccagagcacactgcttatataaacttccatggacttctgcagtgggacttgtaaggaattccagtttaggcttgagatgatgtgttctgggctctctcagacccaggacagctcttcatgtgggcaggctctcactaaactacagaacaggctctctttaaagctgtggttctcaacctgtgggtgacgacttctttgggggtcgagtgatcctttcacaggggtcacctaagaccatctgcatatcagatgtttccattatcatatataactgtagcaaataacagttacgacatagcaatgacaataattttatgtttaggggtcaccacaacatgaggcaccgtattaaagggtcacagcattaggaaggttgagagccactgctttagcggttgtggaagagacataagtggaaccataagttttctgagactgaatgtgagggcttctctgccttacatgtttgtttttctctggggacaaagggtgtcttagaaatccagacaagtgacctaggataaagataaatgactgcagcatcccctttctctactaatgacatatattcacagaggaccccaagagtgaaatgctgatggaagtgaaccattgtgttcttgtaagcttcagactgcaatatggctgctggcaatgcagcaaattaaacaaggtggccccagacccaaggctaccgaggagtagtgtaaaactcaggatgagccatttcccctgagcatcagaggaaagacatggatgggccacacccaagcctctttcctctaagtgttctgggatacagtgctaccagtggagcagcagtcatttcttatgtggcttgccttctcccttagttattacttaaggatttcttttcatccaaaccatttagatgagattttcagcatccagggggtgaaagaaagcagaatctagatgccaagcttttcttctagttttgaaatctgggaggagctggtcactagaacctgggtttaacgagcatcagccagcctcacagacagtccttgttagcaggtttaggaagacatagccacatccccatctccctgactcctgtttctgcctttcagaggcacagagggtggcatgtgaaaggacagtgttgacagaggcaaggtcatggggctgagtgctaagtcctaggtgaagagcaccctggagatctgtcttattttatggctgagactctggggaactcgaaaattgaagggattcatctattaactgtcacagctgggcttctgggcaaggctgaacggctgagaaatggagcctgaagtctgccggagggataggtcaaggggagcacctggctgttggctggaccagagtggggagtatgaagggccatttgtttatctcgctcattcattcagtgggcatcttttctgtgacgcatactgagattgaggggtgagagctattctcttctgtctcaaatggctcaccatctcatccaagagagacatgtatgagctatgtgtgatatgcaggtatataagcaaccatcctgggtggggagacattaaggcagagactgaggtagagagataagtaggtgtggtttcttagaagaccttataaggagagaaagaaggaggagggactaagtcagggtagggccctttcatctgctctctgaagctacagattctagacatgagttgtgcagttaactctatgactctgaaagtgctgtgtgtctgtgttctctaacaggagaactaccagcagagagtatctactgtgccctcaaaatgtggtcagcatgtccaagttattaactatttgttgtattcagttctaatgtattaaagtttatatatgtacctatggcatacggctgccatggttaataacacacctgtgaagcttaaagttagaaagattttaccctaaagatgccttaggcctctgaagcaattctaagctgctattcaggcgggaaaataaccaaccatggacaggacgaaaaaaagatgtgactgcattcttccagtagctgttcccaaaacaaatgtgagatcttagtttagcccatggatcattaaatcaaaagacagagctttgtcctccacctctcttcagtaaagggctagccttgtatagcccatgacagtctgccattacttgtgggccactagggaaaggtgatactttatgggcaaagtgaattctgctaattgaaagagatttcctggaggaagcagagggtcctggtgggttgcttagatttcttaatcaactgccatcagggggtaaggggaaccaagtagtgtctaccagaatcattaacagttcctactgtgtgctcatcatgggccaggctagtattggacgagattctcctgtattatttccatccagttttttaatcttcagaatagctctaacaccagcgattcatgtcaaattcactggttttcaacagtttgatttagttggctttgtatcaattagcaagataggtattcagtcatcttcccctctctgttatgtgcatcctacctggaacatacacatgatgcctagccaggtggggtttttcctgctggagagcttttatttgcttttaaagaccccaatgaccttatcttccttcattctagatgtttctgtttactctcttcccctgtggtgttttccactccatgtttttccttcttattgggaaatctatgtctcaatgacttgtttcaagtttgtgcaaagcaaaggtacatcttgttttggctgtatgtggtttctctgggagatgaccctatgaaacacagaggaaaaagttgaagagacaggaaaggatcaagcatggtgttaacaggcagcctgcctctgtgtttctttctatggacagccttttagatacacatctcagaaagcagacacatgtccctcttcccttagactctaataggatgaaggttgttgctctaagtcactatcttaagacccaaggacaagcatattttattctttcagtgaatgtctcttcctcaaagttaagaccaatatagcaggctgcctatgatctccaggctctgagctgatgctgacaggtgttatacaaccttcataaaattttactagtcattcaaatccagaaggtttgttttccttccttccttcctccttccttccttccttccttccttccttccttccttccttccttcctccttcccttcctccctccctcctaccctcccacctgctctccctccctccctccctcnnnnnnnnnnnnnnnnnnnntcccacctgctctccctccctccctccctccctccctccctctctctctctctctctctctctctctctttcttttcttcatctcactttttcccccactctctccctcccgccccctctctccctttcccccctctctctcagcttcatgggatttgttgccaataagggaagtcatggctctcacctagtcactccccagagagatttcctggctgctcttaaagacaggtcctttagggtacactaaagactgctttgctgagtctttctgtttaagggatcatttctgtagggaaggcaagttgggaacttggctctcccaggaagatagctttatttctagtccatcctctggctggtgtactaggttcaactcgataaattcagcatgacaaacagcatgatcaagaagttacagtaagtccctaagatcatccctgcatgatcttaagcaatgacactgggaggattagtgaggctgtacccttctgcaggtcagtttcttcctctgtgtaatggaggtgatggcaagccttcagctggactgcaaaggaggaaatggatatgtacgtgtttaggactctgggaagcgcaggtggatgttagttatcgattacacactaagtgctgggattaaggcagtgtaaatggattgatgataattatcccagagctttactctaatatgtaggaagccatgactcttattcatcattggctaaagaggtttcctggctgctcttggagacaggccctttagggtacactaaaagatagtttttctgtgtatctctgtcaaagagcttatttctataggggaggcaggttaggaacttagctctcccaggaaagtggctttatttccagcccactctctggctattgtaccagaacttgaggccgacacacttgtataggtgagagcctgacctgctaatggtgaatctttgagacaagaaagagataatgtgaacttggaggcacagggcacaagtacattaatgtcctggttttgtagtctgcactgataaggtgagtacttgattactggatatgggcttttcatctaaggcacccattgtagatgtcagtacagagtctggaatgttatgatgtgtatattggaagtatgctctggtttgaggtgaggtatatattctgattctagaggctgcagaacccaaaaataaaaactatcacagagttcaaacaacatagattaccaggtctaggagaaacagggttgttaaacacttttagccacttgaagcctcagtcagtagtgggattttggagaagtggtgagagacagagacagggcctgagctgatttccagcaggacaattgggtagcccatacatctcttgctttcagaacactgtgtcatgaggggcactcaatactacaagcctttccatatctatataaggcatcctttcctgtggatgcatcctaatcagagaatgctttgctagtgaatgagaaagcactacgacctcagagtggaaggctcaggatagcttggtttgagaagcagcttcttggggcagactgaggagtgtataatggggactctgagggcaacactccaagattcaagccttgacttccttatttagtgaccatttgactttgggggaggacgtaagttatttgtgtctgatttttccatctctaaaatgaaggtaatgtcaaattatctcctggggtttgggataacaaagaaatgatacaatccatgtgaaattttgtcacaatgatagttcagtagatggtatcaatgtgtacaaagagaacagtacctgagaggttgtaaaagtgactgtgtacataataaggctttataacaaaacccatagaaccttggtggcatataatagacacgttactttgtatgagtctatgttttatcaaggcagttgtgttggcctgaaccagacctggaggatgtgcatactggatcagcatgtagatcatctagagctagatggcctgggtagcctcagctgtgataatgatactttgcgccatgagctctggaattctccagcaagctactttgggcttgttctcacagtaggagcaggggtccaagacagcaaggaaaagttcatacttctcttcctatctttcacttgtctgaagttttctgtttttacgttgtccaaaacaagtcatgtgatcatgcccagtgtcaaagtgggaggatggcacctggttatggaacaaaacagcagcgctacaaacaagcaactaaacgtggctataaatgtaatcggcagcactctggtctttctaataaacttcccaagggagggctagtcttggcaatgctcatttcaataattcatctctctcactagctaattgggctttttctcattgggagttactgatattaaaggacataacactattaccatccactaggctctttgttgatgccaattatttaatatttctagcttgagaggctgtggagagtatcagtaaggtaatttgcataaatccttttgtttaactcagagcagacaagttatattaactctataaatgtgacattatttctgtggctgttctattgactgatttatttgtttgttttatcgatactgtgtattaaacccagggccttctctgtaaaagacaggtaatgtaccagtggactcttccctcagcccttactttttattttgagacagtgtcttgctaaattgcccaagcctgattagaactaattctgtgatccagccaagctggaacttatgaatttcctgtctcagcctcccaagtggctgcgatgacatgcctgtgtcaccacacccagcttgatttgtggtttatttcctttgttttgatcatcctggggatgagtgtatgttatcttactctcaatgttggcatttccatcccatcttagcagatgaatctgacttaggatgttaacagctctcccagtgtcacatagctagtgaggggggagacctttcttaaattaaaatctggaatagtctttttatggagtgtgatgtgaaagagagaacacaggcaacggtagaaagtttgagccaaacctaaggtcatctcattttgggtcgaaggattttagttctgctgggcaggatcttacagagtatgcagatgctcttctgagtggacagacactttagccactcagcacactcttgtctcccagactgaccttccaggcttcctgggtaggggtgctactagtacagaaggttagctcacagatcaggattcatttaattggtagatttttaaatcttctggggtaagctcagcaactccgccctctcagccccacactagctttaaaggcagttgttggttccattggaaattagggtcagtaaatgaccctaaatttaatacaggtggatctaccctggagctagtgttcaatgataccagagaagaccataaatgtctagtagaagcagttttctagttcccagtatccaggaggaatactgccttcagccctccctggatcttgttgagggagaaacaagagcatttacatttaggaagtcttccaccatccctgcagtaaaaactctcagtgatgactactaatgtgatttcttcctcgtaagctttacgtcaaaaaaaaaaaaatcttgtacttacatgtatgtgaatgcatctttatgcatgtatgcacacatgcatgtgagtagccactgaggccagattccatcaggcatcctggagttggagttgcaggtgtttgtgagccccctgatgtgagtgctgagaacttaactctggtcctctggagaatgctctggaagcattcttattcaacaaactatctctctagcccttaaatgatttcttgataagtgttaggtgggaatagagggacaagagagaagaagaaaggattctatcagaaaatatttacaatccatcaaaatattatacactcttacttaccctgttgcttattcatctatggctccactgtgttctaagggtgcagttctcagctcatgtcaagatgctaaaagggacactgctggcagtagattggcagagtcatttcagaagggactataaatgtgtaccaaaggctttaaaatggttcatagtaatctaatataggagaaaattaccataaagaatcaatctaaacaaggatagaactacatgtggggaaaggtatgtgagcaaaaattggaaacagacctaagtgcccgagaataagataatggttcagtaaatcatggctagtctacttagtggaatattatgtggctattaaaatggtaattatagatgctattgagcaacatgggaaatgcttatgatagaatggcaaataaaccaacccagagacaccattgaacatacacaatgattaaaactatgcaaaaatgggcttgtgttgtcacaaatggtgtagcaccagcaacaatacatattctaaatttccagccagagggaggtagagtaaggcttctatctaggaagcaaaacagggttgactaatcagggttgctcagagcaaacggatggcaatctcaatagcaatggaagtctcctatgagttttaaatttctttagcaagttttattttgcaatgaatgctgcagattttatattgcataaatctaagtatctttatattctacagttccttcaaagctgtgtgttttaatgtatatcaggattcaagcaacacatggcccagcaagcccatttgatgagctccttggacctggtaaaagtgggtatgctagaggactttggaatgaaactagattgcagtgggtgaaggcaaggaaggcatgggatgtttagacaactgtttcatgagggtcaactgtaaagaggaggtgtcatacaggttcattgatactgaaggacatttggttaaaatttccaactttaccatattgtttgaaatgtcatgattgctatatttagcccaaatgccgatgtgatgaacaatgtcagactaaagaggaacacccaagttctagagtgaagtgtaaagcagttaatgtctgaatagttctatagttttcctttatacaacctaaaaagggaatcttttgattagtttgtgtctgcttttttcaagtttagagttaccagagtgggaatgtagatgttgagaatcaagaaaaccaagaggctgagataaaacaagataaaatcttgtcctgtagataatgacaggatcttggggaaagtcctctggtaatggtttgtttggtttggtttggtttggtttggtttgccttggtttggtttgccttggtttagtttggttaggtttggtttggtttagcagaatcccatcctttgtgcttagtgatagttttcccttttttgccctctgccagatgctgaagaaattgcagagagtggattggagctgagatctggggaatgctatgggagtgaacagagctaattaggagctagaacagaagcagctccaaaggtagcgagcagccaagacaccggaagtccagtgctctgaggaaatcaggaagtcctgtggtcctctgagcaggaagtccagtgtccaaaacttctaataaagatgaccaccactgctctctgtcctattatttcttggcttgtattttaaaagtgcaaatgccagcctcaggtggctacagagcaactctaaaaggataaaattatattgtgacaaagacaggttccttgtaggagaggtcaagtgtgaatttgggcattttttctgaactggctcaaatttaaaggttaacttgtcctcctactgggaacattaataactaaaagcagcaaatgggaagataatttaaattttttatatttgagttctaaaaatctacctcaagccttataattaagatgcaatgacaatctttgtaacaagaaatttttcccctggcttttcttttaatatgaagaacttaaatgggctctgcttttataattctccattaatttataggtttattttattcagcatcatagtgtctaagaaaactctttataaccaaaatgtaaaactcagatccaacacacttattataaatattttaaattaaaatgataatgtacccaagcatctgagtgaagacacttggacaaaggatgtggatactaacagtgaaacgctttctacggtgtttatttagttctgtcacttggccttcagtatgtattttatttccttatatctgaacatgcactgctgaacattcagtctcttgaaaatacattctgtatagcagaggtatgcttagttggaaatgagaggggtaggtacacattaaccattttttttttcgtggctcatcttcataatcaacataactttggaccagtctgtgatgatgtttcccctgagatttaacagaagatggaagacccaccctgtatatgtggcctgtaccctcccttaggccggggttctgaactgcatcaaaaagaaaaagaaagaaagctgagtgccagttttttatctcttctgcttcctagatgcaatgtgactagccacctcacatttcctctgccttgccttcactctcttccctgccttccctgtcatgacttaatgttccttaaaacctcaagccaaagtcaatccttccttccttatgtggcttttgctgggtatttgaccacagcaataaggaaagtaactaatatgacttacatagatgaaagtccactgggtattaagttataaaacatgagctggactttgtattttatccatagacttgggaatgagaccggttgagaggaaagcaagtgtaaatgagcacaaaaagacatgagttgtgtttgtacatggttgggactagtcctataggaaagagtgaatattccaccctgctagactgatatcccagagcagagttccgacctgttgacctgttttatggtattatcaactctcctttcatttgtgaccaggtctcaactttagtcttggtgacatgggctaaggctgttaaactaaatgacagagtgcaatttctacagatagaatcagtgctatgctgatatttgaccctctcacacaaaaaccctgatcatcagtgttggccaatcagcataatatctccagtgtgactgatttcaaggtcagtgtagaatagcaggatataggcttagaaagagatgtgcacagttagcgcttgggaacagttacattatacaattctttatacctaggaggtttctcatgcagtgtacgcccttatttatagattgtttatgtaaacccaggattgggtttgaaaccttcaacccttgtcttattgctttgccaacctggaagctggcttatttaggttagagttcatttatcccaactactctgcttatttaacaaatattcaatgaatgcctgtcatatatcatctactttcttgagcattgaatataacagcaaatgaagaatggagtattagtaaatgaatatcacaaagtgatatgaaaacttaaggtggaagatataaaatgaacaaaggcagtagtctgttcctgatgcaaggctgatggaaggcacactgattacaagtcatgccatcaatgtccaccttagaaccccacagtgcatatgtccaccttaaacccctacagtgcttatgtctacccctacagtgcatatatccaccttaaaaccctacagtacacatgttccccttaaaaccctacagtgcatatgtcccccttaaaaatcctacagtgcattcttgcagtcacatgtgagtgtactgctctgtttgccagaagtttgcttctccctaagggatttttgtctagtatatacacatccactatgataatcgtcttcaggctgactttttccacctgctaggaggtagtaaaaagaacaattcacaccacagcattaagattttacaagctgcatgtgactgatatgaattgttcattggcacttacttttaactattaaatattcnnnnnnnnnnnnnnnnnnnntcttgagcattgaatataacagcaaaagaagaatggagtattagtaaatgaatatcacaaagtgatatgaaaacttaaggtggaagatataaaatgaacaaaggcagtagtctgttcctgatgcaaggctgatggaaggcacactgattacaagtcatgccatcaatgtccaccttagaaccccacagtgcatatgtccaccttaaaaccctacagtgcttatgtcccccttaaaaatcctacagtgcattcttgcagtcacatgtgagtgtactgctctgtttgccagaagtttgcttctccctaagggatttttgtctagtatataccacatccactatgataatcgtcttcaggctgactttttccacctgctaggaggtagtaaaaagaacaattcacaccacagcattaagattttacaagctgcatgtgactgatatgaattgttcattggcacttacttttaactattaaatattcttaattctccacccatgtgagacttttgatcgcccttggaattataaaggaatacgagggcttgggtaccctctatatgatcacaatatgcagttgttcttctgatgtttgaatggtctaagaatatgtaaaaatagccaagcacagggtcaatgtagcctcatattactgaaatcattagtcagctttactaatttcataagtaccaattttaagggacatattcagtattaagtcaaggacattccttaaaagaccatggcagagacctcactgctagctaatagttatttcttgcgagtcatgtataaaacggcattgtatgcagatgcatacatgctggcatggacattgggcttacagaaaacagggcgatgagggttaactaacaatagaaaatagcatccagtgggtgcttgcagctccatgtgggtctccttctgggagctgggtttctatctcaccattctcattatctatataatggaatcttacctaggtttatacatatctaaaaaccaaaataaaaacccaaggcttccaggaagagatgttatgaactctatatatgtacttctggaatcttagcacatccaaaacgaagaattatgactgtgtttgttcaacaacagtcatctatgcacatttctaaacatatctgttattctcattacaagcaattccagcaacaaaagaaataacaatttttcagggattataagttcatataattgcacatcagaggaaaatatggatattaaagcctcgtaaatgttgaaatgcagcacattgttgcctattattttttcaatttcttgctcatgaatttcagcttgaagtacatccatccccccacccccaccaccaccaccattttgccctcttgtttatagatttcaggaataaaatttaccatgacatggaacttaagtatttcttgctattgaaattctctacactataaactgtttattgcaatatttgcttccgtagcttccatgactcctctagaggcatgtgcgtccgtcgggttttagctcaggcttctaagcctgtctttctaaagtttgtcatcctaggcccagggctttgagtgacttttgtccttgagctctgtcatctttgtgctcccaaggtctttgtgataaaggaagaaagaaataggtaggacccactggctcttcattacccgaacctaacaataagaagtacatttgtgcttctagcccattggcctcagcgttttagacaagttgggcttcctgcttcagttttgtttgtatctcatctcaagactgaattgggaatcatcagggaactcacaaaactacattcattctccctaccctcaattataacaaaatgtcatactggagagtaagcagaagctgccatttcctgtctgtgtgatacagagttttcaaattatgtggctactctccgagtgaagttgtgtgtcctcccaaagattgtttgctatttttagtctggaagatgcctagctgcatttgatctaactctgggacataaaatacatttagagtttcaatatttgggtttgtctgctactctttgctggtttcaatctaagagagcaagtgcatagggttttctagtgactcgatttcaggtggcttctgcagtgatcaagatggaagacttttcaaaaacttagaatgttcaaagtctggtttctagcccgagttgtgacaggttgtattttgttcttcatataaattgcaaatggagatagagactgcagtcattctcataatacatttttccacttggcagggtttggctgagtattttctgagttgtcctttcgaaatagattgcctattactagacttgatagatactatcatggggaactaaatccactttcatgacaaatctgtgactcccactgctgggactcccataagcaaatgacttccagcatatagtcctgaatgccggtctcatcaagccatccttgctttgatgattggcaaaaaggactgacagaactcaggaaagcgtttacaccagtggtcacagcttaacatggtaagagaacataggttgagatcagcccagggctgatttgaatgagtttacatggtagaacacaagaagaaccaagcatgaggcttcagtctttccctcagtggacttgaaacagtagtgtgtgtgctcagctataacatgtgacaacacataggaagtggccaagctggccatctcctgagccttgggttcctgttttctaattaggggtactataggcttaacatgatcatttgactaaacccaactccttggttgaggagctggcagtcctccccaggggccaaaatgatagaacatagcccagaggtacagatggacaaaaacaggcattcacaggcatttgttaagcatcaattattgaacatgccccaagatctcaggaatcctaagggtcagattagagacctcaagggtttctttaagatctcatgcccaaagtagggcagggtttcctttgttgtacagcattttaccccttaaactttaccgaattgagcctttttatgcaagaaacatgtcagtctctgagagctgcctcaaccaaagtcagattgcttcttagggcagctggggtcatgatccattgaaatacaaggtatgaatgcttggtatcttggccttaccacaggacgtttaactggaccattctagctctaggaggctgactgaagctgttcttgagtctccaccacaactgtactctgcctcactgctgctaacccctctttatctccatagctgttagtgtcaaggcaaccatgtgatgagtgccgtccttgctgagctccgagtcagcttctcagaggacctgtcaggtgacaatatgtgaatcagtatattcagttgttggtcattttgtctcttctgaatgattttattttggtcttgtttgccaggatcattattgaattgtggactgttgaaagtgaagttggaggaaaaaaaagtgctttttcttaaataaacagtctcaatgtattcaccaccaggtggtagaaaaattccatcttttttctttaaacctatttccccaacactaggcttcatcttcttggatttagactttttgttcaagaagggtacaattgtctttatgttatctcaggttacaaatattaattcctcatgacaccatcaaagatcttgtagaaaataggcatctggctgatggactggttgcaggcacaattgctttagttgaggattcttctctctgaaattttttcttcatctttctaccatgactaagataagaagcccccaagaatgaagtcctgtcagtagtccaaggggacagaaatgtcagtcacatagagagtatctgtgccatcaaaccctgtgcatggtgcttcccatatttccaacgttactgatcctaacttgtagctaacattcttagtagtagctacctatatcctgctgtcagggccgttgtgagttatattagactaatgcttccagtctctaatagctcttgtttctggatacctgcccagcagatactttaacaccttattttgtgtccacacatttgtataaaaaaatttgtggatatataacataggattttgagttaaagtatattaaataaataaagtgttgaaaaccaggggattttaatattctgtttatactatgaatcaagtcacacaagagttgaaaagtagcaatgaattattgacatctatatacctgggtagaatctgatgcagcataattctgtcctccttgcctgatggtgagcaagtatggagctcttttccctctctcacccttagacataatttttatattagtataaaaaaattgtgattttattttggtctgtttgccaggatcattattgaattatcgactgttgaaagttaagttgggtggcacaacaaattctgtaacaaattagcacaaatattgtagtttaaaaaataagtatattatatgatagttacacattctcttctaactttctagaggtcaaaggtcaaaaataggtctcatattgacttccagaagctcttggggtttatctatcttttttcctctcctagctactaaggcttaagtgaagttctggagaagaaccttcagatctttcttgggcactagtctctttcagttataaagacctttgtaattatttgaaccaccaggtaatcatgagtcagaaccctttttcaagatctgtaatcataccagtagagcacatcttataaagtacagtgatattgttacgtgttttggtggttagggtgtaaatgtctttgcaagatggtggtgtgggatacagcgcttcttccagttgcctgtcatagtgggattctttttttaatttttatttttaatttttttattagatattttctttatttacatttcaaaggctatcccttttcctagtttcccctcggaaagtcccttatcctctcccccttccccctgctccccaacctacccactcccatttcctggcccaggcattcccctatactggggcatagaaccttcacaggaccaagagtctctcctcccattaatgaccgactaggccatcctcagctatatatgcagcttgtgccaggaatctctccatgtgttttggtggtttagttccagggcgctctggggttactggttagttcatattgttcctcctaggaggcttcttgatgcactatggaacccattgccacgaacatctgttttgttttctttattttgttttgtttttcccaattgtgtgactacttctcagggatgttttgagttgtacctggttcctctgttctttgatctttggcctgtgatggggcctgttcactacaggtcagctttgcattctggtctcgtcctgctctttagtcaaccttaagtcactgctggtttcataagctactctctatgttcagggtcttcactcagaataccaagggacacatgggttctgcaagtgctagagggccactgagaagagatccctcacaccaggtacccatagaaaatactttacaataagcaatggtttaaggcatcctgataatggaaggttggaagatagatcccatggtgtggacattctcagtcccatgcggtcacattcccctcttgctgaggtgtgcaccagctcttttgtggcgtctctcatgacacagtttctttaacttgtcctcttcttaacacaccatcaccatagtcgactgttgtgtgtattcattgacaactatagttccattttctctatttagaaacaaatgtaattacttaaactaaagaagaaagaactacttttgcagcaaaatcaaaatgtatatcaatactcataactataattatctctcaagaaaaaaatgtcctcactggcttttcttagcaatgaggaagactcttgatagtgtatggtgacttatgaagtcatatgggccagttctttatctcagacatgagccaaacttactcaacttgccccaggagtcagcagatcatgaaggccaaactcaaatactactatagggcaggaaaatactgaagaatacatttttgtgaggcaaatgtatctagatttgaattattattggatataccacatgccaagtcgataatgtaaagttccatcaagtacatgtgtgtgtgtgtgtgtgtgtgtgtgtgtgtgtgtgtgtgtgtgtgtgtgtttgggaagtcacatggtatcataatgacagttaaaattatagaaataaacataaccatagttaggtcctagcaaaaccttatgtcttagtacatgctgtctttggtccctgggtcataatcttccgtctgtaacatcttaaaacttttcatggttctaataatgagtactaaaagtttactttcaagatattattggaacttaattgagatagtgtgtgtgagtatgtgtgtatgtgtgtatgtgtgtctctgttggtctctctctctgcgtgtatgtatgtatgtatgtatgtaagtatgtatgtatgtatgtatgtatgtgatacttagtacaatacctggtccaaatagaggctctatatgtcatttgatagatgaatatatagatatgtgaatgagataatagagctaggcagggagaaagaatgaaaaaggtgtgaataatcatctcaaaaatgtattggatgacaaattttcaatttctagaacatctagagatgttcctaactaagagataggggaatgagcagagtgagttattcaagtgacttaagatttgtctcatgaacagagcaatgacgctgcactttctcctttgcttcctcataactggcctccaggaattgaggaaaatcgtttgcattccagagtggcctcagcattaccagtgtcttgcccctgccacacccacactcccttcctctattgctccagctgtcctgctgacacccatatagatgatttctacaaatggttgacctgacttctgcatgaaggaacttcatctgggacagtgctctcatgtccgagcaaagacagacttcacaacgtatgaaagtatccccactgcttattaagcattcttgggaaagaaaaacaaagaggttcacaatagtgtttttacctttatttttcatatttaaaatagactatagcagcttattagtgaaatctttaactacatttttgaaaagaaaaaacaggatatgtgcaaataaagttttcctaaaacactgaaaagtagacttataaaattatttagttaaagaatacatatatatatatacacacatacatacatacatatatctttatccaaatatgggtataaaaatcttttacctaccctactgcctaattattggctcagatatatgtggcttattcaaactaccacatgaatgctacttttcatgataaacatatgattaaacagtgtgataaaatatatccaaagctttttaagaatttgaacaagaataaaagtgaaattgtatagaaaattgaagcttactcttccagaatctcattggtgtgcttggtcacccagggtccagcttgaatagtgtgttcaccatttaggatgaattaggtgaaaatatgcagaggttttgattatttcctgtaagaaacgagattggctctgtgtagggatgcttcccaatcatatgtaagtgttatttacgtgaatatgtatgtgtggtaccagccgatgaatcctcattacagcttattttctgtaggcagagaggtgagactttagtcaagatttcttttcacctttgttgctagactgaagattgaggaggtgacagacaactctgagttaagtcaaaccaccatgttgaatgtgtatctaatgtcatgggctatgtcagaaaaccaagtatttgccctgaggcacacaaatagaaaaattctaccaattttaattagttttctcatcaccatgacaatgaacctaatacctcttgaaggaaaaatatttattttgactaatggtttaagggggtttaaacccttgtttgctttgctccatgtgattgaacagaacactctagtgatgggagtgtgtgtaaaaggaggatacctgcctcctggcagacaggaagcagaacaagggaagggctaggaatcaggcataactttcaagttcatgtccttggtacctgcttcctccagtgagggtgaatctcctaacattcccagaatgtctcaaaaatatgtcaccagccagtaccaaacatttgactataagcctgctcagggacatttactattcaaaccatagccccacttaactctctgactgctcccacaactctcattctctccataataaagagcatcctgcatacaggctcctccatgagtgtgcagtgaaccctgtggtttctctttaatctcacaggatcttgggaatgaaaggtccaggctatggctaagaaacttataatgattagcctcagagctggagagtgacaagaacaatggagacagaatatctttaatgtattcagttaagtcttttctaaggctctggagcagtgaggtaaactgggcttcatagttaggattttcagctggtcaatccaagtatgctggcataatccccgatgtcttaaatcttgatacactttaaaggacctcctagtttgtcattatctatgggactactttgtcagcattcagtgtgtgtgtgtgtgtatgtgtgtgtgtgtgtatgtgtgtgtgtgtgtatatgtgtgtatgtgtgtgtatgtgtgtatgtgtatgtgtgtgtatatgtgtgtatgtgtgtgtgtatgtatgtgtgtatatgtgtgtatgtgtgtgtgtgtgtatgtgtgtgtatatgtgtttatgtgtgtgtgtgtttatgtgtgtgtatgtgtgtatatgtgtgtgtatgtgtgtgtgtgtgtgtgttatattgtgtgagtctgtgtgtaggtgtgccgccaagtttcatatcaacttgacacaagccgcatcatctgagaggaaggactgccaattgagaaaatgtctccataagccgccaggaaggtcccagttgaatcagagcctttactgtggctcccctagggagcctgtggccagcaggtatggatctctataagccattctaggctagtcttgattcttcactcttcattacatttgtcttgtttctctcatgttctctctgtagactgcctccaccacttggcagaatgaggcgggtcactgaataccaaatgggtgatgttctctccctaatgattgttaatcaagtctgacttgaagctgtcgtatttcatagcatcccagccctcaaatctcagtttgttaacatgctctgcatttctcccttgcctgctgtttttcataacactcagagctaagttggaccaaggaaatgaatactccgaacaccagtctcatgtcaacttagggcatcctgcaaccttgtgagtgttggctcaattctcccaacatgctgcttgctgtcttttacctgatatgtatttaaaaaaataaaacaaagccaaaaaaacccagcattttcagctgtctgggcaacacagtaaatgcaataggctacttgcaatattaataaccaatgtggttttaaccttatgttcccgataaaggaattctctgccgtttaaagctctgagatgaataatagctgagtgtttctattgtcctcttaaaatggagctcactatatgttgaatcacaacagcacgactttttataggttgtgaatagcataaaggcccatcatctccttgcaggctgcgccaagtgaatggataatggcaaaccaattattataaataatgccttgtttccttctggcccctgtgcagatttcaaagaatgggactctattaaaggctgggagattaaattaagtgagacactgttagaaccagcacctagcacagtgcctggcacgctggttgaaccatgatctcagtccagcagcgtctctgttgttctgggtaggtgattttgttttgtggttgttcactctgacatgagtctagtcctgagtgaagcctggcagggcatgatcccaggatgctttgcagtactcccagaatgctgttggattgggctggttgcagtagaactagaggaggcaagcagaccaaaacattctagcagaggcagtagggctaagcttagtgactacaagggaaaggttggctctagaatctgggaagatcaggggatcctgctgaaatgttggtggggagcattccaaagttagggttccagaaacacacctatgaattgaacatcctggaggatggctgggtggtgaactaaggtgttcttcaaactcttatggttgtaggacccttgggaaataaggccatgtctcccacgcctcatatcctgatagtacagcactgagtcctatcactaccacatcacatcctgttccacagagtttaactcttttcttgtgagcattattgaggtaagggtggtgggttaagtgtgttctaatttccaagcttgggattgattttactaataactatatgaggtattttccagtatacaaaattgttctcttcccatgataaacctatattttaaagccattaactttcgtttctaaccttttattattttctattttgacttctattgttctatgttgctcactacttaacaccttgctattcacaattctaattctatccagtgacagggccaaagaccaaggtgagtggacagcaggaagtataatttaatatagatacatctctaatagttgcaagctgagatggtaattttaaagccagcatcacacaattcaatggcatgcccatgacagggtgatccttgacatgaattaaatttgaatcttctccattctcagaaaatatattcttcttttcccaaagccctgcacatggagggtatctattgaaaattgtagatatcaaagacttgagcaaaattttatttgtgaatatttatacaagaactatcaagtccttcagctagtagcctcctctccctcctgattccctttaccctttcaaatgcatctttggttctcctgaatctccatcaatgcttcacttagttgcttgcaactatctttatatgtgggccagtccagaggcatgtgatagttgggtgaagttgccatgcaagagaaaaagaggtaggtagagagacttgtgactcaccagaatctatatagtgctctaactcctgggggagatgatactggggaaggaggaaggaagagcaagccatcctagggatgtaagcattaagcacatggctcgtgttgggtcaggagatgccgtgcaagcaatccaaagcataactgcagagttgtgtttaaggattcagtcattggaacctcatgtttgctggtatcccttaaagagaaggagtaaaagaaattaccagttcagcagcaacagtacccatgaccaccattttgcaacatctagaggagagctgatagggaataggctaaggacaagaaagtgtatataaatatcttcgttttactctttggcctaaattggctatgaagtagagtggagggtttggagagatacagagatacaaggtctggttcttcagggcaggaacaggacagagttgtctaaatccccatgggaagaaggcctgtgcagagcaagtggtaaaagccggaagtaggaggagtaatggatgtgggtgaggatcaagataaggctggaggttaagggtccaggacccagggaaataacagccccctgtttactcgtagagcagaaggaaatggatgtgaatggcggttcagactttccagggggcagtcagaataattcctctggggtctgttaagaaggatgtagggtcatctcttattgggggggggggggggaattcaggaaaatgacaaaggtctgaaaaggcaggtctggagatcaggagagagaatgcagccaaagcatggggaaggtctaactctttcgaccttggtgccctttgctgtcactctgagctgtcttttctagcaggactcaatggcctagttggcatagattcaaagggagtgactgcctgggctcagggaagacattacaacttaaattgcccccttcatctgtagagttctaattcttagatcacagaagtgaccttatttgtaactagggtcattgtggatgtaattacgttgagatgaacacaccagattgaagtctaatccaatgctactagtgtctttatggaaaagagcaatttagatttacagacatatacgctgggaaatgccaggggaagatatatacggacattggggtgatgctgccttaagctaagagatgatgaaggagagtggtgtccaagccatcagaggaggcaaagaaagagggaaggggagtcaaacctgctgataccttgacatcagtcctctggcctcacaaactgtgagcctattacagtttcggggggttaagcctcccagttgatggaacttgattaaggaagctctgggattctgatagagaggggttgggacatttgatttggtttttcctcttttccttcccaaaggacggactgacaaaaacattttgaggatacagtattcttgaggagagagccccaagaatacaaggcaggtaaagaaagagagacaaaagactacagggaagggagaagatgggatgcatgcggtatgggaatgttcttcagctcccacagtgctaagtgtaattagaccacaggatcacagcttcttggagaaagtctctaccctacccacccatgatttctgcagcaaaggttaatcctagcctccgggtccttgctacaatgatcaggatgttacaccccagattataactgcagcttagatcagagccaaggtatttgcaaattgttggttcattgtaggccctggctttcatttacatatgataaccacagaccttagatatcctcagagggactttcaaatgatctgagacctgtgtctcttcaaaggcctgtataactaggatggatttaatgggctattcacccccatgattcagcatttcctacgttccagcacttggagaatttgctcattagcttcgagaggcagctttttaatggaataaaataagaggaaaagcgggttgtggtttcaaaagttactgtgattaaaatcatatggacagctgctgttcagtgtagtgtctcccagtgtgaatgaaaaagtactctgtctgacagccactgggctgtaaattctgtttattgtatagatctttctgtgcctttaaagtttccaaagcagtgtgtgaatagatagcattggtaggaaatcgatttctttaaaataatcctaatataaagagtaactgtcttcattgaagaaaatttggaaaatacatttaagcaaatatctttttaaaagcagataatctcttgagttttaacatttagggtgtgtatccatctggtgccttcttgtctgctcatacatatatatgcatacatttactaatttggaatcatactgtaaatacagttttcaaacttgctttagttaacgcatcctaaccacaatcctatgctagctatggagatactctttctgccatgtggttatcatgatttatttaattgatctccttcctctggaaatttagattgaattttaggttttttctattaaaaaggattcaatgtacatttttcaatatgtaattttaaagaaaagaaaagaaatgaaaaaagcctgaggcttctaggtttactttctgatatagggaaggacagccagggaatggcattggcacctaggtgtagagggctgtcagttgctccactatccctaaagggaggcctcttttgtgcactaaatgtaaggtccttggaggcggtcattgcctgatctttagttggtcaactttagcaggcagttcatacaagcagaacagcctttggtaatggcagcatggaaaatggacctaagtgctcagtgcaattagcaagaggtgcaatctgagggggtggtactcagacattgtgctggttcctccctgaggagctggggctgtgtgactcacagcagaagggggtgcacttgggtgcttctgctccccccgtccccttctccatcttctcaagactgaaaattcataagctgttctcagtgacagttgtgcaaaatgaaaagctctgtgaatgtgtggagaatagattatcctgactgctgttaagcgtttgacaaattgggagttttgtcatacatcaaagaacaatagagggagaataaggaacgatgtgcatcatataaatacaacatacctgatggctcctggcaccatttatcttcctggggggtggggctgaggaggactacagggaggcaagtgggaagagggaggtcactggccccaggaggctttgaaaaccaacccatgatcaagatcaaggactatgtctctggatatcccaggccatttaggggtttttctcattgtgatttcttaaactatgaattatggggagaaatttcctgaatctgaaagggaagggggtctgtgaagctactggtccatcaagcaagagtcttgtgtcctctagaatgtagaggacgtggagaattagctgcttagagtctggtagagctctgtctagcaataaatacaatgggaaggtaggtgccggaacaacagctctgtttctgtttttctctcccagccacagcttctaccacccttagcagagggatgccaagctccaagtgggggcagtttggttcagtcttggggcgcaaaagagcttgcatagactatacaatggcttccactgtagatggaagccctggcccttatatacaacacaaagagaaacatgcagagaaggctagaggtagcaaactttcctgaaggtttgtaggagaaggtaagaaggccttaacagtgcatcttcacatccctttagcaatggggtattgaaggtgtggacagcctttggcagccatgtgcagacctcttcatgcctgggatgttggtgtgcattatagcaagaaccaatagagtttacttatgggaattgtgaaaaggctataaatctcattgcagtgatgatcccacaactctatgaatatactaaaatgcatttatataattccaaaggttgaattatatgacatgtgtattatgtttctgttaagccactattcttcccaacccaaggaaaggagacagagagtatctggcacacagcgggggaacatatttatatagacttgagttttttcccatctcacagatgcctatggaaaaggttgacaagccctcagctcccagctttccaagttcaagtctttagagtctgctccttaaaatgttgtctgctttccaaaagcagacacccagccttcatttaaacccaaagagcttactatgatgacattcttagtcggataattgtgctccaaaaactccagggtgtgagctaacagcccagtttccatcaattcaaatctttccccatgtcttgagagatcattcttatatatttgagtgtctatgttgagtctgtataccatattgcagaagaatttgctggaagggaaaaaatggtggtagaaaagaagtctttgtgctgtctaacgcagattttcttgtagtaattgaagcctgcttcccactgcctgtctgaattctggcatctgctgaggcttagatgcctggagtcaaatggaataagtgcctctttggagagcagctcctggaggccactgagtttttgtcacatgtcagtggcatctgcatatggatgtgaaatgtatatttaaaaatgtgcacacacttgactgcacccatgtcctgttccaaatgtgtttatccagttgcccatcacagatccatcctgaaggtttgggggattaggggctggctgaccaattcacctttgtctcccagcccatagccttccagagcattgaatgcccccagtcacctttgtgacttcctcctcctccctggaataacaaggctaaaggattgagcttcatggttggttacctgggagatggatttgttaccttggtagaagaaaactggaagccacagctactactgcagccagcaaggaaatagcaaggggtgagtgtagagtttggagtcagccgacttgtttttgagtactggttgaggcatttagcagccatgtgaaattgagtatatcaagacacttctcttggtctcacacataaagataaagtcttagatttcctgtggatgccagatctatgctttaaaaatattgaaagtgatgtgttccacagtccccttaatgagcatgtcttaatgatctaaagacctcccctggtctccaccttgtaaggatcccgacaacttccagaagtcccaccctgaagattaggcctttaacacatgcatatttgacgaacactcaagatccaaactgtagccccagccccataggaaaccctgaaatctttcccaatagaaagttgaaaacattgacaaccccccaaccccctacaacttatcccactgtggaagagcctttgcccccttccatggagttgggcaggctgtgactcttcctccctatggagaaaagtcagaacaatgttttcaaaaggttttctcctaacactctctgttcccatggtgctctttttcagaattaccctcaggcagtgaaaagtacacatcacatgacaagacacatgtctgtgctctaagtgacagtcccagcccagctgaccttcagccatgctaacccaagcacaagacacatgagggaaaaagacatattagaaattcattcttctagtcccagtttcccccaccctcgaatagaaatccttgtcaccctgaacatcccagtcttcccagttgacatcccaggcactatagagtggaagaaaacatccatgccagaccttcctggtaccctgaattagtgatctcttatctgttgtttttagaattgttaggcattaaatttgtgtatccacccaccgccaatttccatgaggttggacctttagggagaaatagaattaaaagagatcatgaaagtgggacctctgggatgggattagcatctttctaaacatgaaaagatgtcagagtcacatgccccacccgtctctctccctctacacacaccaagggcatgccatgagagcgcatagcaagaaagtagttgtctgcaagtcaggaagaccaatcagctttatcctgctgatgccttgctcttaaacttccagcctctaaaatgattagaaaataaacatgtactatttaaagcacccagggtatggtatttcattataacagtcaaatgtacttctctgtagcacaagagatgtggaattacctagattggcctctgatgtttgctatttgggtccttggtcatcatagaggtagtctccagggtataaattcatcatagcaaattctctccaggagagaaatgtgtttcaaacaggcattctctggcagagtgggtttggcttctctttcttcccagtgcccactgtgataggataagaattgggctgagtgaatggacagctggcatgtgggggatgggcagatggagtggatatacacttgcacatttatgggtgtgagtggtaggagtccatagaaagttcaggaatagaggtacacagctcctctggaaagacttacccagtgttcttctgccttgttcaccctgagccatatgagcagttcagtcttgcttatcctcagtaagtctccttcctcccaccctgcatcaaaccagagctattatccaaggacaatagggttctgtggtgtttctcattctgcagcagagaagcaaagctgacaacatggtatttatatcacactctggctttccagaggcctcacatccactaatgaattaattcttcctaacaacagtgcctttattagggtggcatcgcactgtgttcatcagacaagggcactgaagcagtggctgaaactgctcctgatgcgtgagatgcccagctgtggccactacggggtcatatgaggcgtgttgtgtggatacagaaaatgggacaaggaacttggatctggatgtgagcaaagcctgtggttactccttgggaagatgaatttgtgtttagagtctccattttcctcatctgtaaaactaggagagcaagaaactagacaacatgtggattctttgtgaagatttggaaacacatgggggggattttgtgagccgtgacacatgcacaggaatactgtggctgagggtgcaggagggtgctgcattgtatggagggtgaagttcagagaacagagtaagaaccctcaaaatttcctggaagattaacatctataaacttctctgactctaggccattcagattctctttccctaacgtctaagctctacagaatctatctgttctccagcaccaattaactcctgatgctctttactctcatatgctggctttcatgttccattcatctgtctgtccatccatccatccatccatccatccatccatccattcacccatccacccacccatccatctattcatccatctatacatacatacatttaactttatttttgtgtatgtggaaaatattttattttactaagaatgggaattatcattgatgagtgataaagatttcaatgtgttgatctgtagagcttggcccacaggttctgaatcttggattccacactctctactcccaatgtttgaaatgcatttgtgtcagcttgtgatggtcaatccttattgttaacttgactggagacccacctctgaatgcttttgtgaatgtgttgctagagatacttactggaggcaggaagaccttcactgagtgtggttgccatcgccaagtgggtggggttctcaagtgaatagaaagggggaaagaaagccaaattaactccaccagtcatcctgttctacttcctgactgcagatagaatgtgaccagcttcctcatgcttctcctgctacaaccagtgtccctaggaccaccatgccttccctgccatgatggactgcattctcaatccgagaatcaaagtcatcccttaaaatggctcttgttaggtgttttgtcaaggcaagagagaagtacttaagctttttctcatgactggtggctcaaccatagctcctcttctaacatcaaatctttacataagaagctccttatatcctctttgtacctagcgcccatggttatggtcattgtaataaaatatgcaaacacaactatgaccttcttgactatttctctatgtatagcttaatggcatagagaacattcataatgaggtatagtcactggcaacaaccattccacaactctcttcacttaacttcaaatctctgccaaccaccgtttctcctaactatggtttttcactattctaggtacctcatgtcagtggaactgtggagtccttcctttctgaaactagcttgtttaacttagcataatgccttcaaggttaacctgtgttactgtgtattttagaattcccatcccttttaagctcattgaatatatgggttacatcttgctttccattcatctctctgatgacacccaaggttgcttccagtttagttattgtagataattcttttgtgaatgtaggtatgttcagggattactttttactccaaatggatagctttgtctgatggatatctgtggcagctgatcacagtgcttctctgtgataggcactgttaaggcagaaatgactacagttgcaattgttaagcaaccatgtgtgtatgacagatacttccataatgcctggggagaagggagaaaggcaaaggagcaggattccagctcagatttctccgtcccgagctacttgcttacctgttttgtgtcttatttttgttacttacaaaagtaggattgcgttttcaatttcatctgctcattgcctatctgttgcatgtacagttcaatgagaggagagagtgaatgtatttcatcaaacaaaaggcattaaactactgacagttgtcattcccccaagggcctgacatgtaacacatgccaacagatgctgtttgaattcatgagtgtttgcttaaatctgcaagtagcagactttgtttttagttctggttctcttggcctcagactggctttgttgtggatcctgctttgtagggatgggcctattgtgccagccctgttaaaacaaataagtatacacagctccctgtgagaatgcatgacccgagagaacaatcgtgttgatgttcaaatgaaataggcctctcaggaaagtaaaggcaagatagtagtagtcacaaagagtttgggaaaattggagtccaaagacaactccaaggaacatagatatgttatataacccagggacctccctggttcaagtataaccagtacttagtacaacaatatgtactaagaaggcacttctcaagtttcaatgagcataagaatgattggtgttcctgtgaaataagagctatggttctatagaaatggagcgggggagggggggaatccctgacatagtcttcatttctattaaccccttttggtgatatgattgcattcaatccaccaaccacataatgatcagcaagagcctatcttctgtgcaaggctcattcgagagcttgaacccgggagatcccttggttatataacgtatctatggtattctgagctcctgtgtaagggagaataggcttcctgttcttgtattcatgtaattctccataatggcaccctaggaactaggtctcaggcaaggagaccaggtttgttgttgttgttgttttgtttgtttgtttgtttttgtttttcgagacaaggtttctctgtgtagccctggctgtcccagaactcactctgtagaccaggctggcctcgaactcagaaatctgcctgcctctaaggagaccagttttaatgtttgtcttcatgttggtctctgaaaggtttggccatttaagtcaattgcttacatgcttttccagaagcgtcctttgctcctagttctgaagcatacttggataagacagtgatatctttgtgaaaattgaggctaaggatcgatggctggagatggcgtattagcttagctctgagaactactcatccagccctttaccttcctattgagactgagaagtgagtaaattaacacccatggggcctggcgggatctgaagacccacaccttctctcattcgggagttgatgagaaaaagatagcttaggaggtcaatttcataaggttgtgtcctgcctccaagcatggacaaagagctccccacaacaggctgtgttctagggggtcagtagtcctggtttaaggtaccgagtgaccagagagatgctgttcaggtttagttttgaccaattggtccagccttactgactgcagggcagctataatggggttctttttaatttttgttttttcattccttttaactttactgcctactcataattagattcttaagggactccttgagaatatttatatatttataatatgtaaatatatttatataattatatttaaatatatatttctaatttatattataattaaaagtagaaatatagaaatatatctataattagatttttaaaggaccttatccagatttgtatccagtatatttctatttgcatagcacttagttcccaccttaaaatcccactagtgggcctatatttctgtgatgcagagagatggagatggagagatagataaatgtggagatggagagataaatagattagatagatagatagatagctagataactcccttctggtttcctctctttaccatttagctggctagatgtcataaggcctacaactcttatgatgctagttttcactctctcatggcaaccctctcaactaggtttcatcccagatcctgaatgagttgccttctcagcacccagcaaacttcagaatggatgagaggttcctgtcacgttccatcagccatgccaatgcagccatggcagttaggggaactatgcaactcaatgttttctggatagaataggtagtcttggtcaaagatggtccacacagtaagtagagtgtcctaggagagaacgaagagtagggcatttgcttcagtcctttctttccatcttggcacctcctttccttctaacaggctcattttgaacagctgctgacctttgaaggggtcatcatgaacaataggcttggtggctttaagaaagagacagtatcctttacccaggacttttctccaaatgagtcaggaggagggtcatgctctacagaagcagattctatagataggaagtaggagaaggcacagggagaagaaggttttggtacgtggcacaggaagcacaggagggggtcataagcagaaaggaagctgggtttttcttttctttcttaatgtatcttaatttgaatttttctgtagttaccttggtatttaaatactttcatttctttggggcatctgtaaagcttcagtgttcataaataatggagggatagagacttggctggctgttaggaacatggaagtatttatcaatcaggatggattggattacttgggactcaagaaacccaacttagaaggagaggacctcttttaacagactctattgttttaaattctccttccccattgacaccactcacactggtgcaggacagtagtgcacacatcagtgccacatttgattagattctaaagagaaaggaaggaccaggggatctttcctgccttttcctctcccaggaatgcccatgtgagctgaccctatatgatcaggagaaataaaaaagaagtatgcgctgttcctgggataatactatctctgttttaagaactaaaagttagaatcactgagtatttatgagcattaaaggattcaaataaaccagatttcctctctcaagagtaatcatatggctcttccaaccggcgcccaacatcagtaacccagatgagtatcagaattaaacagaccccacgtattaacagggtgaaagaaaaaaggcaaaatattttaaatgtgtgggctcttaacagatgacattgtttaaaagaccaggaagagaagaggcggaagaagaatgggagagagatattaaccggaacattgttgacacttggccatcagctcctgcaggaagtcccaattaggcccacgtctgcctgatgccatcttcaacacgaacatcatatccgctgtaagctcctaactgcttacacacacttgggcattcatctcagtttccttatgtttcagtatctttttatgcccatcctttaggatcttatttgtacctataaatatgtagacaagggggaagggaggagacactggtttcctggcatttgttgtatctgaagttcttatagccttagtagctgggtattctgaatggaagagtctagaatgtgggttgagaatgattacatagtatttgctctaatgctctatgcttcagtgtcttggccagcatgtgtggagagataagcaagaaatgtcatctttgtgcatctgctaagagaagttttgaggtttaacatttaccacaatcttcaggttccctatacacacattctatgcatcttccctctaacttaccctccactctgtacccagaatgagtttctgtaaacacaagtcagatcatgtcattgccctgttttcgtgcacctccaagcttcctattgcgttttgcataaaatgcaaactcccttcagtggccttctgagcttagcatgaccatgtcatacccctgtgtcttagcatccacccactctctagcccctatccccacccctggtatggactgtgctccagcttcattggctgtttctgttatcagggctccccaagatagctcttctgtttgttttacatgatgctttctttgcttggaagctacccacccccaatgatgctttaactacttggaatgttctcctccacacacacacacactacccactactttggatagtcatgtggctgatgaagctcccaggctgcttcttctctcccctcccccacatgcactatactatcttgctagtatcttgtatcttgttggttttctctgtcctactgatctctccttggatctttctttctttctttctttctttctttctttctttctttctttctttctttctttctctttctctctctctctctctctctctctctctctctttctttctttctttctttctctctctctttttaaattaatgtttctacttgtttgttgtgacagggtttgattatgtagcccaggcattggactcattttgtagatataatattatgattcatttttatttgtgattaaaaagacagataagcaatttatatatttgctggactaacttatcttagattcatggcacagaatgggctgtgcctctttttaactatgtcacttgccatattttttcatatctctgtactttggtcactccgtatgtataatggaggtattttattagctaacgtccacattttgccattagcattgagtatagaaatatatataaaacctttgatcagtgtcttaccttggtaaagccctgaatagtgttgactgccattattattattattattattattattattattattattattattttgataattcttacaaacagatgcatcttctaagagacatttagatgtagatattatacaatgagtggactctagccagcccaggcctggaaaacatggcagcctttgctcttctcccttattctctctaccttggtaaaaaccattagattacattcctaaacctagcccctaggtccatttccttatttggctaatgtctcctcctaaggataactaccaaggtctagctatcaaattattgaagtctagcaatcaaaaatctcctttggctcacctaactaacatgcccaattaaaattgaacacctcatcttaccacagagtttccatttttacttttctaaactgccatttgcctatgggccacatctatctcctctctatttctgaggcagtcctttgtcccccagctccaggacaaatgcccctgccccctctcccttgcccattttccgcctctcttttgttcccctccctctctcccttttcctctatctcctgtctttgtcccttatccctgtcctatgtccctcctggacaaataaacctttgtactgagaactggtcttagagtatcttgagccagactgcaaggtctctacacataggtgatatctgataccctttctctctttcttcccttttcaaatcattagggactttgaagggagagtttctctgttacatttgactttgaaagacagtagaataggcagtcattgtgtacaaaggggcatgaactttaaaggcagagaaagaaatgggatgagttactcactagattatggttcacacacacacactatgggctaattggctaaattggaatggatgactatggaagaagaatgacatcacagcagagcctgatacaaggtgtagaccctctgctactcttgcatcaaagaacttgtgggtttattactattgtcataaatagtttcaattcattttctggtcatggttacttctttcccagccagtgtgtctggtattctccacaccagcatcctgctgggcacagaccctagcccaacaaagaacagtggctggctatctaaagctagagaaagagcattccagaaagtttcttggaaaccacatcacctaaagatgttcatttaccgatgagaaaactacaaccaaggaagaaacctttatttattcagtaattcagtaatgatttattgagccagtttgctgtgcaaggccctaagctagggaagaaaatcaaaaggagccatccactctttcagagtgaagcatccacaattaactcttataaaagagtacttaatagatgcaatatgtaaagaagagatgggacctgagaattataagctttgagttccaatctaaattccatcaccctttaaaaaaaaaatctaacccagaggaattgactgagtcttggctctttcatgtgtaaaatgcggaagatggtgtgtggattgtgaatctctcacaaggaatttatgagcacgcagataatcctgacacatgctgatgcttgatggcctataaagcaatttgtagacgatgcttttgttactggtaggatgataatttgcaaacagggaattgtggctgcagggataatataatgtgaaaatggaagggatggctgtggagatggaaggaggcctatgcagtggagaccgggtagagcagagcaaaggctgagccccagacctccattcccaggaggggtttttactgttcagaataaatgcgaagggacttttctctgtgaggagtgattcagtcaggtggcaactaccacataatggtttctgagcaagtctggtgggaaaggagaggaaggaaggtgctgaggctcaggcaaagctgggatgtgaaggccactgagggttctactactccctcagctgatgacagaaaggtcacttaaggttgagtagacaaaatgaaaatggtgtatttgtgttctactactaaaacaagatagttgaggctgggtaaccttataaagaaaaatatgtttatttagactatatttctggtgtttcaagggtgagatgcttgcttcagtttagccccactgagggtcttttggttgatgatgttagaaaatggagcataatcagagagaacatcacaaggcaagaagctaaagaagcagagaaagggtcgggtgtgtgcctctgaaacagttttcttagaactctcctgaaattattcttttgtggcctcaggatttccctgcctctatccagcatcccttccctggtgactaaggttccaaatcatgaacctttgaggagcagacaacctatgactgaagaagacacagatatggctaatttgaggaacaaagtatggtttaaagtgaggcctgaagtctatgggggcataatttagaggaactatttttccaggaagacccgagctaagcctggagattggagattatgtgtgtgtgtgtccctgtccatctatatctctcattctgactctctttctttctctgtctctctgtttctctgtctctctgtttctctctctctctctctctctctccctctctctctctttctctctctctctctctttctctctctctgtgtatgtgtgtgtgtatgtctgtgtgagagagaggatagcttggtgacccaagattaaaattatttgattacaaatataatttagattcagagatatcctccttccccttgaagttgcccctacaaccacacaaggccttgtgaaatatgtggccaattctgcaagggagattatcagggtgcaattgctgagagcagtcaccatccagggtagcatgtgaagaatgggcacactgcagatgggactatttggatgagcatcttcccagggagcaaaacagccacaccccagggtgccttggctcattggtaccctgcactgtcgtccaattctccatcacaggatctctcttcccacttcacagacttaatggcatcttaaggcagggggcatttcttccccgaggaggaatagatgggattttctcagaagacatgcatctattaagctcctgtggtttgtagaatcagccctgtggatggtgacagctgggagggtgacataagcaatgctttgtggcacttctcaaaagttgctgttcatgaaactcagattgagcgtgtccaaacctgaaatgttaacttcttccttgggattatcttccttgggccttcctcagtgccttcttcaggcaaaagccacctcgtggttgtcccagttattgcctgctcattgtcctcaaggctttcccgatctaaccaccacctgccccctttgcttcccctgaagctacattgctgctgccttagatctaggtcctccatgcctaacacccaatcaacaggaggagccaggctcactccaccttgcttgttccctcatacccaccccccccacacacacactctggtgaaatctcttccattgctttgcaggattctaaactgccagcattgtcggtgtctgtgcactgggacaccatgaaattgtctctgaatggctcctctgtggtaggcactgaaggttctggctggagagggggcattctgatcaaggtacgcacagcctaatggagaggtggccataggaagagtctatgttcagtgggacatagatagtgaagggcagccttgactgggggtgagactgtaggcttattgtgttcccttagatcattttctccagctagcaaaaataccagggactgatttgggaagagatgagaagaatgttcatattgagaaaagctaaatagtccttcactaggaccaacctctatttacccactgatgacacttactgtcctcactaatagatttacttcaatcttaaactttaaaaaaaaatatatacttgactacgtcacttttgcagactatcttatttttttttcctaacaggatgcaaacatttaaatttaaaaagcatttttcttattccttgttgtagggggaatgcatagctatttctaaaagtttcatatgataagaactacatgcaaatagatcttatgtgttgcctaaggatcttgtttgacagtacttagatacatgtcctttccgagtttcatgtatccacacacacattaatgtaaatgagggtgatgacatcaatcattctgtatgataccatatatggaatattataaatcattaaaactcatttttatacacttccttgtatgttggggatctctctctctctctctctctctctctctctctctctgtgtgtgtatatgtgtgtgtgtgtgtgtgtgtgtgtgtgcacgcgcacacatgtacattctggtcctctgatttccttgctattaagccccagaagatttgctctgacaaaggttgcaaacagttatagttctggtccatatgtttcatagcagaattataagttaatttctagtgaccttcacccaagcagtcttaatcctccccaccgaaacacaccctctgtgacaggtacttggcttgccatgatcatccttgaatacatggcaaaaatgtggctgtgcagatgtaactaggagcctaacacttggctttaagtttgtcaaaggggaaactggtttagatgagtcttagtaattaaccagggaagccctttaagagagagtctggaagcctgagcccttcttttccactagcgtaaagaaggtgtccacccaagatctgcagttacaagcagatgaagcctgccgatggcgtgtgagcttggaaggagactgagctacagatgaggtccaagtcctggctggcatttctgtgtagcttataaagtcctgagcatagaacccctgaaactttgagacactgtatgttgttttaatctgtggtgactgtggtgacttactatgaagcaatagaatacaatatatgaaacctgcctttaataaatcatgcatgatttacacttccaacttctaagccagcccaaggtctgcataatttctttgccaatgctagatgttgctaagatttaagtgcttgagaatctaaaaacgcaaaataatacttttaagcctgtaattaagccacagctagaattgtgtgctttctgtattttaattaaaaaatatttactgtatgtgcttggctattttgcccccgtgtatgtctctgtactacatgcatgcctgtgcccatagaagcaagaagaagatgttggaacttctgggactggagttgcgaacagaagtaaggcaccatgtgggtgttggaagtctaatctgggtcctctggaagagcagtcagttctcttaactgttgaaccatctccctagctccacattgtattttagttgaaaactatgttgactcatcagcacatcgtgtgtccctttgcttgttccatctttctcatactgatttgtcccaagcatctttgtttcctctgtgggacatgatggtggttcgtgttgttgtttgttttccctaataccgtttatggtatttagtgatcagagacatggatgctctgtgaactttcaaagtgccattctggcagtctgtatggaagtgtgtttgatggacattaaggagagccatgctagtagaatcacatttgcagagataagataatgacagtgggagctggggtacattaaggatggcagagatggtaagataggaactcagaaatgtcactggcaggctttggaattcttcagacaaggttctttaccagctctggcatggtggtgatggaatagaataataaagtattttctggcttaggctggtaagtaacaaattcactgaggaccctccttctcatagatgtgggccaacagagactgtgggcttttcacatcccacagagatcagaaagcacatatctgttacactcacagcccttcctttatttcccgcggatggatgaattaactcttcccagagatgcccttcctcccttctaatagacagagcctttgcttatattgtagtacctcagcagacaaaactgtggctttgaaactgagcagattggtgggatgcggtgtttgtcaaacaagcatctacttagacatccctgacacagtgcagatcacccttcaagcagccggaggagccttgtctgtggacaggggcaggcgtgggttggatgaggacacattcttctttgaaatgaacaaatcttagtgagatgttaaacatcctattaagctatctgaaaggaggaaagaaggcaacttgttctggtcctagatgatggacaggtcctcaaaccatctaaaaggacgctgcactacccacagtgtgtagttgcataaataaatgatctgctgggcaggcgccattttgatgtcttctcatgggacatttaatcatatttggatacttgtttgattgtttagcatctggtgtgggtagaggccatggatgctcctaagcatgttaaaatgtacaaggcaggcaggccccagttgcagaaccatgtgccaccaaatgttaaccctgatgagactgagaacccctggtctggcaggaactgtgtactgtgggggctggagagatggctcagaggttaagagcgtttgctgctcttctggaagacccatatttgggtccagcattcatctcaggcagctccagggaatccgatggcctctgtgcccactgcactcttgtacacatgtacacacagagatacacacacattcacttaaatagtgataaaaatcttttaaaggagtgctgcaaatcaatgatatgtcctggttggagttataggaaattatttctaagcactgtaacatgtcctgtgaataactagcctcccagaatctcttctttccctattgtctctgctgagtaccattttgagtccttaatgatgggaacccaggaaggattcagcactgtagggtatgaatctctcaattcatctgcagagttctggccataaacaaccctgaatgccctgtatttgaaagggcttaaacacacacacacacacacacacacacacacacacacacacacacacacacaaaacacatctatctctgaagtagaaagctatttcctcaaaccccaaattaaacattgctaaacagtcactgccatttggcaaggttccaatatcatatccaacacaccaaacaccaacttcatcttggattctgataatgtatttgcccagtccagatagaaactctgtctggtgagagaggttcagctgtggaaatagacaagaggctgtatatttgaaattatgagagtggataaatatttgatgtgtagtaactaaagctggacattgcatatgtgtgggtcagaagagactatgaggattattggtgccagaaatggaagaaggtaaagctggagtaaattaacattaaatgccatctatatatctccagcataatgttatttttataggtaatggagatatatgtttactatataaagatatccagaggtttttctgtttgttggtttgtttccagattggctccaaatagcaaggttttcttttcttctctttttaatgtttgttgatggtggcagtattcttttcggtcccaggagagatacagaaaaacaaacattacagaaaataagtattggccttaaattgtcagtcataaagaatcccgatgcctatgttctgtttccatgaaccaattttatagaaagagatgttttttcgtgtcttgagtctgtttctcagaaatagtctctgtgggacgggatctggattgacagcagcaaatgggatttgcatggaggcagcatctccctccaacaattccacagagggttcgcagccctcatcattcttaatcccccttggcaggaactttcaccccctcgtcctgtcctgccttttgcttccctccctcagtgtctgtctccagccctggctatcttgatttttgccacatttgcaggttctcgtccctacactcagttcttcccctgtgctctctcttacagaaatttcattgactcccaaggtcttaagcacggactctacagacaattctgaaattctcatctttagcttcagtcagccatagatttggtggccactgagatgaaaattcaggaagttatctctttccaatgggtctacttctaacatgggagcacctctgaatgggtaaaactcacaaagtgctattttgatatgtctttctcccttagattagggaacaatctcagggtcacttaaaatgaatctattccttgtattaggacccttcctgcaaacagaagttggcatctctgtggccttccttctctgtgttgtcactattaccccactacatcacatgcttctgttttctatgctcctctaaggttgtctatatatgtgaaatcatgaaatcctcaccttccgctaaccctggctttaatggctagatcattaatattgccattctgtgagatgtcacccagcaacttctatgacgatgctcactagtccccataatgccacagtcttaactgcaatgcttgcttctgcacctggtccagctgtaaagaagaaagagtgggatgaggtgctaaagggagacatggaagactggtggggagaactgctctgtgaaggaggtggagccctctccatagactttgagactttgaagcctgggggctgttagaggtcacctgaccactagaatatagagttctggcaattgcagcatctagtggtgagtgaggggggagctttggggtactctgctctttgggggtattttgacattgtgtgatccttagtacacctgtgcaggacactgagctgtaaaagttcatcctgaacattagtttggacctctcctcctagctgcatgcatctgctgccaggcatgactagactgatggatcagccgctgcttctcacacataggggatttgctggctggttttgtaactatgagaaaagaataaacaaagttggagatagtctgtgtgatcattttcattcacagagataatgaaacttactaaaagttatcctgctgtctactaagaggagagaccgtcccttagcatggcaggagctaatggcataggcagaggaagttttctatcacagatcaagctgacaggccagagtcctaaactggagctttgtgtggaccataccaatagcaaatgaattccagggtgcggggacaacactctccgggtgggccgccctatgtagtaaaagcatgacacactaatgactcctcgttttcccttcttctaatagtctttatcctatgaaggtctacctcttctcctgattaagggagggctgaggaagcaaagcttaatgtgaaacatctatccctcagccggaaccctgggttcagagcccttaagccaacatcttaaataatagctcggtgttcctcaataggccctagtggaccccaggatgccttagtgtgctccagtgcacgtcagtataccccaatgtactccaatatgctcttggtgcactctctctctctctctctctctgtaatcatgtgatatgggttccactttttgttcattcctgcagtattccttaaaaataggaaacaaagaatgatggaagatgccttctttgctgggaaggaagaaaaagtagcctaggtgtctgtcaggatggaatccctagcaaagtgaccatctaggttattacagtggatgccaaagagcctgcgtaaaaggcttgtgtttgtcctgtacccgtgctcgccttacaacatgcattatgtactattctcatttcagcaaaaactttccttgttgttttctctgttgccagagagaaaaactgagacttatcaagatgttggttctaacttcaagagacctgagtctagggtcgtgagcagatcaagaaacctttagaactttgccacactctccccctgcttttggattacctggccagtgcatgccacttcagtggctttgcctggcatccttagtaactcccaataacaaatgatcctgaacaaagtgattttattatattttatttttaagggaaggaatgagaagaagcagacaacacagctgatgtgtgtgagcccccagaccctatttgttaaactctcggctcatctaaccaaccattttcccagtaatggttgactctataaacttcaagctgtctgctctaatctgatgcatctaatgtatccttagtgaacatcagttgggcgtggtagtgtacacctgttttctctgaactcaggaggtgggtttcaatacaagaggatgacaactgcaagaccagcctgagttgtatgtgagatcctatctcaaaataaatctctgtgtgtgcagctttgtgactattgcaggggttggagaagagaagccacggtttcgcagactgccattttatatacctatctccatgacatgggtctttatagcttaatgaacatgctccctttatctccatgtctcctttttgttttgacattacatgacattttcaggcagtcatatttattgaaccttttcttagagctcctggatttttgaataaaaacctataaagccttaagacactcccttggctatgaagaaatttattttctctctctttctcttgtcccgtaggattttaatgaattattcttttgcatttgtattttggtctgtttgtggtttgccttgggattcagtatgaaactgatgcaactctaaaaggttcctctgtgggatgcccctgtgagaactgtgccaaacccatgtttactgggttcggattctgaactttcagatgttctaatggccagttcttctgttgatacattagtccattgttaaggcttcaatggctaagatagtaatatgatgagctttagagtgtattttgaaagcaagacagggtttctaatttctagtaatttttttcctatcttttctcattactttgttttccccaagccttatgatgagataagccatgtctcctccatcttctggatacacacctcgtctcaagatcacattacaaagtcgctcccttggggaggcttccttgatgatctcaggtttttgtatggttctccccaaccccgattcatttccagagaataccctgcaccaccttggcacttgtgcaaatggagcaggcctgtgactgtgtacctatctacatcccagtgacctgtgaccacttcaagagtaggggtaaggcctcatccactcttctatctgtctagagttagctaatgcctgacagatagcaggtgctttctccgatttcagttgcatcacaaaccacctgaactctaatagccacagtgtgattgaatccagctaaatggccttgttgttggatccctccacttccaccccagccatgtggttgcatcagatagtagctgatgctgtaatcatgcatgagtttcccacactcacaagtcaggtgggtgatgctggctgtctctgggacctcagctgggcctgttggctgaagcccctgtcatgtggcctgcatttcaatgacatgatggccgcctccaaaagctggggaatctggtggaagctatgtcatcttttgtgacaaagtctcagaactgtcacataaaggcacagctgccatgttctgtgggctgagaaagccacagaggcctgcctaagttcaagagagggagacataaattcagtctcttgatgggcagtgacaaagtcatggtggaataagtggtatacatgtgtccattatcagaatgtataattcaataatctaaacagggggattatgagttcattcagtcttcatagcccatcccatcataatcatatcatatcatgtcaatcatatatcatatcttgtcttcccatcctactgttataccagtgcactgtaggtggctgtcaaatgggtcaaatggacagtttaaatcaccaggatggttacactgtgagcctcagtttaacctcaaacctctgactaaggagatggagcgttgtcaggaatgttttttttctctgcctcctcaggctggaggtgaagccaagttgctgagttcctggggagagttttctgactgcatcacatgcagttccaggagtcacaggggatgcattcagcatttgtggcactgctctttgctggttgatcataaagttttcctcttccattcaaggtgctgagttattggagtatttttttttccttctctactttctgagtaagtgctttggagaagatggatgcacgggaagtgacatattaagtatttctgctgaaatgtggggtttctgctcgaatggaaggtgccgtgtttatgactggcacacaaattgaagaatggaactggctttttgcacaatcaagtttatagcttttgctctcagaggtggttctcactcatggtgagagctgaaggggcttgggggaagctgcctgctttgatcctgacagataaagtaagcagggcagtgtggggaaaccaccgaagattgactgagatagttctcctatggctgggacgacctccctcattgttgaccagtctcatgggtgggaaggcacccgatggtaaggatggtggggcttgctactgcttgggtcttggggccaaaatttatctctttgccacagcttgagtctcggtgtcagaatttaactgtctggtaggtttatgtcctaggagatgacctatttttagggaggtctttgttgggatagcctttagtaaatagcaagtatacagcccctaaatccagaggttgtaaacccaaactctactcttctttcataccaacacattacctcacttctttgtgacccaggggttccatttcaatcctgggccacattttagaagttgcagagcatttgaatcgagttaaaacaggggactctcaatccatgttagctactgtagtcattgtttctgatattgctatttaagtgtcaccattaatcatgagctgttcgatgctctccctagaccctacctgtacggcttcacattaatcatataatttaaaaattttcagtagcaatattcttttttttaaaaaaagaaacattttagcaatgtcctttatttaactaatatatgcaaatattttttatttaatcagcataaaaatattactggtaagctgggtcaggtggaaacaggcctgtaatgccagctgcttgggaggctggggaaggaggaccatagtcttaaggatggcctgggctatgtagtaaggccatgtcttaaatttccaaatcagtaaaaacagcgatggagctaatgttcagtggttaaatatgtgcctagcctgcatgaggctgtaaatgcagttcctaattctccccattatcatcaatgagataccttatattctacttcataccaagcttttgtcctaggaaacctgtgcactgcttccagcatctctcaaacgcagtagccatacttcatccgctcaatagtgtcatatgtctggtcactgtcatactggggagcacagctctggtggcttgttgttagtccatgaatttaggtaaggcagacagggtgcctacttgcaggcagggtattgctccttactgagttctgtgagctggctactttatattgccatatgatttaattcattttttatgaagcaaagttgaattttattaagaggaggatttaacacagatttaagcacaaatataaagtgcaagagtgctactgacgaagaggacattcaagagatggggatggcttcttaagagagagtcatatttgagtatattaacaatagccacatatggtaattcttatggctattttaccagcaagaattttatgccaactttatagcttcacttgttaaaagttgaagaactaatttttccacagttgcccagctttaaaagacagaatttgaactcgggtctctgagatcaagacttccttatggtaacctggtaactggatgatcagttttactggcataacaatgcaaatctgtctagtgctaattcaggcctcatacacagtatctgccctgtgttccaagactcctgtgtggtcatgtttgaggacagctagatcaggaccaggcgaaggactgaccctgtgtccagggtgaggatacaggataaatctgtctgtggccagtgttgtgacctagtgagaacttaggacctgactctattcattctatccaaggatcagagttgatcctgggtctaggctgtggccaagttaaactttggactgagactgaggtcagggctcggcttcaagtcaagctcagaacttattttaagccccaaagccagagcagtgggcacagctagttcacagagagctcattgttttatgtccattctaacaatctgagcccataccagtcagtgctgttataaagccagggcattgtcgttcccctgtcttggttactctgcagtgtcccatgcaaatggacattggtaaacttagctgtagtaaggcctacaatcccacaggaatagcagcttccctggggaatgttaaagagatacaatggtcagacacctctgctacttttcactctggatgggaccaggccttatgaaactaattttggtgttcatgctgcatgtgaccctggaaaggagttcagatctcaagggacacaattgtccagagagtcagttgggggcatttagtgacccaaggtcacatgcctctctccctgagtcctgacctgagtctcctggagttgccagatcaggctgagacggttacagttgtgagacttagctatagaccagacagtgaatctcagagaccacttctgtcagagggaagggaaacaataaccctggccatccacacagctagggttccgcactggaaatgaatgaggcgccatttctaaataaatcattcatagaaaagcaaggtagaaatggtgcgggcagtattttctcctaagtataagaaagaagagaaatgaaaacacgaggagaatgttgagtgatgtagggagatgctcacagaggctggaggcaggcagagtactctcaacagcaagcacagctttcaaaggtgggccaaggaggatgaacaccatcaggtcttcgattaacttcagccattcctaggattcagggtcctgtgactcccctttctgtgtccagcttcatgtacagggatctggttctcctttgagcataggagtgtaaaaggagggcttaaacagggaggttgcttaaagggttacaacctcctaagcgtgattgtctagtagtctcaactctgcagtgggggtagaaagaagctttatgcacccattccttgttagtttcagccaatataaaaacaggttgtaagaatccaacatgatgaatctgagcatccctaggcctttgaaaggatcatgtcacgcagtgacagataggctgttctgattctaacattaagtatccaggctcatgtgtgtgaacacttggaccctgctgttggccctttttaggagtttgcacatcctttggaaatctggacctagctggcagacataggacatgtcaaacaaaagaagcacctgttcctagttacagcccgtccctgtattcctgccagcttcatatttttgctaccatgccttccctgctacgacagactgtgtatctctttaaaccacaggcaaaaacaatcccccttttctttaatttgtaatgcacagtattttgtcatcacaagaaggagagtaataagtgcagataggtttgaggaatgtgtcattaggcaatgtcgttgtgtgagcattgcatgaacttctgtacttctagataggtagtctgctgcaggtctaggcagtatggcatatattgtgcagtctattaataattgaattataattatgcagcatacaacaatactccctttggggtaaaagagttttgtgtgtcttgttgtagctgccagaattttgaagcaaattccaaaaagtgtttatgcatttgcaatgcaattttggagcatcgatgtgtgtacttgacagcaacactgaatgcatatttaatttggatgtgtaagcaatcactggtaatccttttatgtttcatctttatagttttatgtataattgtttttccatgtatgcgccatgaaaagtattaaacaatttaacagtaatgacagtagaattgaaccaaatattgatgccagcaaacactgtatatgtgtgtgctttatgtgcacggatacaatgtcatgtgtgtatgtatatataaatatgtttatacatataacaacagtatcttgccatgttgaaaatataatttgaacttgctatgaaaaggataaattattgaataagctatgttggaacttttggcaactattggtgaaaaataattatattcttgcctcactctcaactctatattgtaccctcttgttactgttattttttatttaaacaatttttattacatattttcttcatttacaattcaaatgtcccttacatccaaaatctcttataccctccccccaccctgctctccaacccacccactcctgcttcctggctctggtattcctctgtattggggtatataatctttgcaagaccaagggcctctcctcccaatgatggccgattaggccatcttctgctacatatgcagctagagacacagctctgaggggtaccggttagttcatattgttgttcctcctataaataacaaaaaacaaacctagatttgtaacacattcctaagatcccagaactcaggaggctgaggcaggaaaattggttgaagctacccaggactttacagcaataccttgtctaaaactataaaaataataatagtgataaaataaaacatattgaaattgaaaacataaagcaagttgaatgatctataggtaatacacacagacacagacacacagacacacacacacatatgaatgagatcttgtataagaaataactaatctcctagatctgtttcttaatttcttccttcatattatgagtttctaccatatagggcacccatggagattaagtaatgtatataaattcttcagaaaagtacactgcctgaagaaattatatataaatattaactactatttaaaacatgtattaagtagagtagctaaaataaaatgatatattggactacataaaatgttagagtatctgcatatcaagacataaaatacatgaaacagagtgcaaattgcacactaaaaatttatcctgggtgacagaaaattggagtcccttcaagtcaacaaggaaaataagatgcatgaagataagagtcactttctgaagataagagaaaaatcaaacttgctcatctatccctcctacagatacccagctcacacctgttatgtattggactctctttgggacgatgactagcaatgatcagagttctgtccctgtgtacaagaaacctacatcttattggacagaaaaacataaaagcaagaaacctagcatgtgaagagctacagaaatttcaattctgacaatgactaaccacgtttatcaatgttcccacatagcaaatatttttgagtgaattttatcacatattctggatgacgcagggaaattaacacgctcacacatttgtaatgggagaaacagccgctgaaacctgaccgttgggaattttgtgctatatgtgctaacagatcttgcgatgtgtgattcctacattgtgacaacttgatgtataggaagatacatataggattggtcaaaacacacagaaagattccaggcaagagagataacagaaacaattattgctttaaaaagtattgcgatgatatctacctctttctatgctgacaaacatataaacatgaacatatgagtggatagattcatttaattcccaatatttattgtttatttttaaccccaaggtactgcttccattcagggatatagcagtgataaatgaaagcagtgtttcaattcttggggtgtccttttatttatgggaagaatacaaagtctaaattgacagaaagcacacaaaaagtgtgcacatgcatatatattcatatgcaacttgtgaacagtcagaaaaattataaaaaatttatgaggaaaaccaaggcttatttcccttctcctgtgtctttgtgaatagggtggagacaaagaacctatgtattagttaaggggtcagaggtaatatctctgattgatgcttatgcataggcccatgcgaagccaggcccatgccatgctgacctttcatggaggtgcatcctcaaaatagcatgaaagggctaatcacatagattatagagagttgtgggccacttggaagattgttatggtattgggaaattctggtcaatgctgagtaatagctattaaaattatttgtgggtcaagaatgtagctatagctctgcttggagactctttgtcattgactgttgtggtttgaatgaaaatggcccccacaggctcacaggaagtggcaatattgggaggtgtggccttgttggagtaggagtgatcttgttggaggacatgtgtcactgggggatgggctttggggtttcaaaagctcaagccaggcccagtgtcactctctcttcctgctgcctgccaatgtgaatgtagaactcttaagctatctctccaacatcatgtctgcctgcgtgccactgtgctttcagccataaaagctatagacaaaacatgaactgtaagccagccacagttaaaaccttttcttttatacatattgctgtggctaaaaaatctcttcacagcaataaaaacctaactacgacattgaccaactggtcatttggtggaagattgagctgatttttagagtctaaggtgaatcctgggttgagccggcaggagggctatgctccggtggctagtcagctggatgactgccatgtctagtataatgccttctagaacagctcaagtgtagagtggacttgcaagctccactggaagccttatccagtctatcataggaaaggagaggggaaagaaactaagggcttaccagattttggtaatttaagactatagcttcatagataaaataaaaatcagcagagaaaatgactctgctgtacaaatttatataacatgtgttaactaataacttttttattagagaatggtatgtagatgaggtaaggtagataatacagtgtgtgtgtgtgtgtgtgtgtgtgtgtgtccacatatacattttaaagctcatgacagtgaaagtcagtgtccacacattacttgagcactgtgtgttggcagcccctgtcagtagtgaatgtagagctgcctgtttctctttatggccattggacagaaatatcctaaacaaggtgtcctgcaagtgaccctttacattctctgacatatccagggttgaagtgggaagcagacatttgaacaaatgattctaagcaggcctgttgctacactaagtttcctagttaagtcttttgatcttactaaacgttctcccccaggctctgtttagagactgtaagcctctaaggatgttcctgttgtcaggatgatccggctcaaggtcatctctactgatccattgaccaatggagttgcaacattctgtgccattcacttattcacacattcagcaaaaagctttgcaaatgtcagggcaagggatcctgaaatgtcctacacagtacaaatttatataacatggggttgtaaagataagcatagaagtctgttctttacaccaatagatggcttgctaaggaacagaatcagccgtttctgttttctggtgtgattggaaccaggctctgtgtaataactctgtacattaatttgaatggatgaagtggatgctgttgggggccaagtgtgtaaccagaatctgtattctgactaaggagttaaaaatgaatgttctatagacttctttgtagtgctcagatctttgagcaagcctggagaaggaacaaatttcccccatgtcctccgacggagtgtttctagccatacaaaacaaactattatagagcagccacagctaacaagtcactaatatcttgagatctgggcaaatttttaaaaggcaacttttctgcttacccaatccatgcaggaaagcatagctctggggtatcttactgctagcccctcctgtgattttacacatcctacaaccagcagttgcaaccaggtgttgtgactccctccaggtcatatgtgaccactatgatcctgtgtctgcccatctatggacaatgagatttagcctgtcatttccctgctggtctaagagatctaattatctcaaccctgggtttgaagcacacttcatctttccagggagaccccaccctagatcccacctccagaatcagtcaccaggcacttccctcctcccttctatccagaaagaaatccatgttcacatccaccttggaggatctgggaagcaggatcggactaacatttcacattcttaagattatctcagagctcatcgagaaacttagagctctgtgctcactgcggtgccccaaagccatgatcccagcccctttcttgttcccagcactgattcgtttccctgtactattgtgtcttcctttcagttcttccttgagagcagaatttaagttgtttattgattcgagctgtaaattgctccgcaatgctccaggcgggagagcaggcaactgtacaaattccagcacacctagagcctctgcctccacccccaaccgctgaggtctttccacctgcagtgccatcttttaagcactcttgctctcagatgtcattcctccctcccccattcaaagccaagaaaactgtcacttttccagtgtccctactgaaaccccattttcagtttttgttttgttttgttttgttttgttttgtttttctctatgcagacccattcatttgttaaggttatatcttcagtcccttctgttgagctaggggaagggtagcatacatttcttgttgatgtgacaacatcaacataagagcctggataaaactccttaaggaggaaagggtttattctggctcgtggcttgagggtatgctccatcatgacagggaaggcatggtggccggagtgggagacagaaagatgaatgttggtgctctattcgtcttctctgcatttagttttggatcccaacccttggaatatggctgttaccgtctagggatctggattgggtttgatgtctcggccagctaaagaagtaaagggcaggaaaaaatctcacgtataataggaagcagtggggaatacctttaccaggcgatgttgtggataattttgaataaagtggctacagtagcctcaccgagaggtgacttattaacagagacttgaaggaggtaagagattttgagcccaatggatctctaggtatggaggaggagagaaatttttccatcagagggacagcctgcgaaaaggccctgaagctggtgtgtgcctgctttgttcagggaacagcaaggcccctggctgggacagagtagacagggagaaaagtgggaggcagtgaggttggggcacagggtattggcagactggagcttgcagagccattcaaagaactaagaatttggccatgcatacactgagaagtggttatgggcttttcaaacatacaagatgatttgcttgcatgtaaaaaaagatcagttcagctctggattatttgggaatagtttcttaagaaaagacactgcacgcccatgatggactatatggtgccatttgagagagggctgcgggtagaaatagttggactgtcaacattttagaggtccagtcagctttgcaggtggatatgtagaggaggcaagagaaagagaactctgtttccttatgggttactagaaggataggctcccagccacctgagatggggaggaaggtgggcagagcaggagcaggaggggactcagaagtgtggtgttatgtgttttcagatatggtaagtgtgaaatatacactaggcagctgatggtacaagacagctgtaagacttgcattcacattgggtagtactgacttaatctctcagagctcagattttgtactgtgtgtgtgtgtgtgtgtgtgtgtgtgtgtgtgtgtgtgtgtgtgtgatgttcattcctgtgtgtttacacatacatgtagaagccagagattgatgtcaagtgtctccctttgctgctctttacttcattttctgaggtagaattccctactcaatctgtgctcattgatttgcctcaatgtctctaatctctccccccacacacacacacccatgctgggtctacagacaggcagacactaccatatccatctggcttctacgtgggtgcaggggatccaaactcagaggtcttcatgcttgcacagcaggttgtttattgactaagccttctccccagtcctgattccgcacttctcaggagtacataattttcagacttggactagagggttgactgtcactgtgtcctggaagcacagtgagtcttacagctgagaccctgcctcgtgtatctctagacagacccaggatcaagtggctcccagcctctcctggctgacatgaagtgacttactcttcccactctgagctttagcttcttctcttctaaatgaaagagctggcataagagacctcatgaacaacctcttgagggtttcggtgttaaggctacgtgaggctgtggcagatgggctctgctttacagctccatagtgtcctgcttcctcctgggaatctgcatatgtatgtgcatatttgtgtatatacacatgtatagacacagcatatcccagctctgaaaggattgtttctttagccacattcnnnnnnnnnnnnnnnnnnnntgtggtgttatgtgttttcagatatggtaagtgtgaaatatacactaggcagctgatggtacaagacagctgtaagacttgcattcacattgggtagtactgacttaatctctcagagctcagattttgtactgtgtgtgtgtgtgtgtgtgtgtgtgagatgttcattcctgtgtgtttacacatacatgtagaagccagagattgatgtcaagtgtctccctttgctgctctttacttcattttctgaggtagaattccctactcaatctgtgctcattgatttgcctcagtgtctctaatctccccccccccccacacacacacacacccatgctgggtctacagacaggcagacactaccatatccatctggcttctacttgggtgcaggggatccaaactcagaggtcttcatgcttgcacagcaggttgtttattgactaagccttctccccagtcctgattccgcacttctcaggagtatataattttcagacttggactagagggttgactgttgttgtgtccggccagcagaccacaacctgggttctagcctggaaaggcattttggaaacctggaagagaagaggggctaggtggcgagagaaaagaatgtagccaagacagttactctgatcaaggctcaaattttattgttgcaacactagttatgaaggaagggggaggggacccgattcccgccgaataatctctggtccagtagaaaggtgcacctgtgtggctccgcaggttccagcagtgggcgtggcagaatgaatgagcaggaagctccacccctgagcaagcaggtttcaggctgggggaggggagactacatttcctcccttttattaacaaaatttaaaaaaagaaaaagctggcctgagggggggaaaattcaggctagaacccaggttgtggtctgctggccggacacaacagactgtcactgtgtcctagaagcacagtgagtcttacagctgagaccctgcctcgtgtatctctagacagacccaggatcaagtggctcccagcctctcctggctgacatgaagtgacttactcttcccactctgagctttagcttcctctcttctaaatgaaaaagctggcataagagacttcatgaacaacctcttgagggtttcggtgttaaggctacgtgaggctgtggtagatgggctctgctttacaactccatagtgtcctgcttcctcctgggaatttgcatatgtatgtgcatatttgtgtatatacacatgtatagacacagcatatcccagctctgaaaggattgtttctttagccagattccctgcttcctggccacactagagactccctttggccagcgccttttgaacttgactccttcatgtctggttccatgctcttgatcttcctttttggccaatcatcgggactcccctcacccttcctagtggccacagcatccagagagagcaatccaggcagccactgttaacccagtaaagccacgctcatgtctattgtataaagaatgcagctttgtttattaactactttcttggtgctggcctcccccgccccgtgacccaccccccagactgttaagtctactgatttctaaaatgctgcttgatctgaacattatggtagagtttattgccagttttattcctttccattttactgccacatcattcttggtcatgcatttatcacagaatatcctaatggcctgtctttctcatccagtactagggcaggaattggacatcagctgtctcagtggatagaacagccacttcagtagcagaaatcctatgggaacttgatgactatttgtaggatgaattaatcaattaaggatttaatgattgtactgagggaaaaaatagttgtgaattcacctgctcagaaagatatataaaagtatcaattcctttgtgctccttcattaagaaaccacagagagttctagaagacaggtcgttttcttgaaccacatgactcctggacttaggaaaactccagagcaattaaaagtctgaaaccacccagctcaggacatgccatgccatacagaactcaagccccagcaccatccagaccttggaaaaaagtactcaactgaatgttcttgaaatcattgttgtaagttacttgattgacacaatgatgtgcctagcctagccaatagacagaactaagccttagctataattaagcaaggtgcagatgggctgctgaacttgactctgaactcacaacttagccacaggggaaccttgctcacaacttagccacaagggagctatatcaagaaaggctagcagaggaagtgatacctaaagtgagatgagtcagagtaagggaatggaaagatgctattggtatgctgaaacagatggattcatactggtttttcttgagacagggttaggtgcaaaagatgggccactaaacactggctatattgcagcacatgaagtggggagagctgaaggtgtgggttccttgcaggaggatgagtcaataggctaactgggcaataacatagatcttcccgtgtaagcttggtgacccctgtaatcaggcctcccagtgtggaagctccctgtgtgggttgtcaggagatgttgggacacagtcagaatcagagtgaccaagaaaatagcccgatagggtaatgggatggctagagagaagtgattgagtctaggaattttttttttaaataaaatcattttggcagattgttagaccatgggttagcaagcaatagtgtgtggataaaatctggcctattgcctagtcttggttttactggaacattcaaacgatagcaacggagttgaggagctatggaagaaactctggtctgcaaagtccaaaatgcttactgtgtgaacctttaagaaagcattactcacccctaggccagatgcagagtgtggggaattaaagggaaagagggatttgaagcgttgtccaaatctctgtgtattgatgcctggtagaactagagagtggaaagtgactgcctgggcctttcattcctctcttaaatgaatcctgatgctcagtctgcctctgcctggacctccttcactagaaacctgggccccgtcctccctgttgtgtgtcaatgtaactctgctacaatgaattgttcttctacaaccttgcttttgacttcacctggccttgggattaccctagtgctgtcatctagcttgaccagagccctgagcatggatgaacacctccctgtctgggtctttatgcatgtgtagcccaacgatcatcaagaactggacctgattctattacaaccctggcccaggctgcccctcttacattgtctcccccaaggtcacctctagctgtcctactgacacccaaatgcccttcaggccaccaaatatgccccgatggatcggctaccagaggatggtactgttccttctgtctccctctcaccccctccaccccagctgaggtataccatgaggacatagtctgtgcctgtctctctcagaggccaggctgccttttttcaggcaggtcaccttttgtgggtgtgtaaatccagttttctgcttgtcaaagtgacattttcatgaggcccaaagttattaagtggcatctttgggtgcctactttttaagcaaagtggagtaggctgggaaatgtcaatagtggtaatgtacagttatgtccccaatacccttttgattgagcacatgatggaaacagtgcgaaccatggagccctttgcagggaattgccggttaaagaatttgttcagactcatggcttcttaactataaactctgagtgtcttaaataaaataccagctgccatgggcctccgactgactagaaaatgtcagagctcagcctgcaatgctctgacaggctctatagcctacagcctacatgtgtgggctcagtgcttttccagttgtatagtccaaactggcctcagtttgagcgatggaaggggtctgtcctggccctctgagactgctgggctgatgatggtgctgtcctccctccccctgctgtccctctccccctgctgtccccttccccccatgcaggagagccagatggaaaccctgtagatagaagtttaaatgaagaggagaaaaagagagagccagaccagtgacctcagactttcatcgtgggttagttctgtgaatgccttgcactcctccaaatccaggcttggggtaacatttctcccagtgtctaacagatgcttggcaattgtatattatatgatgctgtacattgccttatcttaattgttgagatccctctaagtcccaccttgcatccttttcccagaaaaatcccttcctatttttttctctagggccattgtgtcaatgtatttattaatcatagtagggtacctctgagtggcttgggtgctttgtctggcccatggcaggctggtccttatgtaaccaggctcatccagctgaccttcctaactccatgtccttgatggtttccctttccctggatgactctcattctcctatttcctttgtgtgagggagaactgggggagtcatgtgtgggtggcatatgtgtttgcagatgcacggggaagccagaggtgttcacaagattcatccatcattttatttctagacaggacttctcagtggaacttagagctctctgattaggctggactggctacccttatgggaattatattcaaatgtatgttcaggagcaagggaagagaggggggagggaatggggaaaaggaaaggggagacggaataggcatttttttgtacagcaatttaattttcacagtgctgatcaatatggacttcacttttagagtcagtggctggaagaggcatggaatgggggtggggctcctgaggtgcctagcatgtatacagaatattttctttgtcatgtttcttatgcaaggagcaggatgactgttactggtgaaaatttagagatttgtgtatatacgatggctattaatcatggtaaaaaagtacagaagcaaatagaacagttaattaatgaaaccttagtgaattcttttagagaagaggatagggggatgcaggagcaggaccttgtttggcgtccagggactttccagcaagacacaccattttctggaggctctggcagagaatccttccttgtttgtattccttgaatgtgggctccaacctccatcttcaaagccaggggtgtgagatcttctaccctcagatctctccccctcccatgttcttcttgtctttcctccttctcttccttatccacttctcgccctgactcctgacatctcccttcctcctccttccctccttttccagattatcctccatccctcccccgcccctccgtccctccctcctccatttctcacttttaaaatctctgtgattacattcagggtcatccaaataatgaagtcatccccttcccaagatcattgacataataatttaattaacttcaacttactctgcagtacttcttttccaatgtaagataacctagtcatgaaagtcatagggtccagaggttattaggacaaggatgcagacacttttaaatttttgagaggacagtattctgcccactatgatatttatcacagcaatgctgtgttgctaaaagtgtcaaaaccacccaagtattccaggaacacaatggttaaatgatttcacctccccaccacacctgacaccattaaagtgcttttgaagaactgttcataatgttggtgattgtggagtggacaattctggagctgtgcaaatttaagagcattgtgagttgtaaaagcgtgtacaaaggattattatgacaattaagagcaaatatgtctgcaaagaaataatagttcacatttgttgtggtttgtgggtgaatcatatgttttttttttctatttgtctgcatttcccaagttagtctgtgatgagcgcatcaattttaaaaaagttagcattgacaaatacacccatatatacattaaatgcacacatgaatacaccacacacacacacacacacacacacacacacacacacacacacacacatcctggagtatgcagagcctgaaatgaatgggattctgaagttcctgtgcatccaagttagacaatgggcctgctgatctgatggatccaaaccctttgtccatagtggtggggatcactgtattaggacatctttgcctcactctgaaagtttgttagtgagtgggtgagataaatgagaggcatcccctgctcgacccatccagagatgttgatgtttctctgctgtggtgatcaaattgctactcaaaaagaacagtgtatctcaccacgtggtctgaagatcagcagtgggagctccctggtgtcaggctatacattaacaatgatggtagactgttcccaacccagaagactgaatactatatataaagaacacccttagaaatgggcattaattccatgggtgatcaattttacatatagtgaaagcaatggcctacaatacaagtgtgtgtgtgtgtgtgtgtgtatgtgtgtgtgtgcacaaccagaattagtccattattggagctttctgaggactttaactcattattatactaaaagttttggctgccttagctgcattcaaacaccttaaaaatgaatgtacaaacatagatgtacagtcaatcccagtatctgttagaattaaccctcaagcccctctcaggtataaaatcctcagatgtggtattttgaattagctgtcccaataagtcttgggtatttgaatttttggatctcagctgggctagttggggagagggaaaatggagttgctggaagtcactggaggaaggctttcaggtttcaaagagtcatgtgaattagatttgtttcctatttatggatcaagatgtgagctctcagctgctgttatagaacactgcctgactgcctgatgccatgttctgtgtcatgatggttatctgctcctaaactatagaaccatatgcctcctctcaaactattttttctatagattgccttggtcatgttatcttacacatgttatttaatcacaacaatataaaagtacctaataatagatactcaggtctcttgtataaaatggtacagagtatgcttataaccttccacaccctcatttatattttaactaattacctctaacatttaatgctatgtaaatgtcatgctaacagtcattattctggtattattggctaataacaccaaggaaaaaaaagtacattttcaatacttatacagcctgactacacactatggttcatggtccacgattggatggatctgtagatgttaaatccaaagatatacaatcttcaaatattgagagccaactgtggtagagacctcaaaagtttggaaaccatggagaaacggaaatttttactcagtagaagtcaagaatgaatgacagtgtgaatttcctaggaaaaatctttggcatttcctggaaatatcaaaatgtctgagtctgtagcttattaattatgagcctctcaccttggtaattaagcaataaagacccatcaggcagtgtatttgtgggtgattagagccatgtttgatgtcgttggaaacgtacagctgaagattaagtggttctcaccacctgagagaggcattaatcatcggagctgccctacctggtggatttggtgacttctttagattggcacttaagcattaaagcagagactccctgttcatgcagagccgagctgcagactgaagcctagtgacttagcaagggcaggcagtgtttctgtgagtgatattatgactctgcatagcatctgcctgtgggtcatctttgtgctcttgtcaaggagggacagatggaaaagatgccccagacccctatgacacccaacggatgtcctgccagatgtaaggactgtatgtcattgagacaaggtaacacggtagaagcattagttttagaagtaggctggttgaatttaagcagtggcttcatttcttcctgtgaagcattgagcaatgtcatcttactagatctaggcataacaatttgcaggtgtcagctatttccatgttagaaatcaggcctagcacaccaatgcattcagtaaagagtgatgatttagtttccatgtgttgtgttagtccattttttcctcatgcttaaatacctgagagaaaccatatacagcaagaaagatctattttggcccaggatttcagagtttctgtctgtgattggcatcctctgttgttgtggacctgtgctaaggtagaacatcatggcaaagagaactgtggtgtggtaaagtgacttacatggtaagcaagaagagggatccaggaagagaccggggaccaagcataaccttcaaaggcataactcagtggcctacttctttcacctagaccctagttccgcaaatgtctacctcctcgtaaggagtgctgccagctagggatcaaaccttcaagacatgagcatcttagagtcaaactgtgcatgtgtgaagcagattggataatcccagctaagtgtgtttgctccttagaaattggctgaaggtctgttggtctccgatgccatggctgagctggctctgcttggggtatggttccaacatctcccttcttctttaaggaccagtgagtgagtccagggcttcatcctcttgtggcgagtgcagcagcatagaggatatgtgagggatgcagtgaaatccttgtgctagagtaaagtttaccacataggactctgctggtcctgggcatgggcttctgaccaaggcactgttacacaatccagaatctagtgagcatgccaggcattaggcagacaagcatgcatatgcacagaaataaatctctattgtcttaaacagtataaaaagatactaagaggagttaataggatatatgcggcaaaaccatctgccatagttgaagaagaaagaaaaactttctatgcactactctaaagccatttattagaaattagttttaactatttttaattctctctctgtatgtatgtatttatgtatgtatgtatgtatgtatgtatgtacattagtacaggtgcttagagaggccagggatattggatattggtaactgtgagctgcctgatgtgcgtactgggaattacccccaggtcctttgctagaacaggcagtgcgcccttaaccactgagccttctctccagctcctattctaaagtcttaagcagaatgtctagcctgaatactggggacagcaaggcaatatggtcccttgtataaagactcccagccaaggtgagggcccacacatgctctgcttactaagccttgcaggctgggttggatctgttgcatgtgggtcatcctgcagggtagggctgttctgtcttttccagctctaaatatctccttaagtttatggtacatcaataatacagtgttcacagtgggcagaagtgccggagcctaagctgggcttcattatgctctaccttctcaaatatcagatcgcacgaatcagcacactcagaggtgatggctccgcaggaggaagagaaggaaacacctcaagctggagagtaggagagagcctcggataggtcttgctagacaatgttaactgcgttcatggggagactgtgaaggctctagcctgtgtacagctcactcagcattgggtagtaggtatgaaagaacttggtgtcagagggccttttgcttcctgcagcctagagcacagggtgcctctggccaacactctgaagagcactcactatcattttgtatcaaatgccctccagtctgtgaggaaaagaagcactgggcctctgctgtgttagcaaactagtcagttccgctaactgttgctcggtgtgtctgaggctcattttgtcatctctagagtgagaagagtgaaaagcctccccgcttccagttgctgtaagggttccaaggagctgtgttgtgcaaagtgcttagcacagtactggcatgtattgaaaaaaaaccctgaaatttgatttatttctagaggatcccaggaacttgaagcatcttgggtttagcagcgttgacagctctgtataggcccggggctgggcacctctgaccctgagtcccagctccaacaactggacttcagtttatggcagtttgtttgagttctggcattcagcttttatttgagagccaacccagaggggcatagaagaaattggatttatttttatgacagttcttagtggagcctggcaatcaatcacgtgtcaggatgctgttttgaaaagaagcaggttggaggtagactttggagacccagctccgctttcagagtgagcgggtggtaaatacatcatttattcgttctgctcagttttctcacctgtgaagtggaggataagaattccaaccccagtgacgggtctcctgggattctaagagatacagaagtgaaagccaccccaccccaccccacccccaaaccccgagcactgcttgtgtggcacccaatagttagtcaatgaaagctcccccacttttaatgtctttgggggttgggaggaaggcatcgaaaaaactgtttaagccattttgctgtgtcaatactaattaagacaatcacaatcatggcccaagtaccatgcatcaatgcagacatcgtaggccaccagaaaaaatatatcacagcagcaaagcaggccgctgttcaataaatactttgtgactgattagtcatgccctgcatctgtgcagtacttcagagctaatgaagcagttccgctctggttgggattagtgactgctcacaacatggagaggaggttggcattaactcatcggacatatatttctgagctacgaaggagacaaaacattgcacacacacacacacacaaaatgtctgtatggttggggaaatggggcggtcagttagtcacttctcatgagtatgatgggcaaagacatgattcagaagagaggtcacccccaccaatcacagaaggcttcccagaggagacagtgcacctgtgtcctgaggtgtagcaatgagggtatttaatattaattaatttgtcacacgtgcatatgcatgtgtgtgcatgtgtgtgtgtgtgtgtgtgtgtgtgtgtgtgagagcacgtgcttgcagggtaagggcctttaccagatgaaatatctgttgaccctcaggagtttggtccagggatgcatagatattagacaagttggctcaaactcacaatccccctgcctcaaccttccaaatgctgggaatggataagtacctcattttcataggtgaaaaggaatgcaggtagaagcaggttagactgcagtagcaaataacaccaaagacagaaaagctcagctgagctgaagtttatttattatgtagttaattacttattacttcaatcaacttttaatttggaaataattttaaatgcattgaaaagttgcaaagattgcatggagcattcccgcatacttcacccggcttcatctaatgctagcattttacattgctgtggtatatttgtgggctactattgactaaacttcagattttattgggattttagctctaaaaaattacatagatgtattttttctcctccatgattaatgctaagatagccctgcattcagtgcaaattcacttttgctcactcactgggtaaactcagtgcacagttctgtaaatgttcatcaagagttgggacagaggctctgacatcccctctacccggctcctgagtatcttgtcattgtcatcctgaccattaattctactccccctttatgatgaaaattcttagagttgattgtgcatattctatgtagttttgctctggacataaaacctttgttaaaaacaatacaatctttcaaagaaaagccttcctttgaaactgcatacagccaaaataggggccagagatgcttctaaccttagctgcatgataaggaggggagaatgaatcagggagagaattattttttctgtgccataaggaggatgtgtgtgtgtgtgtgtgtgtgtgtgtgtaggtattggaagtagaaggaattgtattaataaaaccaagagggatccaatggcaggctatgtagtcagagatagcccctgctcccactttaggagtctcacatgtggacccagctgcacaactgttacatatgtgcagaaggcctaggtctgtcctatgcatactctctgtttggtggctccatctctatgagcctctgtgagcctctgtgagatcagggtactcaattctcttggttttctcattgtgtccatgacccctctggttccttccatccttcttccccatcttccataggattccccaagccccggttaatgtttggctgtgagtctccgatcgatttctataagttgctgggtaaagtttttctgttgacagttatgctaggctcctgtctgcaagaatggcagaatatcattaatagtgtcagaggtgggctctctctcatgtcatgggtcacaagctgggccagtctttgattgatccttttctcaaattctgttccatcttttaccccggtatatcttgtaggcaggacaaattgtgggtgtaaggttttgtagctggttagtgttgctatccctccaatagaaatcttgcttggttataggagatgcctgttctggctccacattccccattgctaagagtcttggctagggtcagcctcatagattactgggagttttcattttcctaggtttctagttcatctcagagatggcacccaatccagttgtctctcctagtactctctccctgtcttctcactacctcatccctcctgttcccaacccccaataagaagggtcttattacttagtatttttgtatctgtggattgtagcatggttatcccatactttatgacaaatatctacttataagtgagtacatatcatgtatgtcttttggggtctgggttatttcacttaggacaatctatctgcctgcaaattccatgatgccattgattttaatagctgaataatacttcattttgtaaatgtaccacattttctttatccattcttggttcagggacatctaggttgtttccagcttttggctattatgactaaagctgctatgaccttagtagagcaggtatctttgtggtatcatggaacttctttggatatctgctcaggagcagtatagctgggtcttgaagttgatctactgccaactttgtgaaaaactactaaatggatttccaaagtggttttacaagtttgtactcccatcagcaatggaagaatgttccccatcctctacatccttaccagcacgaattgtcagttgagcttttgatcttagccattctaatggatgtaagatggaatatcagaatcattttgcatttccccgatgactaaagatgcctttgggtccctttaccctaacagggctgccttgactagcctcaatagaagatgtggctagtcttgctgcaacttgatatgccacggatggttgatatctataggaggcctcccactttgtgaggagaaggaaatgaggggcggagaagatgagggaggagaaactgtaatacttatgtaaagtaaataagtaacttaattaataaaaaatacaagaggaaggaccaatgttaatatgcccattttgtaggcagaaaagttaaggctgtagaaaggaaggcacagctgttaggcataactacaggcacaaagtccagggctatgtaggctacaaaccaatctgtgttctttcttcctggccccagagggcttaagatcaatagtcaaactgtaggatgaataggtcacagggctactctatctcatctgtgtctttaaggatgacttttctcaacactgtgacaaatgtctgtcaagatgactttagggggaagaaaggtttactttgccccacagcttagagattccattctgtgctggtgggggaagcattgttgcaagagtacctgatggagttccatgaaaggaggagagcaggaagctgagagcttaggccaatccagaagacgatatgaccttcaaggacacacctctagtgacatatttctatccactagcaccaatatctcaaaggctccatacagccccagagactaccactggttagaggccaaatagtcaaacacaggggcctgtggcaatgttgtagacttcagccacaacaaaggctgtttttatttttcagttgaactgaaattctttcattgtgatgaaacaagtaaatgaagaaagagggtaagagagggaatctcagggccccagttgatctgatttttcttaccaggcttgaagtcatacccatacccagaggctctgtcacagctgggtaagatggggaccatgtctgcctgtcatctccagcgtgacgctggtgtctgcttatttctggctggataggacataattgctccccaggctgacagtgacaaatggtggtgtgggaagtgtattcctccgagtgatgggatgggcttgtgtttctcagctgccagaaacaggccttgtcagaaaacaacagggggatttcttctcagcttgaggcctcccgggcatggggggcagattcagggtatgagcctcccaggagctagtatctgactcttctgggatatgaggtaccataagatatatgccagggctttgttttcttggccaccatagtctctacctgaagatttctttttctgtttcatatctccacggtcaggcattatctgaagacactaagtagaaacatcacaggcattatcaattcaaagttttaagtctacagtattttgaagagtgtgatagggtgtgaattgtccctatatccagcatgtccaccctgcacgtgctacctgtcctcagtcacttagtaactgtctgggacaacagatcaactgcagtgcatcccaggtcaataggttggtgctttcttcacccagcctctgtttcattttatatctacaaatctcagaacagtggtactagagctttatcacagtctatgatcataattattttatttatcattatctattaccggtaatgacttgtgccctctaagttctaaattgaaatatatagaaaaccaaaacatatgtatcaatttctaagtatcttttgagtggtttgggacatctttccagtggataagggtgtcaacacacttttgacatgaaggacccaaagccccaccacagcggttacagcatgacctacactagaggaacaatatacttcttgtgaatagccatgaaaatggaaatagatttattgagttcatccttcttcatttataaactagaaaaaggccctttgagaaaagcttagataatacaagatgataaccaggacaaagccaagtcaactgcatatcattttaatcagaggaactcatttgagatttggtacctcttatttatttatttattattagatattttctttatatacatttcaaatgttatcccaaaagttccctataccctccctctgccctgttcccctacccactcactcccacttcttggccctggcattcccctgtattggggcatataaagtgtacaataccaaggggcctctcttcccagtgatggccgactaggccatcttctgctacatatgcagctagagacacaagctctgggggtactggttagttcatattgttgttggtacctcttatagttagggatggccatagtagaagctttgaggttgggatgcatggttaaagaattttcactctgaactgtagcctttatggacagcctgtgaagactctctcttctatctgatggacccatgctgtattagtcagggttccctagagtcacagagcttatggagtgtctctagatagtatgggaatttattgtaatgatttacagtctgtagtccagccaacccaacaatgggcagctatggatgggaagtccaaatatctagtactgtgtgcacacgcacacgcacacgcacacgcacacacacacacacacacgatagagttatatcttaagactgttggccatcatctgctttagtctccaaaaagacttatgaacatccccatgatagaggtatatttaatcactttattgcctgaatattatttcattctatatgttccacaatttaacaaatcccctctttacggacattaaagttacttctcatttaattaatatatatatataattaatatgtatataatattttcttttcaatgactggcaggctgatacaaaactctttgcatgtaccaaagcattttcttaggacatgtccctctaagttaaatcatttggccacattttaatgatgttttctcatcaatggaaagtcaatgaaaaaaaaatactggtttaaaaatcaggagggtgaaagctccatccttctaaaaccatcaactcaatgctaatctggtaagtgaaaaaaaaataatgtccttttcatatattgctgtttgttgattgttaattttgaacaacttcatatttatcagccctgaatattaccagttgcctcttcttgttattctttaataatagacttttgtctgttaaagattatatttgtttgtatattttatttagctttaatatggctatattcttcatattctttctgtagagaagttttcaagtgttctttcttccattttttgtttttttaggaccattgtcccttcagggaaccaagaccagaatgtggttatattcttcacattttcttctaacatttttattgttttatccttcctcttcctttatgtctttaacccttccattacttgcaaaggagatgtaatcatgtggctttggtttatactaaagctacaaagaaagaataatgtggagtcagtgcattaaatgtagttcaggctgcctggcctgcagccctaggggaagacatttaattctgaagttaagtgaggtggtgatggccagatgatgagggtgatggtcatagccagagtcttagggactgctaggacattaaagtcagtggctggggcttagatataggatgaatttttgtgcttaaatccttagacattgactttggtatagaataaagaaaaatgagtgcacatattcacaaatatttcagcctaagaatgctaaccatagctttgtgatatacataacatattgtgccaaaatgtagaaaaaaaacaaatggcagttcaaaggagcatagataaatagctaaagtacacacaatggaatactacttagcaatagaaacagaccatttcttcatacacttgggaatacagattaaccttaaatctttcattttgaacaaagctagacacaagcaagtatatgcagtgtgaatctatatgtcattttagatttgagcaaagcaatttgaatgctaataatggtcagactattaggtacctctggggttgcagtacctggcatgatggatgagatcatccagaagggatggtaataaatgctctctgagctaatttgggtagcagggaagtaggtatgtacacatatagacatttatcaaattgcacgtttaagatttatatacttcatattgtttttaaagtaagtttaataaaagaaggtcctgatcatgggtgaaaaatggtcatctttgctctacagatgaagcaactgaatccaagaagtgtgatttgttttgagttgacatttcaagccagagctgtctagattccaggagagagccaaggtagttacagaatggtgactcccttaactaggacatcctggaactgcatgatttaccgccattcctgagagagaaccacagatagtctcaggatagtagccagtaaggtcacagcctcaccagaagaaacttgttacattatttccatgcccatcctgtttggtctcccacacttttgggtgtctttaaatatgaactggtagaccctggtacttactgggagccaagagcagatttctggtctctctcagtcacgtgggtatttgctttggtaaaaagcaagcagcatgatgatatgaggtaaccagtatccaaagccacatacctaagtccactagaaacgtggaatagcatgtaccaaggatcagcacgtattattccgggactggaaacactgccagcttctaaatatatgctagaaatcatatacacggctcagctgatacacacctgctagatcatccttgccagcctttcactttggatgtccccattacacacaggagacagtgattgcaacccctggaaagcatcgttgatgttaaatattcattgatgatggcatgtgcttttcagctataagattccactaatgcagctttctgctgctgtccatggtcctagttttgcttacagtctctggcctctgccatttgcaaggactttgggagacagggaagtaactgcaggcttgtgcaagaggaagctataccttctagtggaacttctcgggaaactggcacacacgtttactgacttgagagcagttcatctctaaggttccatttctaagggagagaaagcaattgttagagtccttaaatgaaggcaaaagcagacctcatttagagctgattgctgcgtcccagggaccggcagcatttgccgtcagtcacaggttaaccacagggcactggtgccaattctgaagcctcctagacctttcattccctggaaggaaattgccagcagatgtgaagagtcattagaaagaggctgggggtacagagtgggtagtgatgcagaccttcattctcttcctactaagtaagaagtcagggtggggatttcactaaagtctccctggatcccagttagacacctagaagcatgtcttcaaccaatggcaatattgtgttaagagcctgctgagtagggagtgcttcaagtctcaaagccatggagtcagctctgtggatgttcacagtcagtgaagggatacagaatatccttagttagtcttggggtaattcagatttcctatgtagcaagggctgaaatacacatatctcagaagcccagctacctgcaaatggtgtgtgaccaatgggtaggagctaaatgaagaacttgactacatgtgtcggtaatgatcttcagctggaggcagtactgtcttccatggggtttggacaatgcctggagacactttgatcccaactaacagtactagttactagttactagttactagtttacaggaaccagaggacagagatgcttaaatatacccaacaacaagggctggggtggatgtgattgtcttcccatttggtaaagtacttactgtgcaacccacataaaaatgttgctaatcatggtgtgtgcttagaatccagcactggggaggcagagataggtctatatctggggctcatttattagtaaacctaattaaatcagtgagccccaggatgattagagaccctgccttaaaataaaataaaaacagaacatgatgcaaagctcctgaataatgatactttaggatcaccactaagcctggacactcatgcacacacacacacacacacacacacacacacacacacacacacacacacatgaatgcacacatgcatgcacatgcatgcatatgctcactcacacatgtgcacgtgtccctataacccctacatgggatgatatagccctaaatactcatagtagtgagccactgctgctaggagtgaaaaaagaagctagaaaatgtctgcttaaactcctgactcctctgtcctctaatcctgtgccagtgcctcctagtgactgaacccaagtacaatctagagccaggggggcagtgggggcagcctgtaggagtcagccccacccccaatgctctgttgttggttggtgcccttacaaggtgagaggacccaactgaactgagctcccaggagctctcctcctgctcagacagcagggcagatgctttgtggccccgggctgctctctttgtcatctttgctcctgctgctgctgctgctcttttaatgttggctgtcagaatgagggcaggccatgaaggtgggagctgcagggagagagagagagagacagagagagagagagacagagagagaaagaaacctgggtaggatgctaggagggagctctgcctgctatgctgctgaaatgtggattttcacgcagcttcacaaacttctcaccccctacctggcttggatgagaaagtaagaattaagtagctacaatatttttttctagcacaatgaactttaaaaatggaattgctgtgcggagcaatgagtgatagttcagtaaacaggctaagtacaattacattatggttgtttcggctctgacatttctttgggaacagaatagcatcagtgtggatgtttggaagccaggctattctcacttcttggagcacagggtgttccagttaggaatcaaagagcatccgagtggtctctctggtttaaagggacatttcagtctattgactctcatggactacatactgcccctccttcaacaataatagaatttaagaatacatgaaaacaaatgagtttgctgaaaacaaacaaacaaggggggaaagcaggaactctgcctgttcctgccacggccttcctgtctaggaagacagacagaggagaaacagatgctaagtgtgcacttcagtcaatgactgaaagacacagtgtgtgtgtgtgtgtgtgtgtgtgtgtgtgtgtgtgtgtgtgtgtgtgtatactcacagcagacactgaaagccagagctcaagacccaagcagcttcccatgcaggagctgagcatctccagcctctctgtatgctacacagagctgctgaaggtgtcttgaagaacaggcgttcagggcagagagacacgcatgagtctcttagtgccagtgcctaagagacatttgcttagtgctacctttagatgtgtgactggttagtggtctcaggctcagaggaaaattacctcgttttgaatagagacatagcatctgccattcctttttcctggacattagcatctgctcatttcactagagttaaggaagaattgattagaaaatgatgtttattgagcatccataacaacagcgtgtagggcatagatgcctgtggccatgcatttttgtctccatagaaagtcacacggagctaggtgtcatgctagacacaggttctgggaggaaacatcttttgttccaagtcatgatcttctgacctgtgaggactttggtaagttactttgtgttatggactttagtttcttcatctgagaaatctcaacgacaaaatatcccgttgtaataaggctgaattagcaaatatataaaacttgtagcaggggaacaatcagcaatgtgctctccgctttaccaagaggcaagatcctgagttgggatgccaagcacccatgtaaaaagccaggcatggtagtgcatagtagtacaggagctgggaagacaaaagcagacatatttctggtgattactagccagccagtttagcgaacccagtcagtgagctccagatgcattgaaagaccatctcaaaaaatgaagtggagcgtgatttgggacattcacctctggcctccacaggcactcacactcatgtttgtgaacacccaaaatcaatccatcaatcccctccctctcatattcatattctctctctgtgtctctctctgtctctctctctctgcctctctgctctgtctctgtctctgtctctgtctctctctccttcccccctcatacacacacacacacacacacacacacacacacacacacacacacacacacaccactttagtagcatagtgatagtcctgaatacagagagttatatatgggctggaccactagcctccatctacttactggagagggggttgctgagctattgaccttagtgttctcttctgggatggacactgtctgtaatcaccatcctctaagtctcatggcctttttgtaatatttgagtgagatgcagaaaatgagaaagaaaatgaggaatctgctatagacctaggcacacccatcttcaggctcaagggaggatccagggcctcaataacttgggttaatacggaggcaacctattgaggagaatggggaaaggtttcccacaggaaaacacaatgtgccttttgtcatctgagctaggtggatctgtacctgagaggattttgtgaactaacccagacagggggaaaatcttcaatagacactttcccgcttaatactggggcaacttgaaaatcaccttacttctcagggcctctgttttatcttcttatctcctttgtcctcgtctttgataaactgtcaccttcttagaaaggcttttttatattaaccggctttattatagcaatagaaaaataatattgtagccctacaacagaattttcttttattacttgtgtcccccattaggcaggacttcctggaaactgtgactctagagtctagagcaattatctgtcattgaaggagtctggtggcagaatgggatgttccactttcacagcaaaaagaaggtgtaagcctgagctgaagacaagcattctttttttgtttgtttgttttacttttttattagatattttctttatttacatttcaaatgttatcccctttcctggtttcccatctaaaaaccccctatctcatcttcccttctgcttaccaacccatttcctggccctggcattcccctacactggggcattgaaccttcacaggaccaagggcctcccctcccattgatgccagataaggccatcctctgctacatatgaagctggagccatgagtccctccacgtgttctctttggttggtggtttagtctctgggagctctgggggtactggttggttcatattgttgttcctcatatggggctgcaaaccccttcacctccttgggtcctttctctagctccttcattggggaccctgtgctagtccagtggttggctatgagcatccacctatgtatttgtgaggcacgggaagagtctcataggagacagctatatcaggatcctgtcagcaagaacttgttggcatccaccagaagaatgctccactatgttcatagcaaacatatttataataactagaagctggaaacaacccagatgtcccttaacagaggaatagatacaaaaaaatgtggtacatttacacaaaggagtactgctcagctattaaaagcaatgacttcatgaaattcttaggcaaatggatagaactagaaaacatcctgagtgaggtaacccaatcacaaaagaacacacatggtatgcactcattgataagtggatattagcccaaaatctcagaatactcaagatacaattcacagaccacatgaagctcaagaagaaggaagaccaaactgtggatactgcggtccttcttagaagggggaacaaaatacccatgggaggggatacagagacacagtgtggaacagagactgaaggaaaggccatccagagactgccccacctggggatctatcccatatacagttaccaaacccagacactattgtgaacaagcattctttttgaatgtaatataatccatgactccttacattctattggacaaactgagtcttgtgataaaccttatccattggaagtactagctgtcagagaggacttacaggtcacgtggcagagtcaaggggttgtgatagaaggaaaggatgttgaaggagaaaatgtcctaactaccttaactcctctgacagtgttaaccaaagttgcaggtggccagtgacattagtatcacctacctgtgtctcagcctaattgatctccgtgtgttcacaatgttgtagtatcattctacatagttttcttactcagctctccaattgtctatcagtctgtacctacctagaggttcagagacacctgtttcgacaggggcatcttccaagcctgggacagcagtataagtactttgaatggattggttaagcaatctttcatgcagaggaaaaagtgggtgatgtaccaagtatcactcagagcatcaagccctctatttcagactcggggcatccttccccagagacacctttccctttcacatgctgtgctggcaaagccctgagtttttctgaagatcccattggagctctcacttgtcagtcatctcccacagtcttgtcggctgacaacaatttatcattctctgtagatgaaatattaggacaaggtaccagggtaggcagctcctgttacagacataatacttcccagaaatgtctgtggaaatcaaatacttgaatgtgacaatgattgacttaaggtcttctctttttattaaaggagtaaggtcagttttaagaaacataaaaatagaaataaccctaataaaagttctttaaaaatcttcttttgcatttttaaatgctgtttccagcattcaatctatccttaattttattattgtcattgacaattgagcacaaatttggctagcttaagtttgatgagcagccaatcgagtctaaaaatttaccattttcaacgaagcttaatgagtctcgtcattgccttggctgcacggtcctttgcttctcattctaaatgtgtgtttccataatttcattttgatactctgggttttttttttttttgcagaataataatgaatggcacatggaaaactcaaagtatttcttctcacgtgctttctcagcagccactaagcacctgtcattattggaggtggtggggtctccatggagggatgagaggacaacttccctgccctcttgaaattgcctggctctctggagagttctttgtgttaatagctttgtatagagggacgacacgatattaagtgagcctcggagaaagtgactgttgctgtttgatagatttatttatttatttgtttgtttttaattccactaatgcacaaagcttacattttttaagagaatgggtgtttaaaagactcccctggatgttagatggtgaagagcttcaggatgaataaacagaatttgaggactgcacatgtataattatgatttcttttttcttcaaaaacagttctttttggatctgaatataccacaagtatttaggaggttctgtccttctgtctcagtatatagtacaggctagcctcaaacttgcactcctccagctagcctccaaatgttggggttacaggcacgtgccaccatgtcaggctttatacatttttttcttagcttgaataaagtggctttatgatctttgtggtcaaggaatgcctagatttgcttctcttgctactttctgtggctcttcattgcatgatttcgtttgttgtattcagtgtggcctctgttaagagatgtgctggcatgtccatggaggcacctctactccccatgactggggttagaaagaggacattggttaaaaagtgatcatggaacttagccaacctccaaggatctttacccagtgttgggatctcagtgcctaaggaagaaataaagggaattacaggacttatcttggacacaagcagcttatattggaaagaactggtccaagaagaacaagtctgactgcccactagcatgccccatacaggagagagagccattttctaatgagcccctacttcagctaaactctgtgtgaagacagaagtatttcagttcctggggagagttcagtggtgaagctcttgtctggcatacaggaactccacacaaaccaggacacctcacgcatgagtcattggcacaaccaaagcagactttgacatgatgtgaggtagaagtgtacctattagggttgttcttctgcatgccatcttccttatttctcctctacagccattggttaactcccaaccagaggaaggatttgggggaaaaccattatttttttaggaatggactaactaaaaatgtcaaagcaaatgtgtgacattgaaacatgtcgcaggaacaagccacacaaactagatttcctaatgaatacccaaatagaatctgttgcagcaatctaacttgctaccattttgtgaaggaaaattatattcagtgttttcaggctatgtcatccttgagattcgaaatgtctggattggaggggttggggttcagtgataaagagcacttactgcttttacagaagtcttgggttcagttcctagaacccatctgaaggtacacaactatctagaactctaagtccaggggatttgatacccactcccaacctccatgtcaccgagcacacatgtggtacacatacacacaagcaggcagaacattcaacacacacacatacacacacaaataaataaatctttaagatgactacagctgtttatgctcttcttcacaaggttttatgtaagtggaatggtgtttgtggagtgtatgtgtacatgcgtgtatatatctttgtgtttgtatttgtgaatgtggtatgtatgtaggggagtatgaaagtgtgtatgtgttgtgtacagtgactacgtatgtgtactacatctgtggtgtgtgtgtgtgtgtgtgtgtgtgtgtgtgtatgtgggtgtggtgtatgtgcatgtatgtgggagttcatgtgtctgcatgtgaaagaaaatttgtatgtgtgtatgtggtatgcatgtgggaaagtgtgtgtttgtgtgtgtgtgtgtgtgtgtgtgtgtgtgtgtgtgtattgggtttgtgtatttatttatttatttttggcttttgcatgtagcactccaaattcatatcctggtcatggggtcccagtaatgtgtcaggatccttaaaatagggacagaaaccatgtaatgatccatctctatataatttcccccacttcatccctatgtcatgaactgtggggattttcatttcatttttcaagatctcctagtttacatagctcacctaagtgctgctccagaattcttccgagtcctcatttactcctttggctgtgagtttgtaagtgcttatggtatgccaccagatgccaggcacagggtaaacacacatgatggacaaatgctctgtggttttagaatgtacactcactcactagcaatggacactgggttgttcctatactatttgatttttcctagaagcccacggagtcctatattctgtagttctagacttagaacttacttttttttttttgacttagaacttatattcattcatacagagatgaatgggaggagctatcaaactatcagttgtgcccattacagtctcttgattccctggtaaccgcagacattcctcttgccaacacaaaagctatcactgcctctttacaccagtgactcccgtatcctaacattagacatgcttcccagcatgcatcagctctcctacaagcatttctaacccttgaggatttaaatccattgtggtttataaaattgagacatttctaccagctacagaggaaggcttttcagaatcaaaattaacaatcttaccacaaaattgtaatcctactaatgatgtctttgatcatgtggatctcttccaaatgtagctttttaagtattttcccaagttttcacaactgctaagtgtgtgatgaggagaaacatctgtgtcttacatcattaatttattattcagggtaaagtccaagaaactgaattgctaatgcaaagtctgtggattcatgccatcattgaatattctattttttttaatcttggccagtaatgaacaaagagagccctttgattatagatgttattttcttaattgataatcatgccgttcatgtcattgatcatttaatgtcttttctaaatgtcaatggcctatttatatcatctgtccagttttagaaattgtcttggttgtcttttgcttactgatttgtaggtgagatgaactttatatgtaaaaagatactcatcatttcatgtgctataaacaccagccttcatcttcattttgttttagatatgcttaggaatttagttataatatagataacaaaatattctcagcacaaaagaaagtatatatccaaggcaaaaaatttagaaaaaaatagaaattcagaaaggcaaaatacagtgtgtattttcatatttaatgtttattataatgtaaatataatattgtttatatttctatatttttctatatatgtaagcattttgttaagatacctaattttcaactttagcaacatttattttaaataaatgacaatcttcatatgtcttaattttaaaaccacatgcacctaattatcaagcactatattagccactggcagtgcagctgtgaaggaacccagaccattcctcagagtccattattggatcatgcatttcagtataattgacttttacaaaggagagacacaggctatggagtccatgcataaaaggatatacgaacctgtattgttagcataggaagctccttgatagtgatgtttaaatcaagtctatccaaaaatcagatctaaccatgtatatgtacaatgcctgtgtgcgtacacacacacacacacacacacacacacaaaagagagggatgggggacaggcacctggttgtcataccataagaggtgttggacctactttcttaattctgaataacaatactccaaacccaggaactgcagacatatgtttaatgaatgaagtaattaatactctgtgtgtgtgtgtgtgtgtgtgtgtgtgtgtgtatgtgacttatacatcacacttatatgtcatccctaactgggacctgggccttgctgattcaactcaattgactagtgaccttcagggaccactttatcgccaactccctggcactggcagtatgtatcatcacacccagcttcttatgtgggtgctgggaataaaattcaagtcctcattcttgtgtggcaaacattttctatttagctgtttatcaagcctgtggtgattaataaagaggggaatttcgaagaagcatctaagagtcccagacagcaggctttaccttggtttcacattggaatcacccacatgcctgtgatgatatcaagaagttgtaacccacttggtttggcacacctggattataagaattcttaaatctctggaaagctcaaatgaacccagattgaaaaccactgacataatggtagagccccaagaggtggttctcacactgtagaaaatcattgcataacttcacaaaatagactgcaagcaccctgttctagctggtccagaagatactcatttaatatgttcctatatattggtctagggtctgtactttaagaagtgctgtggtgatagaataggtcaaggccaaggggtttgcacaggctgtatgtctcctttgtcattctgaattatgctgagacaagtaatatgagaaaattaaaaacagctaggaaaaggcactagcaacgactgtctagagaagcagaagaggtcttgggagaagagactcaactcatttgaatgatgctgaggcatcaggataactcaagaccaagagccggctttggattgagtgatgagctcatcaatgaccttgtgagttcactgagacacatgggcaaatgcagattagtgtaggttggagattaaatgagatgttatgaggaaggagagattcgtttaaggaaatctctgggaaagttattttacttgagctaagcgaccattagatttttatgttattttcaattttccattaatgtgccattttagagagcattgttacacaggcatcaatgcggattcatgactctttcagatatattcttagagttagaattgctgaatgaaaaattattcacagtttgaactatagatagaaaatagagataagaaatataaagagccagactgacttctaaaatgagttggaccatgattcaaggatattcagaccatgctaccccactagctgcccctgcagctttcattttaatccatgaaaatgtcatatgtctaaagctttattgtttaattttcaattctttgatacgaaaagtaggaacattttgagtgttttctgcttcctgtatgtctttggttttggaagtaaaaatttgccaccctttcgcattttacccaggagatagttatctgtttttcttactggattgtaaagaatgtttatgtattaatgacatttgtcttggttaccaatacacatggaaactattttcccagttagctatggtttaatggtctgtggtgatgaaaaatggtgtattttatattttgaacttatctacttttaatagttttatctttgaaaccatagttttaaagttttccttgaaagtatattcatctaagctgtggtgtctaaaaatttattccctctggcatttgtttggcagcataacttcatctttctcagatagttaacccatgataacaataccactcggtaaaccagcattaattatcccactattccaaaagttcacctttagattctgaagtattatttatatttgtctttgcttactggatatcctgtcctgttctacatatgacttttctatagctgccatcatctctactttgatcagagttgagggtttatttaaaagaaaaaagtgtctctagactttcgcacaaaactgatttgagaattattctttattctttcattctggtctccatcataaatgtagaaaacctggagtatttgtgtaagtgaagtttcctccatgtttgttctcttaatcatgtatgcaatgaacatactactttaagaggaatgacctacatattaggtgtaaattatacatttggaatgctgagtcatgtattgatattaatcaggaatcatgaagagcatcgcatcaagctcaaagggtaatggagagctgaaaccggaatatccaagagagtgttttcaaaccagagcaggacattagggatgggaccttgaggaaacccattaagcaactagtgtggaaagtcaagtagagcaaagcacctaagctggtggctacactggtccaatcagtgtttggtccacgaaagccaaggcaagaaagacattccagcagacagggctagtctcttacctcatcatgcaacaactgagggaccttctcaacaagatggaagagaagtccacaattggaccaactagaaattgccgaggcataattaaaattcaaagattcaaacttcttcctagcacagatgcagacaggagtagcctaagccagcttattacactagataagaattgactaacattgtacataagggaaaatgcacttagtcaaacaaacaaacaaaaaaatccctctctgtttagccatccatttcaaatttttatagaaaattgtgtaggcagcatcaattatgcttgggcaaatttagactaattaatgggttgactaagataattattgaaatttgtctatggatgaaaagaggaaagatgagccatttaaattgctttttgtgtgttcctgatgactatttctaaaagaatgggcccactgagaagcatatgaggtaggagtggcccggttcttctcagggtttgatgatagaggaacaaggcagctgttttaatcaacacatcaggattaatgcctttaaaagtccaacatgcataaataacatggaacatgcagcttatataaagaaaagcattcttcatgggagatcaacaacatacaaagagtctttcagataatttatttgtgtgtgtgtgtgtgaatactttttttttttgtcttcaaacatcaatgctgtgaagacttcatcagctcctatataaagatgaggccctgaagttcctagggttaagcaggtagcaagactatataagctggtacaaggggaatgtggccaggtccattgctcacattatgtgtgctctatggcttctaggaagcttcctttggcagtaatttatttgtggtagtgatgaaacccttgctcaaaccagattggtatttactgagaaatgtcttccaaagcaagtgtttgacacacagcacaacctactcatttccttctagtcacactaaaaccttgagaaatgtttcctggatttgctttttcatctcagggaactgaggtgggcaatttatttaagaaaaaaaacaccccacctagatctatctatctatggagtctgaagcttgactccactttgcagcatgtttacaatgggctatatgcagcatgctaggtacatacaaaagagatagcatggctctggggtggaagactcggctttgggttagaaagacatgtggtctactgttgtgtgggcttaaaaaggccagaaatccattggattcagttgatagaattcaactcaaaagccttagtcaaaaagaatgattctgtggctacatgagttgagttctctaaaagaactgaaacaatacaataattatggcttaggagatgatctattagatcgaagccaagcttatatggcaccagaaaattttagttttgatgtaagcaaacagtagtagcacaagggaacccatgatgtggcagatgcacttgctggcaagaggcaaaagcaagaaagcagaaggtgaaaacttatgtttaggcaactttattggtgacaatttgcgtgtaactcctgaacatttctaggagacaatatgaggatgctaccaacagatgtggtagcatggacagggaaaaacttatagggactcaattatacataaagaactacaggaaactaagcagtgctgagagtgggaaaaaaacactcttccccagggaagagtacacccattgcttttatgtaacagcaaattgtctgccctaaaaatgtgcatacacacaagtaccattatacagtctaagcagattttaatgacatatttaggaatatatagatgcatacaaatacgtgtaacaattaaactaaaagaggccatgaatctaaaagaagatagggaacgggtgggtttaggaggtttggatggaggaaagggaaaggggagataatataatcataatcttaaaaatacaaagaaatacattaaaaaaaaaacaaggagctgaaggggtttgcacacccacaggaggagcaacagtatgaactaaccagtaccctccagaactcccagggactaaaccaccaaccaaaggaagcacatgctgggactcatggctccagctgcatatgtagcagaggatggcctagttggtcatcaatcggaggagaggcccttggtcctgtgaaggttctatgccccagaattggggaatgccaggaccaggaagtgggagtgggtacgttggtgagcaagggggaggaggttttcagaggggaaaccaggaaaggggataacatttgaaatgtaaataaagaaaatatctaattaataaagaaaagttagagctcataaaaccaaaaggcttaaaaaagcaagcaaacaaacaaacaaacagaaagaaacccagctttttcctcagagtacattattctgggactcagtgtctgggagatgtcacctactcttgggggaatgtctttccttggcagctaatccttccaggaaatatccttacagatatcggagccacatctcttagataactccagatccagtggagctgacaattaaagttaaccccctcacattgtcaaagctcagggtaagagttaacttgtatctctcctgttttcttgctctccctttcttcatgttcctatctctgtggtcatcttgtttgcttcatttgcttgtgattcccgtcaagaaaatgtaaacgtgatcccaaatgagatcttttgtacatctaggtcagctcgctaactgaatgctagactgtttatagcatctaatcccattggtccagagagacacactgaggagcaacacccaagggtgtcatatctctgaaggtggaatgaaagttgaggagttgattgacagtctcctggggtgacatactcacacacaaaaaagagtgaccatgcacaaaagccatgggaatgcagaagataaggaaatatctgtccaatatggaagcatcagttctctagctacaacatgctgctaagatttattttgtaatcttggttggaagtgtaaaggatactaaatggagcatcctcagcacatgtgaggtattcagtcaatagatgcgcctataattttccaactgcataccagccaagccacagttcaccaaaagatgtaaaaatcttaattcattccccattcgtgtctatttttaatatgaagcaacgagtcgtctttgtctggctcagttaaaaaattatccatttagtaaacaatggagacaggtccttgagatagaaatgaatcaaggtgagtctcagcccttgagactttcctaaccttgtgccatgagcctttatagtggtgtttaaatgttttctataagtctgaacctagaagcacaagtcccaggtgtagctcacttctgaaaactgtacatcatataatcttcagccttccttactggttctgaagtggtacaggctgttctaaatggatttgtctttcctgggcagactaacaagcctcttcacgtgacacctctacagcaattcttcagtatttatccatggagacaacatgaagctgattttttttttctggaatctagtgtaggtgtttagctgaaagctagacctgattatgacatttaaacacattggtccagatgtctaaaatgacacttttctgatttctttttagttgtatcctcagctaacttccctctgtactggttgtttggctatgggactctttatctggtcccatcagttgctggatgaagtctctcaggtctctttgatggtaattctgcttccagaacactttgcagttgggacaaactgtaggttgaaggttttgagctggggttagtgacccaatcccactacttgagatcttgcctggctacagaagatgcctggttcaggttccctgtccccattactaggagtctttgttagggttacacacatagattccatggagtttccattgctctagctttctaccttgtccctgaaatgcctgtttccagccatttctcccagtattttctcccttcctcactctgccacttgatccctcctgtttcctatcctacgagctccaagttcacctgtgaaatctcctctacttccacttcgcagggagatcattgcgttccccacacccctttgtccctccttgttactagtccctctgggtctgtagactctagcctgattgttgctgtatatctaatatccacttataagtgagtacataccatgtttgtctttctgagtctgggttaatttactcagggtatttttttttcctacttctatacatttgcctacaaatttcaagatgccattttaaaaattattttattaggtattttcctcatttacatttccaatgctatcccaaaaagtcccccataccctccccctcactcccctacccacccactcccactttttggccctggcgttcccctgtactagggcatataaagtttgcatgtccaatgggcctctctttccagtgatggccgactaggccatcttttgatacatatgcagctagagtcaagagctccggggtactggttagttcataatgttgttccacctatagggttgcagatccctttagctccttgggtactttttctagctcctccattgggggccctgtgatccatccaatagctgactgtgagcatccacttatgtgcttgcaaggccccggcatagtctcacaagagacagctatatcagggtcctttcagcaaaatcttgctagtgtatgcaatggtgtcagcgtttggaggctgattatgggatgggtccctggatatggcagtcactagatggtccatccttttatctcagctccaaactttgtctctgtaactccttccatgggtgttttgttcccaattctaagaaggggcaaagtgtccatactttggtcttcgttcttcttgagtttcatgtgttttgcaaattgtaacttataccttgggtatactaagtttctgggctaatatccacttatcagtgagtgcatatcatgtgagttcttttgtgattgggttacctcactcaggataatgccctccaggtctaacaatttgcctaggaatttcataaattcattctttttaatagccattgcttttaatagctgagtaatactccattgtataaatgtaccacattttctttatccattcttcagttgagggacatctaggttgttttcagtttctggctattatgaataaagctgctatgaacataattgagcaaattcttgtgataagatggagtgtcctttggattggtataactgggtctagatgtaggttgattctgaatttgctgagaagcagccatatagacttccaaagtggctgtacacatttatactctctccagcagtggagaagtgttccccttgctccacatctttgccagcatgagtgagctgtcacctgtggttttgatcttaaccattctgacaggtataagatggaatcccaaagtcatttttggtttgcattttcctgaactctggggatcaaacttgggtcctcttgcttttaagataaatactttacccactgacacattgtagagagaatatcttgtgcattgtatgaatgcatcgcctgtcaatttagaagcctatggcctatggcttaggtaggaaataaaggcgggacatcaaggaggcaggaaggattgtgggatagagccaggcacagatgatccatccaggaagatgtgagaagatgaatgcatggtacctgagcataggtaacaagccacgtgacaaaatgcgtattaaaataaatgcattattttaagttatgatcctagtcagagagaagagcctagctatatggccaaagtatttgtaaatatattttgattctgagtcttatttctgggaacattggactgggaggaagaaccaaagccaacttcaacaatctatcactcctctccacctctttccttttaaacataacttagttataattttgtttatgtgggaaatgtaccttgtaatctggtaagttcacacaaaggaatctctatacctcattcaattccatcccgtattaaatcagtgctacttttggaagtcttgtgtgggttacatatgaacatcctatccataagctttaacctcttcatgatggcatatatatttcttagctcttccccatggtggatgttcacactgcatagtaagcacactaccttttgtggtacatgttcacacatatctgctcatggaggtctgtgaggatgtctatgggctgcaagtcagggttcagatttctggattatagattacaattgtcttcattgagctatgtaccgagaattactttccaaacagattgccctggtctgtgcctccacagttggagctagctgctcctacatccccacatctcctctgagagaggattatctagcttgtttactttttctcattctgctcagttttaattccattgcttcagtttctatctctctgattacaaatgaatttgaacaccaatcccaagcctattatttcctcttctttattgattgtctgtttatataacttatggctgatttttttaatttgaggaagggtcctgacacttttctattttatagcttgcatttgtattcttgatatcattagattgattattttgatgctttcaaatgttacatgtgtctgttctgatctgtctttgattttattgaatgtaaatctataagttttataaaataaaatccctcaattctttgctttataacatctgtccttcaagtttttaatagtttctctactcttaagtcacaaagataatcttccatattttcttctgttaattttatagccttgttttgtatattttaatatctgcttccatttaatacaaatctatgttttgtgttttgtttttcttcaggagccagtgttaccagcatacccactcatctgtctgtcaagtaccagtgatggataacttgctttttatcatatcatacatttttatatttcagtaacaatcctcgccctctaccattgaattgcacccacgccactcattccttcatactctatctcagaattggtttagaaatccccagtctcatacctttgagacttattaattttcgtccctccttatacattttaatttttctaattattaggctgccattggaacttttggaaaatttgcattgatctcatggataaaattggtttgaaaagatgatgtatttgctgcagtattgcatgttttccaataaaatgcaaatcacagttgcactctgttttctacgttcgcttttatatttttactaatctgtatgtctgcacacacactcacacacatatggcagagagaagggaaaaagaagtgtctgtgtgtgcccattcatgtaagtgtgggtgcatatgttacaccatcagaatatggagggcaaggaacaactccaggtgccagttcttgccttctgtcttgtttgatgccataggcccctttgttcagccccatgtagagcaggctgctctataagcttctgaggtttctcctgtctccacctctcattttgctataggaattctgggattcgagaggcacacaattctaggtcttgctttacatgggttctggggaattcaagcataggtctttattgctcacatagcaagtaattttcccactgagccatttccctaaccttagccaataaacatctttggttgtcttcgtgtagatcttaggcatgtaattttgactgtcatcatagagtgtatgatatataatttttattcgtgttttacctgattattgataatgtgaaaaaatgccattgatttttctgagttaattttttatatagctacctactaaagcttctattgattctaatagcttgtgactctgttgcaatattttccttttgtctgttatatgtgattgcattatctgctattactgaccgtgttaactttgacaatatctacctccctgtttggtgacagtaggaagatgtgacctatcattgattcaactcagacagagaattaatgaaacatcaaagtattattgccattaaagtccaagttagtggacaacgatgttactggggttacttacaggagaataggtaaagggttgcttacaggaacataaatagctcagggcagcctgtcactgaaaacctaccctaacatgggtaataacttgtaagctggaactcgagagctcacagagtcttttctgtttggtaatccatactgctcacacataaccatggggagagaaaggctttgttaacttggtaagtttcagggactcccagagacttgtaagttgctttctccttcagtcataatggaccttcctttaaaacttcgtgagtcttaacagcttccttttataacttcctaagtcataaggagctgccctccaaaagagactgattcagttcacagaaaattgctacttaactcatccagtctagtttttttttcctttcataatcagaatctatatcttatttccaatcttaaaaaacacgtattttaaaactttctaaaagatatttactcttttttgagggtttaggtatatataccttttaaatagtcaagaatattatcttctatttttagttgtgtgttattttaatcaaacatataggttgatggtctgaggctatcactctgtctgtaaagtgctttctatacaaggataaagatatgacttaaatcacccagaatccatgtaagagctgagtatggtagtgtgtgtttatatcccataaatgagggggtgagacaggcagagatgcctagtattcactggtttgccagccgaagcttctctgtaagattagctccacctcccagtaagggactgtctcaaaagtcagataaaagcagctgggagtggtggcacatacctttaatccaagcagatctttgagttccaagatagcttgttcaagaaaatgagttccaggacagctgggcctacacagaaaagccctgtcttgaaaaatcaaaacaataacaataacaacaacagctacaggagcagcagtaactgcaataaccacatcatgtatggcagctgaggaccaacacccaaggtaatgttttggcctcatgtatacacacatgtaaacaatcatatacataaactcctcccctcctcagagtaaagattgagcttcatcaatatttttctgtccaataattgcatgattttctcttaagactatacccaattttctttaattgaaatcaccaattttctttaattatgggtcaggaatatgtaagcttgtatcattgtgaaaggtaaagtctttcaaatgtattttaattctttcatactaaaatgaatctcatatgtacctgaacatttaagttattcacatacatcaaggtcagagatagcttatgtgaatagactcctagtaacttaatgataattttagtatctattaaggtccatattagcaaagtgatttctaattttataggcattttgcttactctacaagtctttagttctaagttttagtcaattaaaaattatagttagaatatttctgatcatacaaagcacaaggcacaggaaatacataagaaagagtaaccttccctccagtccacatccattagctacccagttcccttgtcttacaatgaaggcaatgggagagttggtgagccttcataggtacgcaagcatcatgctcaaatgccggacaaaaatgatagtgaatctacttcttatgaccctgctttattcacttgtcaagatatcctggcaaccattcagttacatcaagagcttttctaatggctgctttgtatttttgtgccatgaaatcgtatagatctaggaaagatccatctcttcatgtgtgacttggttggtttagcagagttctactaatagacatatacattgtttgcagtcatttgttcgtatgaacatcatttcatgcatgtgtgagtatatttgtagaaaagattcttagatgcagaattattggtcccaaggcattacagatgtaattttcatagatttgtcaaattatcttctctttgtggattgtgtcacattgctgttcctagacaaatatccatggatgtgtgttttctctgcatttgtccctgcaaagaacatgttttaaaactatggcaacttatacacgaaaaccgtatttcttagcgaaataccattttatattcctggaactataaattaatttgagtttctttttaaatgctctgagtcattcacatttttcccctgggatgaatctcctgtgctaatttttctgttggatgggttttccttactgatttataatagatattttttccagtattaaatgtaagttaactcaagtctggtgatattgctcaatggcaggacactttcctagtagtctcaaggccctgggtctgataacacattaatataaagaaaatgtcagattgtttgcacccaacataatgttctttttacagttatttgatatttcatcattttacccataaaactttctggtttagtgtaccatgatcacgtgaaatttaaattaacctagggaatattaacattacattatgtaatttcactttatactttgaaatctttattcaaggcatatctgtgcatagtttaaatggtcaaactgcctttatattaaacagtgagtacagagccagactcccctctcacccagtagcttgcagttgaagccccagccccacatttgtgcattagcaacctctctcggtgctcatttatcctctttcctgttatctactggcttctcaccgaggaagatggtttaacttttcctgttctcctcatgaagcatcccatgggcatcatccccacccaccattctctctcttccaatagagtgatatcctaattttggttagatcaacagtcagtgttttcaatattttgactatgtaaatgccattcaaaactgaaccatgcagtaaattacgattattttccctttctgcacaactattatgttttccctgaagctaatatttgccgcgtttatggtttgtttgcttcgtttttatgtttttattactaattcagtcccagatctttgccaattatctacagctctcctccagatcctcagatgtcctgggtgctcttttcttcgcgttcatccccactgaaagccctcccaagttgctagcttgctctgctctcattgtaggcttccagtgtctggtacagtccatcaacccaggactgcccttctctctccacccatggatgctctacatttcagtcttagcttagtgttttctgttgttctcttgacttttctcagagaatcctgatgtccaagaggccaatgcatgaatccttcattcctcaatccttacatcaaactgatgattcaaggaaaatagctgctctctcctctcatgaaagtactgtcctttcagagttcagcagccacctttggttttttgttttgttttgtttttgttcgtttgtttgtttgtttttttggggtggggtttcgagacagggtttctctgtatagccctggctgtcctggaactcacgttgtagaccaggctggcctcgaactcagaaatccgcctgcctctgcctcccaagtgctaggattaaaggtgtgtgccactgctaccctgctacctttgttttaagaatcataaagctattaagatccctagccatggcatgctccccctctctgcccagactgctatcaatgttttccagttctgaaagttaataattctgcacatcaaggcatgtatgtgtatttttgtgcatgtacctatcaaatagatgataagctgcaagttccagtagcactcatacttcatgttcaggaaagttcttgaaaacattttttattccttttagcatctttagttgcatatgctaataatacaaaataattggttttcatacacatgtagagttctttgatcatattttcttttccctattgcccatatgtgtcttccattatcccattttccttcatagtgtttactgtctactttcttgggtgtgtgtgtgtgtgtgtgtgtgtgtgtgtgtgtgtgtgtgtatgtaaacatctgtgtctgtgtgcaggtgagcctacctggacagagactaatagagagttgtcttccatgtcacttctccatcttctttctttgaaacgttgtgtctctcattgaacctggatctccctgtttttcagaggatatctagggacctctggaattcttgtgtctctgcccctcagctctgtagtcacaggcacacattgctatatccagttttttataggagtgcaagggctctaaacttaagtcctcacatttgcacagctaacactttaagactttaaccactgagtgatctacttttgtgctttttttttttttttttttttttttggtaaggttatacacatgagacctctttcggagatcttttttacttaatgtggtgatctctagtccagccactatcctgcaagctatgtgattgcttatgaatattaattcattgtgtatcttctatgtgcattcatctattgttagacacctaagttggtccatagcgtggttattgtaaattactgctagagtaaacctgtgtattcaggttagcttgacatatctaaattttattccttcatttgtgaatcattctttcctttgtgttttctcttttctttctctgaaactttgggatgattccctaatacccctgtattcattttccagatatttatagtgtttcgctttgctttgctaagagagttcctcagctccctgtctctttttctgtttgacttttaatatggaccaccattcttttaatttccaagtgctctttattgtcttctggaggttccttttgttcacaggtttgcagtgttttcttctgtctctggggatgtttgtaatggtgttttctgtttgtagtggtcttaacattgaatactccattcccttccaattgctttgttctgcttgtttgttttgatcgctatctcttgtagttgatgcctctctagatatcccattctggtgagaaatggcgagacccagactaagacaagcctggcagggaggaggaagataaaagagtgacttaggaagtagagatctttgaggtgatcattagctgaaatagctagagagaaactgatgactatttttctacgtatttataagtcttagaggttggtaacatgacgcaagatagagtctgggaaaagtatgtagcaagggctggaggagtggctctagattcaagagtgcatttctcttggaggggacttcagtgtggttcccagcatccacttctggctgctcacaactgcctgtgctccagctccagggaccacaatgactgtggcccctgtggccactttcactcttgccaagtagcccactccagatacataatttaaaagtaagatatttatttcttaaaatgtttagcataggaaatcctgtgtatgttgtcaggggcacatggattgtttgtttgttttcttgtaaaagttgggcaaatgtaagcaattctgtgtattctgtttgcttggttctctgacaggacaataagcatgctgctccctgagcccaccccttccagcctagaccatagtgctgtgtatcaaactgtactctggagatacattccattgagcagaaaacactgggtcttactgaatgtcaatataatctacaaatacagcagggagaatagcctccatggctattggagaggaccaaatggtagacagacaatggtcacttagcagcagtaaatagaagatgtcccaccctctcagcatggagcattcatagcactgatatagcataaaaagagaatgggcaacaactgcaaacataggtaacatctgaacctttggttggcttgtgaatacaagtttatcaaagcacaataaaaatcccactggagtaggcagatgctccatgggccaaagatgacacatgaagctacaggagaaggcttcatagtggaggaggctaggatgtgcttctatgtgggcagcactgagaggcctccgtgcagtagctgtgtaaagcaaaccgtccttctgcctctctgtctaatagtataatatgatcaagagagccatatgtaagaacataaggattccctctggagccaattgtcccttccgctccacactgagcagtaatgttcccagtgatgacccaagttcatcctcatgtgactcgatatataatatttctgagtggctaattaattctgtaatcataggaatggcaattagcaagatgcttctctgattagaggcctgtggtcaggaggttcttacacacttgcatttactaaaaaggaagccctgtctttgtggcacttgttaatttctaccagcagggaacatgagatttatctgaaagaccaaacctcttcccttctctgtccctgccactcattcttacttaggaagtatttagaggacaacctcagatgtgggtctttatctttcacctcatttgagatgtacggtttctttaccatctgcaactatgcacacaaggatatctggtccctaagattctgggggaatctactgtctcccaccctcttcttactataggagcactggatttatagatctataaacccatgcctggccttagatgggttcagtggattcacactcagtactcatgcttacttgccaagaactttgcccactgagccattccaatggcttctcggcatcactatcaacacttaatcttataagaattatttcatctgcccaattagtaagcattacaatagacactttctgtacatactcagtctacagattgttatgatcagtttataggtatataatcaggagccctgaatgttcataaaatatgcatagccttgagaaatggcaaagcgcttacacctgggaatgaaagtatcactgacaggtatgctaaggccacccagggacgtgttagaacagaaggtggcataaaaattattgttaataatgttgcaggtagatagccttaagctcaagcatagagcttccaaattgccatccatctgccagtggatgagttcttaaatttcttggaaatactacttttgacttcagtaaactaagacttactccatggcattactattaggattagagagatagcttatagattctatacaactcctaggtgcttttttgttttgttttgttttttaaaagaaaatctgcctagcatacaggaagctctttcttatgcagtggtcaggtctctgcactattgctctttggcatacctagtggggtatttattctttctttgctttaagcctagtttgggaaatttggcttgattctctgagagaccgtgagaaccatactagccaattgtagaacatccccataagcctcctgctgctaaacagcatgggagtcagaggtacaggtgataagttattgacacccatggtgatgaagtgactcttagaagcccctgctatctgttctgaccactcctggtggtgagagagtacattttgagtctctagcttctagccctgccgtaaccaagaacatttcaaacctggccctggtgtggtgtcattgtttgcttcctattgctgtgataaacaccacgaccaaaagcaacttggggagcaaggatttattttaatgcttacagttcatcatgaaggaaaatccaggcaggaactgaaagaagaggccataaaggaatgctgcttactgtcctttgacctcagctcactcagctttgtgttttaatacaacccacgactgcctgcacaggaagagcagtgcctactatgagctggccacagggatggcagtacctactatgagctggaccctcccacatcaatcattaatcaaataaatgccccatagacctatctacaggaaattctcagatgaggttccctcgtcccagatgaccctagcttggtcaaggtgacaaactgctcaccagcacagtaacactcatcaaaatggacttgaagatacagccatcttggtttatggaaatggtattttgaagaattgtgaaaaactagtccagcaaaatggctcagccgggcaaagctcttgtaaggacaagtctaatgacttgggctcagcagaggttccctcatcccggatgacccaagcttgtgttaagttggcccctaaatcaacccagcacacacggaaatgccagtggaataaatacaaccgcacatgggtacttaccaccgccattctgaggtccagacttcctagtctcatacgttattctcttaatctgataactggctggggacaggatcccctccaagtatacgtagtttctattataagtatatttttactgagtccttgcaaatagtgctatgactttgggcaagttcattaaattctttttttttcttcctgtttcccatttgcatagatagaattagctacggggcaacttctcataggtactgggagagaattcactgaaataagaaaaaaaattacacaaagtgtttagctcagtacgagctgttctgaatgctcaaaaattattgatcactgtcgaactatttctgttcttagtttccttatgtttctggtgcggtatccccattttcagagaaacaattgaaacagattgatcacatgacactcataaaataagaacaatcacggctttgggcattgaagtccccattgatattgataattagatgtaacaagtcttatttaagagtcaccctggtcagcccatgttccctgtcccttcctctcccacagcccactttcttcttccttccactttcagcctctctctctctaatatctacttgccagagtttcaaaagaatcctcaggctagactctggtgtatcaaagcttcccagcacaggcaggaccaaggagtaaggcagagagtttctaacagtctcctttcctgtcctaaagagatttgttgaaaacatctgcctccccatctttattccaggtgagaactggcctacccttttcctacagtctccccagtcaggtgacctgcccttgggcattctatgagactataaagccatgcacagagaaaacaagaatgttcataaagatcattgagtagagtatggcttgatccaacttccagcttcagtcagatgagaggaggcagcttggctgctccttggatggcatttattacactcacaagtcaataatgatcaccccagtgatagaagaagagtttgaagaggcctatgagcctaccagtgtgcaaacaatgacacaaggatggaaggaatgggcagagtggacacgtgaccttgaatcctcaccgtgaccctgcagtaggtccagtgggagccatcacattttacaaacaggaaagccaggccgactaccatcggatcccattcacgtaccaaacccacccagagccacacagcacactgcgctgctttccctgggccaggctacctcctttcttacttcccagtttggcaaccaactaaaaggcatctggaagccctatcagctccctctcaggccttcagaaaaatgagcaggattccagaaggggtgctacagagtctgtccaagaaagcaccaaggctgggagctggcagcacggctaggtttgattattcacgtctacagaggaacactgacttggtggaccagaccatccgaaaattcctctacttgatttttctggaatcaaattaggctggtgaataggccagtggcgttttcatcaatttcttagccttcccttggaactgagcctgatttccttggcctcccgcaaggccgcctgctgtttactgagcaaacccgctcccagcaccagctctgcttcagtaatgtggcaaggcaacgtggcagagggaagattacaggtattacaggccatttaggatcatttagaatcgagctgttttctgagcaggcaattaatccacttgcattaaagggagctgctggattcctgcacctctccctgagttaagaaggggatttggaggccttgttcactgacttgccaactggctctggagctcagtgaggtctcttcctgggggaaggaccactcccctgtacactgtagatctatgctggggaaagggtattgtacaaactgataaaaactgacgacacgactgttccatggtgtgtgaagattttcattgtaggtgtgtgagagacaacagcacgaagcctctgaaagagtcaagagcagagaagaagtgcactgagcatggtcagcagaagggacatgaccagggctatgtggtagagaggacagaatggcaggagacagttataatagagagtgtgtagtagagtagcaggggcctgggagaccaagaagctgggggatgggaaagtccaagagaccagcatagaggctttgaaatatacaagtgcttgtgagtagggactgtactatggacttgtttatgctgatatgtattacaggcatatgttaattggtaagccttatgtcccttttgttggaggtaaagaaaatgactccttttggtagatgggagctaaggaaggaaattcctaaggaaggctggcttttatctaaccactaggaatcctactccagtgtaggtggagctcgtttctgcatacttgcactggttttgccttcaaagggctcaggctttatctggagcccatcacttgctaagaataagaacctattagaatcttggaatagaagtttggaggaatgttttttggttggggagattagtgatttcattggtactgttgttctataaacatagatgaacatgctttgtcttcccacaacataagaatatactgaatatcaatcacaaggtgctatgatttcaaaggcaactgtttacccagtagtcctccttttcctttgtaactcagccaacaagatcccaggtcctcgtattccagtcttaattagtaatattaactttcatctttgatcttccatttgcaaaagggcccaaaatatgtgagaagtaaatggaatatgtacatatcaggcagtacatttatcatttgtctatctgcctgtctgttatagtatagatttaaaaaaaaatgcttaccaaggctacatgggctgttagaaatgtaagtgaagtttgtattgggaaggtaaagaaaccaaaccatcttcagaatagagatggcttctcttctgtcagacagtagagaatattgtggaatgagagtagagagtgaaggtacagggataagtttagccatgaagaaaaagagcaggaacattccaggatggaatgtgcaggtggactgatgggttgactaagctgttgactaagctgtgtcaacagcagggatccctgtgcctagaacagtctggagttctctgcctgttggcatacaccagatatcagatgatagatcattacaggggctgttgtcattacagtcatggatgtctaactctttatgggatcaaagggaagaagttatacttttccgtcagcctagtgtgtctgataagtacttgggtctggtttctctggtataatttaatatactcctgtagccttacagtcttgatacacctgaagtttatggggtaactctctttctattcctaggagtaagtcatttatctgcctgtgttgcatgggcggttctggacagatgatttttgttgcaggtcagtccaggtactcagtcaccctccatcctcaaaatggaatcactggctgctggtaaaacagtctctcacaccgtggctcagtctgggaaaaattgaaacaaagcagtcttctatacaatatgaggtaactaacatagagacagtcataacccaatccaagcaggtaggatgggaagaaataaacatcctgctttggggcgttctttcatttaatatggatctggacatggcacatgtggtccctagagggtttctgcaattatatcctccttgaagtcctactatgggttgaacatttgcacctccttctatattaaccttacaagttatgacataaggtaggaactgaagagatggaggctaagacttaaagaatgtaatgaatttatacttaagaccatgaatccatggtacctagttctacaaccacactattcacatcctccaaagatttgcatcaggagatttgacctttatgctcaggcaacacatagacaggtggtcatactgttaagcaacatcactttcttctcctagccttatctttccccaaaccaagatatacattacctggcatgccatccacagtgagaggctgtgtgccacatcaacctgagtccattgctactcagtggatagagcaagcttggctgaattcaccctccccctttttgtctccatttcctttgaagtaccattggagggctggtctccatgagggctgaggctgagcagaaggactgtggaaggcatcacactatacctactataaatactgtcgtcttagagggggtatacatatccctgcccactcctgaggctacgagcctttgcttctgtacatggccttcctttctgcattgacccacagtctggaatccagtgagagaaatttgcttgcatggttgggtatatcctaaaatgaaacttctgtggcagaagccaaagggcctggaagccagtttatatttgctgactgttcaagacaggctactgaaaactttgctaacatcctccccagtgagtcagggctatctgctaggcctaagtaaaaggaataatcaatttataggtgttgcctttctttcccaatttctggtgatgctattttgcctattcaaatttcgtcagtacatggatgaccctccgtaagtaaattttcaattttatctttgtgagaagggaatacacatatagaaaattctcacatttcatgtcatcatatcctgccattaaaagagaaagcttctcctcttaagacctcaggtggtcttctgaagtccagtacatatcaaggtctctttgactttcaaattttaagttactgactctttaaattcaaacaaagaaacaagcaacaacaacaataacaaaaacaacaacaacagcagcaaaacccccacttcctagctaagggaggatcaaatctccctgccaccaataggtagcgattggagccatagctgtccgtagccttggggaatggactccttagcttctctgtgagacatttcttatgtttgggctggcttttgatctatgggtctctgtgctaagaactgttacaatgaaaggtcttgggaatcattggcatccggctatcccagttcttgttaatacacatacacacacacacacacacagagagagagagagagagagagagagagagagagagagagagagagagagagagagagagagagagagggagagagggagagagagagagagagagagagagaaagagagagagagaaaaacagacagacagacagacacacagacacacagaaacagacacacacagagacactccattaggttacactccattctcaacagatcattagcagggtctccatatacagttacttttaaaacagatgccagaacagtgtccttcattctctttccaataacttagtgaaatgcattttcatgaatgtgaacaagaatacaggaggacattcaagagtttcaattttccttttccatccgtgacctcataaactctacattcctaactgtatcccaagaactgcctccctttcaaagcctttggctaaatctccaggctaagctaagcatggcagtttatacctccatcaatcctgagtatattccactgtgatgatctgtgtcttctgccttcctacaagttccacattctctttgcttagaaagcattatacacagtgtctggcatgcagcaggcaagttgagcaatgactggtaaagaacttagaaaatgctgcacggactacttggcttgtccatgtagttttaaagaaggcaatcatgaaatgtatggtctccctctagagaagtcctctttcctagcttcatctgcctcattgcttcagtgaaaatgctttgtcaacctttggataagccccctcttgtcgtgaattagataaaaccattataattttgtattgtgtagcagtgttttcttcagtaatggatcatatgtatggtgaaagccccacaagattatactgccttgtaaacacagaggccctacccatttatataagtgtattttgtgacatcggcacattcggtgatgcagtcttcaggatgtagtcttatctcatgactatgatgattagaaacaagcagcagtacctgtcgacctaatagcttttaaggacaaggaatgttttcaggaaatttgtttagtagcctgtgctagataaagaaaaagagggggtgtgtgggcctggggagagggtaccactggtaaaacactgcctcagtttccattccgttaagagggaatgtctaccaccatgtaaagctcttgatggctcctcagtaaacatttctagggtgtaatttataaagtaaaaaacagtacaaagctaacaaaagaatatagggcttatcaaccacattacaggacaaggcctctcttttagaagagttggccagcacaaaatactcagtgtgttgtggtgtgatgtgtgtgtgcgcgcgcgtgtgtgtttgtggagaaagattataatcaaaatattttgtatggatttttaaaatatatttttaaaatgatagtttaataacaaagtttaaaaacgaagttttttgtttgaccagagtaagacaaggtatctgagggcaggagtattgataatagaaaaaagttcagttagaattaggaagaagaaacaagtcagctctgcttttcagtcatagacttttctaaaatgtttcctatgagagcttggcagggcagggataataaaaggatccaaaaggcagctgcaatatgacatactgatgactgacagagccatagtgggtagaatccaagtgtatggggggaaaatcagggcattgagactgacagatgagacactttccaaaagcatgagctaaactgccaagtgtgtgtgtgtgtgagagagagagagagagagagagagagagacagagagagagacagagagaaagacagagagaaagacagagagaaagagaaagacagagagacagacagaaaggaagatatgagaaatagagcaagagagacagagtgtgacagatagctaggcaaagagaaagacagagacagaaacagacagagacagagacagagattaaccattagaaatacttgaagtatggagagttaagccatactgtggctctattttttgtgcttatgttttagatatttaaatgattagcccatgaggcagcaaattgggagcaaatgctacattaaaggcatattcagttatcactgaattgtaatataaatagtttatagaattggtcattctgaggatagaacttagaattatctatggcatagtaatgatctggctcagatacaaagccaggccaaggcattgggaatggaaagggctgcgagaaacataatggcttcagacagttgactttaagagctgttatttgccacaaaaatatctaatcatccatttatccatttatatagcatgtacatgccaaacacccactgtatgccagccactggaagttgtttgtgggatatatgtagtgaacttaaatcaaggcaagatgctcttatgctataaacttttcagaaactgaccaagtaccagacatccattatatgcgttataaagggtgaattagaaagatgaataataaagaagctttaaaagacaaaattgtgagactggaaggatggttaagtaattaagagaacttgctgctcttgaagaggacccaggttcagttatcagcacacacatggtgtctaacaactatctatttcttcagttcttggtgatctgattccctcttctggcttctattaacattgggcgtgcaagtagtacacagacattcatgcaagcaaacactccttttgaaaaacaaaatatgaaataaagacattttaggcaaaagaaactaaatatacaaagatctcagagctggcaggaacatgacatattccagtaataatgagcacagcggttggagtgtagtttgcaatcagaggtccagcaggaaccaactcacgggccttctagatgatgtggaagattttgcccctcacctatgaatgatggaaaacattggaatattttaagcaagacagcctcagagctttgcatttaaaaatattctatactctatcagctagaacttggaattcattttttatccatagaaataacttaataaatggtagctctgggaagccagaataatgctattagcacaatgtatccagctaaacagcctactgaaaagcttggctttgttgccaaccaccatttataacttagtttctataggaaaacgcattccaaattccagacaacctaattacaaatgacattttttgggacagcctacaatctacttagactggtgaaaagactcccaacattttttcatatcaaaggttgttaagaaaggtgagtaacagacttctaattttgagatgctggaggaacaagccctgtgcccccttctgctctctgaaattaccactctataaaaaggaaaggactagaagaaaggaaattgaaagtattaaggtaaggcaaaaaaaaaaaaaagtattgtgctggacgatggctatgctcaagtgctcacataaagggtatggttgggagctgaaagaagagcactatggccctagactctaatgatttcagcaggacagattacaagactggtattttaccctgagaagccaagtcctataaggtgggtttcagaggccacataggaattgaacagcactttcatacaatttagcataacagaaaattaacgggttaatccaataaagagccaaagagccaggctgctattgtcttcagggtagaagggattgagttgtttgtttgtttgtttgtttgtatttgttttcattgattttattttttaattttttaaacatatataagaaataaatgtaataaaccaaatacatggacaaaaaaatacaagaatcacatgatcatctcaatggaagcaaaaaagaaaaacatctttgataagattaaacatgcattcttagtaaaagccctagaacaagtaagactgtaggaaacatattccaacttaataaaggttatgtatgacaaactcatggctaatatcatcctaaatgaataaaaaacattaataagcctcagtaaaatcaggagtgggagaagtctgcccactatccctacaggtcatccgtgtgattgaagcattagctggagcaataaggcaagagaagggatacaaatgggaaaagattaagtcaaattattttcaattgaagattatattaccttatacccaatgttcccaaaatttgacctgaaaaattgtagaaattatcaataatttcagaaagtattatgatacataattgacttaccaaatttaccagtcttaatacatatgagtacaagcatgctaagagagagatcatggacatgctcctcttcccagtttctcaactaaaggaaaatatttagaatatacataacaaaagaggtttaaaaaaaaccctctacaatgaaaactttaaatgtgtgaagaaagagattaagaaacctactagaatttgaagacctcccaagcttacagcttggtaaaaattaatattgtgataaaaagaccttcctaccaaaacaatttactgattcaatgaaatcacaatcaacatcctcatctcattcttcacataaatagaaagaaaatcttcaatttgatgtggaacaacaaaagacccagaataaccaattagccctagataagtgtttgtttctatgcattttgcctgttttaagtgctaagatcatctgtctatgacccccaacttttatatatctgtttctaatgagtcaattttgttccatattagaatggctactccagcttgtttcatgggacatttgcttggaaaattgttttccaaccttttactccgaggtagtgtctgtctttgtcactgaggtgcgattcctgtatgcagcaaaacgcagcgtcctgattacgttcccagtctgttagtctgtgtctttctattggggagttgagtccactaatattaagagatattgaggaaaagtgattattactacctgttatttttgttgttagaggtggaattatgtctgtgtggctatcttcttttgggtttgttggaagattaccttcttgctttttctagggtgtagtttccctccttgtgttgctgttttccacctattatcctttataggactgaatttgtggaaagatattatgtaaatttgtttttttttaatggaatatcttgttttctccatctatgctaattgggagttttgctaggcatagtagcctgggctggcatttgtgttctcttagggtctgtatgacatctgcccaggatcttctagctttcatagtctctggtgagaagtctggtgtgattctgataggtctgcctttatatgttacttgacctttttcccttactgcttttaatattctttctttgtttagtgtatttggtgttttgattattctgtgatgggaggagtttcttttctggttcagtctatttggagttctgtaggcttcttgatgttcatgggcatctcattctttaggttaggtttcttctataattttgttgaagatatttactggccctttaagttgggaatctttgctctcttctataccttttatccttaggtttggtcgtctcattgtatcctggatttcctgactgttttgggttaggagctttgtgcatttctcattttctttgactgttgtatcaatgttttctatggtatcttctgcacctgagattctcacttctatctcttgtattctgttggtgatgcttgcatctatgactcctgatctctttcctagattttctaactccagagctgtctccttttgtaatttctttattttttctatttccatttttagatcttggatggttttgttcattttcttcacctatttgattttgttttctcataattctttaagggatttttgtgtttcctctttaagggcttttagctgtatacctgtgttctcctgtatttctttaagggagttatttatgtccttcttaaagtcctctatcatcatcgtgagaagtgatttttagatctgaatcttgcttttccagtgtgatagtgtatccaggacttgctgtgttgggagaattgggttctgatgatgccaagtaaccttggtttctgttgcttatgctcttacacttgcttcctgccatctggttctcaatagtgatacctgtctttgctatatctgactggagaccgtccttcctgtgatcctggttgtgtcagaactcctcagagtccagttgtctctgtgatcctgtaattctgtgatcctgtgatcccgagatcctaggtgtatcagagctcctgggagtaagctgcctctgggaccctgagattatgttgtgaccaagcctctgggatcctgggattctgagtgtattagaaaatctgggctcagcctcagcagcagcggtcgccatcttggttccgggactcagcagaacttaggaaattagtctgaacaggttagagggtgcgccagagaaccggacagcttctgggaccggcagaagcacagagccgctgaggcagtaccctttgcaggctgcagacagccagccaccgtccggaccagaggacaggtgtccgcctggctcgggaggcggcctcagcctcaggagcagcggtcgccatcttggttccaggactccctggagcttaggaatttagtctgcacaggtgagagtctgcaccacagaagctgacagcttctgggaaatgccaaagcaacacagcttctgagaaaggccctgttttgggccttcttcttcgaccaggaggaggtccaaaaacaagatatctgcgcaccttccctgtaagagagcttgccagcagagagtgctctgagcactgaaactcagaggagagaatctgtctcccaggtctgctgagagacggtaacagaatcaccagaagaacaatctctaaacagagtcaactataactactaactccagagattaccagatggcgaaaggtaaacgtaggaatcttactaacaggaaccaagaccactcaccatcatcagaacccagcactcccacttcgcccagtccagggcaccccaacacacccgaaaacctagacctagatttaaaagcatatctcatgatgatggtagaggacatcaagaaagactttaataaatcacttaaagaaatacaggagaacactgctaaagagttacaagtccttaaagaaaaacaggaaaacacaatcaaacaggaagaagtacaaacagacaaagaggaaaaaacatacaaacaggtgatggaaatgaacaaaaccatactagacctaaaaagggaagtagacacaataaagaaaactcaaagtgaggcaacactggagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagacccccgtccagtaagacaaaaaggcccacccaccagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaagaacactcctccattgttggtgggattgcaggcttgtacaaccactctggaaatccgtctggcggttcctcagaaaattggacatagtactaccggaggatccagcaatacctctcctgggcatatatccagaagatgccccaattggtaagaaggacacatgctccactatgttcatagcatccttatttataatagccagaagctggaaagaacccagatgcccctcaacagaggaatggatacagaaaatgtggtacatctacacaatggagtactactcagctattaaaaagaatgaatttatgaaattcctagccaaatggatggacctgtagggcatcatcctgagtgaggttacacattcacaaaggaactcacacaatatgtactcactgataagtggatattagcccaaaacctaggatacccaagatataagatacaatttcctaaacacatgaaactcaagaaaaatgaagactgaagtgtggacactatgcccctccttagaagtgggaacaaaacacccttggaaggagttacagagacaaagtttggagctgagatgaaaggatggaccatgtagagactgccatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaacctataggtggatcaacattatgaactaaccagtaccccggagctcttgactctagctgcatatgtatcaaaagatggcctagtcggccatcactggaaagagaggcccattggacacacaaactttatatgccccagaacaggggaacgccagggccaaaaagggggagtgggcgggtaggggagtgggggtgggtgggtatgggggacttttggtatagcattggaaatgtaaatgagctaaatacctaattaaaaaaaaattaaaaaaaaaaaagaactagtattgaggaagagggataagctaggaccatgctatggaaattggcagagcacagcatgttctttgaatctcacaagttgtatgtaagggtggggaacagatagagagcagatggtgaagactctcctcagcatgctaggctgtcagccttcatcctggatggtagaggtcctggtagggactagcagcttcaaaacatccctatctgcgccttctgctaattgtcagccctgtgacatcatcattgtttggtgcttttataacactttaaaatgtctgtggttctggacagctttgtcagacctattctcatataaatttccgttttttagctataaaaaaaaaaaaaaaagaaaacctggaagtggagcttcctctgggtattgtgggactggctgcagagttcatgcccaagatctgtggaagggattgagtcttctggcattgacctatgctggataaaataacttacatagacagccagtattttatatcacaagggattttgttatgaagcaggaggttttttttacaagtttagagtacatccctacaacacttctaatacaaccatcagcagttaatgcaaatagaactgtatttgatggttagtgataataattataattaaagaaacagatacaggtcctacacaggataacacaataaaattgaggaggaaatgcatggaagacaaaatctgactgggaaatattgctgtagatgcaatgaaagctgtgaccaaatttatcaccattaatttaaaatgaaggctaagcagttacctctttatacacacacacacacacacacacacacacaccatagatgaagatccagcaggcaataaaacaggtttagcttattcagagctgagaaggcatagaaaaatcaaaccatcacattagtgaacatgcatattgggaaaattacagaagaaaactagagatgccccaatatcacaaaaatcttcagtaacagcaaggaaacgaaacagaaataaaaacattgacaataatttgagaaaaaatgatagatgcagaagacaaagaaaatctgccacatccataattatgttcccccaaagagaaaaataatctgaacaatgtaatatcaaaatatgcacctgcacgtgaaaggtgcagtattggctgtaatagccacataagtgcagtccccatgaataaatttggtaaaattattaggaaataaacttcagccaaaagtagataaatggatttaacattctagcccctgctttgttttgttttgtttttgttgttgttatagtttctccattcaaaaaagagccacaagtgttggaattataattatagaaattgtccaatttatttccactgtgatcaattctgaaaaccatatatttaaaaaaaaatccctgaagcaattacccaatcttacaaatggtagaaaatggcaagtgtgcttttaaagtgaataattatgcctaggtaataaaggagatattcagaggacaaataaaatagagcagagactggagaactaaaggaacagaaaccagagcctgagtttcagaaacaggggatataagtactgccaccatcagtacaatgtattcactttaagtgaaataccccaagtgaactaccaaacaggcaaatatgcattaacttaaataaagaagaaagatgaaatgatagacctagtgctaataagacattttaaaggaatcacatataatagctaagaaattattaacttagtagacatggaaatgaaaagattgagatacatacaagaagactattaataactcctgaagtgaaatttaaaattcatcctttaaaagatatatattatttttagtgatgtgtgtatgtatgtttgtagtgggtttgtgcacgtgagtgtgggatacctgtggaactccaaaaggggtgtcagatgccctggagcaggagcgatgtgtgtttgtgaactgtctgacatgggtgttgggaaacacactcaaatactctgcaggcatggtatactctcttaaccaccgagccatctcttcagccccccacacagcatcgaataaacactgaatatgctcagggagacacaaatagaaaagagaaagggaacataagcaaggagcaatagtgaaagggatgtggccaaggacttctttgaacttatggaagacagtatttctgaattcaagaagcccagttgatctgaagtaggatgaattagaaacagcaaaaagatgcctacacttactatagaaaagctcaacgcatcccaggaatcttcaagaacagattggaaaactccacttcgctgtgaaatcaccaattcagatcagagtcagtttcagcagtgaatgctgggaacagcaaacaagctgcagaaagagcaggcacaacagcaagccttcacatggatatgcagtggagcatatgggttgagaggaaacagtctgaacaataaaaacacaagaagtgacttccaagagcccatcactgtaacagattcacaggatgactagatgggagagtgctaatctaacacacaagacaggcataagggcaagaaatgatggtgagcaaggaaaccgttacagactatgtgaatttcaataaactgtgtgaaaaatgcagtaatttgtaacagggtatatgcatgtacaggaaaaaaaagtgaaattaatggtaacaatatgcatgtaaagtgggagagagttaattacatttaaaatgtctaagattcttgagttgtttgcaatgtattgataatatttgggctttaaatgaaatgcatgtagtacaatattaaacagggtcatttagattagtttcccaaagaagaaagaggcattgaaggagatgattggaaaattacataaaagttgaagaacaagcagaatagcaaaatgagatgaagaagcaattccaggtttaccagtagccatactgcacatctctatccttcttttaaacttagccattatcagagatgtgcagaaaatgttttaagtaagtatttttatggataatgtcattagtgattttgtttcaatttcccaatattatctcctacaaacaaactaaagaaggaaggaagaagggaagaagggaagaagggaagaaagaaagaaagaaagaaagaaagaaagaaagaaagaaagaaagaaagaaagaaagaaggaaggaaggaaggaaggaaggaaggaaggaaggaaggaaggaaggaaggaaggaaggaaggaaggaaggaaggaagagaaaataaagaaagtaacccagagtacatgctgtctccctcaaataaaattattgatttaaccattgataaccagagggcaatctctgagacatcaaaacaaaagccttgggatttaaaagaaaactacattatttgtatttccagatgaaaaggaccagatccttttcaatgaagagggtccaattataaagaggtccatggatctggagcctgtgcagtatcaggagtgtgtagagaggacaggtaagcatcaaagcatcttatggacctgggaaaaaagaacccatgtgtccccactgacaacacaaataacaagttcaaggcagagtgatggtgcatgtctatagttccatcacctgagaggatgacatgggacagtcaagagttccagaacagtctgggccacagagtgagataggtctcaagataataaatattaaataatagtactaatagtagtagtagtagtagtagtagtagtagtaattaataaaaataagagaaagaaatagaaatcaagtttgaaaataatggctaccactgagagagatcttgcccatgacaataatcaatgataacaaagtataatggaaataatggagccatctagagcccacaactctcaaaaataaccagtcaaagcccccattcaggaataaatactgaaattacataaactgagcagcacagaaacagtagtgacaagagattggaagtgtgtgggtaaaagtgtaagaagaaaacactgaggagtcagagaggaagtcgacatgtctgtggaaggcatgcagaaagaacaaggaagagtgctggaaagctgctaattacatttcagatcatgttctcatcttagtgtttaggagaatgaattttgtgtaaaaagggatataatgtctgaaattagaggtgaatctcaacaaaaagaaatacatgacatcagatagtaatactttgtcagacagatgtttctatgagtcagatgaaaccagtgatgccctgcccaacagtgttaaagacatcaaggaatgagacatgaaagaacaacaaaaccaagaataagaaagttttgggttgaagccaaaggactcaggaaataactgcaagcctaagaaaacatttctcagaaatgaagaatgagctggaagcaacacagagcaaatgaacacaaaaggtggcacctggagagaagctggaagagagacaagtaccaaaaaaggaacaggactaaaatcaggagatgatgaagaagttggaaagcaagctaagaagaccaccatagctaacccagcatcctcaaggaagacactcaaagcaaaggcacagataccaaaatgtccaatgacataaggggataactctgtggttaagagtgtttactgtgtaaatgtgaggacctgagttcaatccccagcactcatttaaaaagcccgacatgacaatacttgactataatcctggcacttttaagacagaaagagaaggatccttgaggcttcccggtcggctagtctagacaatagtaaactattgattcaatgagagatcctgtctcaaaaataaaatgtatactgataaagacactttacatagacctctatgcatacccaaacatatgtaaacacatgcacacacccctctaccacccacacatatacaattatataattcaaggatactctttgaaaaaaaatcaataaaatgataaaaatggaggatactgtagattataaggggaaggaagatgtctaaaaggggttagcagaggctaagaattagaaaatacctattattttaacatatgaagattttaaaagtacataaagttaacagtgtacatgtatgtgtgcatgatacatacacacatacacatatatacacacatgcacatgctacacacacaaaagcactcactcatacaaggaatccaaaagaggaactctttggaagaggaagggccaagtagggtttaaaaacagtttgtaattgaatatattgttgtatgtcaaataaaactaaattttaaaatgaagaaaggacagcattcctatctgagaacatttatctaaaacaactaatactggggcatatttcagaaacatttttgcaacttatgataaaaattgtttcatatttacaggaaaaatgccttagtcatatataaaagaaaaatgaaattattatcaggcttttgactgtaatgctatgtagacagaagaaagcagagaaatgataaaactcaaagataatatgatctaagcttttatacacaaaaaagtaactttcaagcacacacttgcaaataaattgctttctacatgcaaaaatattcgagattattctcatgggtccttcttgaagaatctactcatgaataagtttgagtcaaccaacatgattagagagaggccaataagagtcagtagaaagaatattagatgatcatatgctctgccaatgtagattcagtacaattattaggaagagtgtaaagagttttattgttttaataatgaggttagtagagctgatagtactagtattgttactgacattggaagagtggtaccttagtcagggattctattgctgcaaaaaaacccaccatgaccaaaaaagcaagttgaggaggaaagggttaattcagtttacacttccaggtcataaaatccatcactggaaaaagtcaggataggaacacaagcagggttggaacctggaaacaggagctgatacagaggctatggatactacttactggctagcttcatatggcttgttcagcctggtttcttatacaaccctagaccaccaactcaggatggctcgacccaccattggctggtttctcctccattgatcactaatcgagaaaatgccttacagctcaagcttatggactcatttcctaaactgaggctcctttctctctgatgactctggcgtttgtcaagttgacacacaaaaccagcgagtaccacagggcataccaaaatggatgaaaatgtaatattctttttgaagcttgttgtactgtgtaagactgccactggggagacatgaataaacaaacatctattcacccaagacagggcagtgatgacagacaaaaataaggagcccacaaagtccagcttggtgaactgtggagagcagatgaagtcctgggtgaatgtgtattcttgccttgaccatgaccatttcaagggccctaatgcctcagcctcatgtgagtggcaaagtcgtcctctggtccaagtatgagtgtccaggattgacctgtatttaataccattgtatgcagaaactatccactatagcttcctcctcctggataagtgtgatttgaaattgctctcctacagagaccacccaagagattcactaaccagccttacctcattaatattgtatataaaacacccactaagttcactggttgctgttagtgtgtctccagctgagcgcatggcccacataatcctagcttttctgtatgtgtatatgtagtttcatttcccatttgccaaatcaagtcaatcccaaagatgtgtaggttatgccagtgaagcagttagtttattggggttacttgaaggaatatgggtgactcaaaggcaactgctttcctgaaaagtcctcactccaatctggctgaagactccctaatggtgcaattttggcattatctgcaagacttgtaagcaactcagatggttaaggcctctcttctaggtaacttggttgttcagtcttctttccaggcagttgtttactgcttctataatcttggggaagtggtcttgtgaatcttgtccattttaataacttcctgagacttgtaagttgtttatctcttgaatgtcatgaactccattcctttctccataaaagaatggagggaatctctctactacacttgagaaccaagactcttgaagaaaaaaagaacaaagaggtaagagacaacattgatctcccatacttgaatcagagttgttattataaattcaagagatattttactctctctctctctctctctctctctctctctctctctctctctctctctctctctctctctccctccctccttccctccctccctctctctctctctcacacacacacacatacacacacacacatatggaaagtttgtagtttgtatgtgagagaagggagggggagggagaggaagagagagagggatgaatacaaatgaacatgaatgtggagactagaggacaaccttaggtattattcttccattgctgtctatctttttggttaggtggttggttggttgaaacaagatctctcaatagcctacaactcaccaaggacacactaaagtggatggaaatgagccccagatctacctgtctgtcttttcaaccctggaattccaaacacacattatcacactcagcttttgtcattcatggttccattgactgagctcaagtcttcgtgcttgcaggacaggcaccttgctggccaaattctctctctagccaaagaaatattttatcataaatttatatgaaagttttacaattagtatagaaacaatttgggttttggattgaggtcagagatatcagagtagatgtatgcatagatgatagatagatgatagatagatagatagatagatagatagatagatagatagatgaatgtacctttataactttctaagctctgccttctgagaagtaatggtaccacagctgagtctagtgagcacacatagcttccaaatcttattttctaaaaatttatttattttttaaaattatgaatatgtacatatatatgaaaataatatatccatattcgtgtgtgtatgtgtgtttgatctcatgcattatgtctctgtagagatcagaaaagggaatcagatcctctaaatccagagtttacaggtggttgcaggctacttgaaatggatgctggagacaggacttggttcctcaataaaaccagtacttgttcttacccactgagcatctctcctggcccaagatcttggtttctaaatagtaatctctcatagaaggaatgaaaccttcttacagaagtatttgttctcagggtagagaaagtaaatgcaaaaggaaaccataacaagagagtagactcaatgatctagtgctttgagataaaaaggagcatagggggatagagaggaagccgaccaaaggagtctgaaggcattatctttaaaaacatgcacacaaagcacaacagaaacaactctactgtggcattctgggatgtgcattttgaagataaaactataaataaaagctagaagtatttttcataaaaggcaggattgtgattacattgaaaggaactaaggactccgattgctgtgctcccagagaagccagtgaattgtatttgttgtcttgagtgtcagtatgctctatgggcattttctaagctctctattttttttaattttatcttctctatttgtcctgtattttacaataaatgtatttgtttgcttctgttgcatgcttttaaatagacacattccagacataaggatataaagagactagacatgaagaaatcataatacatttttatgtatagagtagaatattatgggcacaaactgcccccaaagtgagctgctgtggttatgataatatgagacaaaaagaccataaggcaagataattattaagaaaaaagcctggtattacattaagacaaaaggccaagttcactgggaagagataatactaaacttgtatgtactgtgttacgcgggttagaacatgtaagattaaacctgattatactagaaatgaaaatctgaaatgaactagaaatgaaaagttgaagtgacatatatttaaagctgtcacttaccttagtcattgtcaaagagatcatggtaactattaatgaagatatgaaattttaataagacaaaattaataaggtctaacaaaaataaaatatgacttttggaaattaaaatatatagtcttcttaaacacatattgaatcaactaattttaaaacatgaatacatataacaatatgtatttccttatcatctgtagttaccagacagaagatagaaaaacatgaaagaaaaacccaaatctaacccaagatataaatgtttgtttcatataacctttatttatatattacaaatgaaattataattagatgtagttctctagtatattaaaatctactgtaatcatttaggtacacttttatttttctggcaaggtttcatgtagaaacaagctttgtacataacagccccaaactacaaatatctctgatatcatccactatgcaaatggccaaatgaattatgctactgtatattatttaacagtaatcaaaataaatacatacaataacttggataaatctccataaaattaggctgagtttaaactagttattgataaaatactatatactatataatttcatttctataaaattctttaaatgaaattttggtggacagcaaattagtagcttccaatgttacaaagggtatagggagtgtgggttggagggatgtagatatagatttatcaggcagcctgtgggatcctcgtcatgaagccaacctcctgcatcttgactgtatcaatgctcataactttttatggaatcatacaacagcttttcaagatatttcagtaggcaaatttgataagcatatattggatacttctgtagtatttcctagagatgcatgcaaatctacatttcattccaagtaaactcttaatagaaagtgcaataaaatatgtaaattaaaacatgcaagatatagcaaagtgggattctaaatctttaattctggtttttttttaaggctaaaatatctgtaagctctctctctaagccacacatggagggggagtgtcctttgaattaaaattaaaaataaaaaatgaacataaatttaaaaattaataaaacaggcaaaagttccaaaagttacagcaagttcaaaagtgagaaaaatttctgttattgtctgtctctgtctctctgtctctgtgtctctgtctttctgtctctttctttttatatctctctgtgtctctgcctctgcctctcttcctttttatctctgtgtctctgtgagtctctctgtctctttgcctctctttgtgtctctctgactcctgtctctctctgtctctctgtctctgtctctttgtctttctgtctctcacatatgcactcacgtgcaaacacacacatactgtttagagaacccaaagattctctatagatgtagcaaaatttaaaatatgagagaatagatttgctaattgtattccactatatttgaaactttgggtaaaataagatttctcagaataataaaatactatgactatcgcaaggaaataactcccatgatggttgagtaagtatttcactaccagtgggcatatcttgccaggcagttattaatttacctttcaggttcacaactgcctgagactgatgattgccattctccaacattagtaagcacagcaccatgaaagctagccggtagggaagaagcatccagggtgatttctctatattctgtggcccaaaaatatagcaagaatacagtctttagcaattaggtattcctatcaagccctagaggaaaccaatagcaatggtgagagcttataatatttaacaggtctatggagtctcacttacctacatcttcaatcaaagtaacctattcctggcaccaagctttttatttgttactctctggtatctagtagaggcatttgatagtaattacatttcagtgctttttatatctgcatgtttctctttcaggatgtttatgctttagtaggttttcatatgacattttcagcatagctgtccctccctgtattttattccctaccttgccctctcatccctaatgctgtttaaacttttttgtttcattattcaacccaccccctttgaacgcatcatagtttagtgaatctctcaggacttcatcagagaagctccattttgcattgaatggtgatgagcagagagtcacagctggtcagcagtgcagagaataagggactgctgtgtggtcaatcctatctgaggcacctacatcacattctcctcctcccagggctcacagatcatcacagtaaagggttatcattagagcaagagatagcagtaactatgacatgacagtgttctggatacaataggacagttacacatgtgaactcattatggttgggacagtgtacaaagacttatgcaagatcaagccaaacaaaatcccagtgtggaaggagagataagcatgaagccccacttctagcccccaaaaaggcttttggtagttattgatagttgttgagaagagagtttttcttctctcttctcttctcttcttctcttctcttctcttcatttatttgatattttttatttatatttcaaatgttatcccttttcctggtatcccccaagaagtccctatcccatccctcctccccctgcttctatgaggggtgtccctcccacccacccacccacccactcccacctcctcaccctggtattctcctacactggggcatcgagctttcacaggaccaaaggccttccctcccattgatgcccaacaaggacatcctctgctacatatgcagctggggttatggggccctccatgtgtactgtttgaggggtctggttagttgatattgttgtttctctatggggttgcaaatcccttcagttccttcagtcctttctctaactcctctattggggatcccaatgtttggctgtgagcatctgcctctgtatttgttaggctttggcagagctctcaggacacagctatataaggctcctgtcagtaagtatttcttggaatccatggtagtgtctgggtctggtgactgtatgtgggatggatccccagtctctggatggcctttccttcagtctctgctccacactttgtctctgtatttcctcccatgaatattttgttcccccttctaagaaggaccaaagtatccacactttggtcttccttcttcttgagcttcatgcggtctgtgaattatatcttgggtatccagagttttgggactaatatctacttatcagtaagtgcataccatgtatgttcttttgtgattgggttacctcactcaggatgatattttctagttccatccattggcctaagaattttatgaactcattgtttttaatagctgattagtgctccattgtgtaaatgtacattttctgtatccattcctctgtttaagggcatctgggttgtttccagtttctctctattataaataagaatgctatgaacattctttatgttggttaatggctgatggattaaccatgctctacaggatgccacatatccaagagtacatgagaagcacaacttgtacaggagtttttaataaatgataatgcaaagttggatttggtatggaacagcaggtgtgggttggtgagaggggtatatacaggtgtatgagtgtgtgtatgtgtgtgtgtgtgnnnnnnnnnnnnnnnnnnnngacagagacagagagacagagagacaaatcaaaacataagagaaagagagaaatcaaaataaaatgtatgaaattatcaaataattaatataaacacatgaaatagaagatcacaaagacacacatcagaatcacaaatacacacacacatacacacacacacacacacacagtataaaatgtctctaggatgaatctagaattttcaatggttgtcaaaatgtaattaaaaaagggatggaaggaagtacaatagaagagttatattttcaaacatatattcaatcatcaaaaacaagcagttctcaggccagtaggtcactagtgacatgattgacttgcctttagaagttcaaggcaaatgctggagcaaggggaacaaacagatgcacaatcctcacgctagtgctgatgcaatcgttttcattgggatttttcaccccaaaacattacaccattggagttgatgttgaacaagtaaatcaaaagtagtgtagtataactgtagacttcagaatttttccaaccacagaggaaaatttatggaaattgagcatgtattagtcatgcttaattctccacacactttatgtgtaacacataggtattattttattataaaataattggcatcaatatcaataaaaaggtaatcttacaatgattgtaatgcagaactcatatctcgtacattgttcagagggtggagaacaatttccaatgaaaactgagagatatttagaattttatgttaataaaaatacatactgaaatatatgaaatatagttaagacagaacttagggataaatttaaacaaaaattttttgaaaatgtttatgtagccataacagagttaaaaattaaaggattattgtttcatttcaaagattgtaaagggggagaaacagatgcagaaattaataaaatgaaaaaaaatatacagtagaaatggaaaaatggaagtcttagaatcaaagtttcaataactgatctctctatcatgagtgggtaaaaaaaaaaaaaggtaatacaaggaaactgtgtgtcacctgcatccatgatataaacagtaatactctagcatctgggctcattgtaatgagaaagaatgtgaaatgaccatattagacataatatagaaactgcctgaatccccagattaagtaaaatgtcccccatgggctcatgttctggatgactggacctcagctgatggtgctgttttggaagatggtggaatctttgggatgcctggtatgactggaagtgtgtaactgagtgtgggtccttgagagactattttcccagaatatttcctcttattccttgattccctttgtaatgtgatcagccaccctctgtaatatagttctgccatgatgtcattctgctcacacacagccaagcagttatggcctgaactccctgcaacatccagacaaggcaagaccctctttcctaaaggtttattttgttttttgttttttggggtttgttttgttttgttttgttttgaggtgggagggtaggccacatcaagacaaaagttactaatacaacatggtggcacatacctgtaatccctaccaaggtccgggggatggggggggaggggcggagattgtgaatttgaagttaacctaggctacacagtgaattctcagaaagcctggcctatatagtatgaccatgtctcaaaaccaaacctaaacacacacacacatacaaagaaaagaaaaaagcagaaatagccaaaagataaacatatatacatacacaatacataaaaataaaccaagataatgtctgaaaagacatattatccttaaaaagtatcatatgatcaataattatcaaatattccctctcacattattagcttcaaatagtccaataggtatgctttaccaaacacttgaggtatcaggtattgtagtcttacataaaatcttacagagaagagaaataatgggaactttccatagtccatatacttcaaaataaaatctatgtcaaaagtaggtaaagacaacatttaaaaggaagatgaaatttgtttcccttgtgaatatttataaatcaaatttattagcaaaaacttgtgatagctggtcatctatgctgcaaccttagtggtctatgtggattctcaataggctagcttattattagttcaaataaaatattcaagtgggtatgaaacttgcagggtttgcgtaggaaatattcaaatgtcatgcacaggttgtagtgggttctattgtgagttctgttctgtacaagagaataagattggaattaagaattggctgactttagtgaaccaaaacaatgtggcagagtctgctaaagaggagcaaagcagacatcgacagagcaaggagagtaaacagagcaaatgcagctccagcaaggatctccctcacaagaggtacaaggtcagcaaaaaatagacagaaaaggatacatttctgtgtaattctgtaagtacaaaannnnnnnnnnnnnnnnnnnncgcacactgcattcaataaaaagattattaggaaagtcaattgcatttttatgctccagctgcaaacagaaaaggtattaaaatgataatcattatacaaacaaagtatcatttcatatggcttataaaagcacagatgcatgattcatgggaagacgtttatgaagttatattggaaggcattaaacacatttcaataaatagatttaatattggataaaaagacttgatttgttttagatgtcagttcttcctaaatgaatctgtagatccaatggtacttaaagtaaaaaaaacaaaacaaaacaaaacaaactcttcatggaacttggcaagtggctttcctcattggtgcagaggaggatgtgagagctgagcaatcagaccctgcgttcaatacccagcacgacaaagtcacaaggtgaaaatagcactaggggcaagaacctgttccttcactaataaatatacactataggttacagagagcaagagtacgattttattgcaaggtttgacaagaaaacgacaatgaaaatcaaatctgcacacagatccaccaacctgtccagtgaactgctaaaataataaagctacattgctgtggagtcattgactgtccacaggaaaataattataagggatctggtcacttatcacacagagaattgatttttcaatgaactgactcatatacaaagggaagaggttcgcatttttttaaatatggagaaaatattttgacaatgaagtagaaaaaaatttcttaaacattgagcacacatgtgcacgcgcacgcacacacacacacacacgcatacacacatacagatatacacacacacatattagttgcatgtctagttgctggaataaaatatctgacaaaaacaactttagggagagttacttagggctcacagagtcagtccaccatggtgaagaaggcatggtgacaagagcttgaggcagggaatgtgagtcacgtggcatttatagccaggaagcagagagggatgaatgctggggtttggctcatttttgtctttttaattaggctaggatcctgtggaatgatgcgatctatggttagtatgggtcttcctgcctcagttaacctcatgtttaaacatcttcttacagatgacatggtatttgtctcctaggtaagtctaggtcttgtcaccagattggcaattaataggaaacatatttatatttacatttatatttatagttacatttatatttactctattatttatatttattagaagccaaactatctgtgaaaaggaaagagattaggaggaggaaggagagtatatatagaaagaccatggccaaaacatatgatattcttagatcataatagctttataaaatatatcactacatttaatgaatatagaccaattaaaattatgcaaatggtaatgcagataaattcaatcttactatacccctaaatttttgttcatcaataggaaccccaatttatttgaaaaaatacaagctttatgatggttggaaatatttgctatatacaaattcaataattaataagtgtctagaataaatcatatttctgtgagtcaactttgaaaaggcatttagatagaaaagacatttgataaagtgtggatgattacaaggatctgtgaatgaacataatactgtctggagtagatattaaatacttcatgatgcggtttcacattttacctgtaaaatattagcagtttgacactgcggaacgtgattaaggatgtggagtaatggggtgtacgagatgtgtaaattgtaaaaccactgcacgtaaaactaagcacttaataataaggctaaagacagacatatatcttgcatgctggacattccattctgaagcagctaaccagatcagttctcatttgtatatatcatggattatgtatatgaatatttttagattattgtgcgttcaagcaaaatattggaaacagtccagatggcgcatcaggagtaaagtagataaataacttgtgatagttacactcagtaggatactacacaatagtgaaaatggggcggggggggggggcgaatcaaaatggatgagttccaaacactgcagagagaaaactacattaacatggaaagcattcaccaggattcctataaaacaagggcgaaaacagctctgccttgttcatgtataaaagcactagatgataaatacaaaatgtaaaagtagtctctgcctataggaatggaagaagatatggactaggggaaggcagtgcctgcacttgtaagatcctggcagtggttttcataaactgttaattatggaagctctttccaccattctgaatgttctgtatactctatttgtgctagcaagtggacatttaaaatcatactaatataaaagcataactttctttttttttttttcttctgcggcaaagctttattgcttactcaggagcaagagaggaagagcgcggcagagagaggcagagaggaagagagagagagaggcagagagaggggcagagagggagagaggcagagagcagaggaagagagcagaggaaaagatgaagagaaagagacgaagatacgaagagcataactttctttttttatttgttttttgagacagtgtttctttatgtagtcttggctgtcctggaactcactctgttagaccaggctggcctcgaactctgagatccacctgcctcttcttctgagtactgggattaaagatgtgtgccaccactttcctggcaaaaagcctaactttcaaatgacagagaaaatcaatactacagttgtacaatacctagaaagtgacaatgggtataatgcatagcaactggaggattacttnnnnnnnnnnnnnnnnnnnnctctgccttgttcatgtataaaagcactagatgataaatacaaaatgtaaaagtagtctctgcctataggaatggaagaagatatggactaggggaaggcagtgcctgcacttgtaagatcctggcagtggttttcataaactcttaattatggaagctctttccaccattctgaatattctgtatactctatttgtgctagcaagtggacatttaaaatcatactaatataaaagcataactttctttttttatttgttttttgagacagtgtttctttatgtagtcttggctgtcctggaactcactctgttagaccaggctggccttgaactctgagatccacttgcctcttcttctgagtactgggattaaagatgtgtgccaccactttcctggcaaaaagcctaactttcaaatgacagagaaaatcaatactacagttgtacaatacctagaaagtgacaatgggtataatgcatagcaactggaggattacttaagaatctaactcaagaaattattgttcaacagaataaagcaaaggaagtagatgagaaaaagcacccagaatttagtgaagttacaaaaattcaaactataatatggcctcttcaaggaggtgatgaagtacctgacacaatgattgtatttagagaacatgaagaaaacctatgcagaacatatggaactctccatagtaactacaagtaacctcatggaaagaatggggtgcatccaacagtgatagatgccaagtgagtagggggacacttgctggttttacaaagcaaaaccctagagcaatgtgtacagtcaaccttcagctgtgtttaaaactctcaaggagcatgggaaaaacattacatcagggtcttaataacttcaacaggtagaacaacatagcttaataatccaacttctaagtattttatattgaaaagaggaagtggaagagaaggagtagaaggaaaagaaagaggggaacagaaggaatcatgaagatcacagcaaaacatactcacatgcttataagtgctccatgggtaataaccaaaagatctaggctttggctagctaatggcacaatgaagcatgttagatttacaatgtagaatactttggaacaggagacactgtgactgtggatagagcttataaaatgttgtggttatgttttcatcctgatcatagtagcagccacatgaaatgtgcccatttattatagttcacagaactgcacccaatcaaaaataaagattattttatagaacttaaaaataggcatacttaccttcaagtacagaatatctttagacagttgcacttaagttatatttttgttgttgaccccactgagaaaaacagaacagggaactcagatttgaacaagggctggaatagagtattgtcccacatagcccttataccttcatattttgcttttcatgtttaaacacaacacatatatatatatatatatatatatatatatatatatatattcacacacatatatatacatatattcacacacacacacacacacacatatatatatatgtatatatgtatatatatatatatatacacacacacacacacacacactacacaaaatgaaactttgttctcttaagattagagatcacaggactggagatatagcctggtaggtagagttctttcctatacttcatgaagccccatgttcaaggaccagacccattttgtgaccaatgaatcagaaatatctactggagcctgatgggatcactagcggttacacaacggaatgccataagtcactctatccttgaatctatcagtaacaagtagcttagcagtaagggatgaagctccccagttctactctcattcatgcattactattgacaggccaactctgtagaaacccaacatgggcatctgctgtgagttcatggttgcactgtcttatgtctagaaaatgacatttttgtagctcccccctatttttgactcttagactccttctgtccctcttctgtcatgtttcttgtaccttagtagaaatggtataagtaaatgccttacctaggactgcacagtcatctgtcactacatcttaacacctttgaacagacatgagcctctctgctctcacccataatgtggaagagaggcttccctgattacggctgagagtagtatttgtctatgggtataaacacaaatatttagaagacggtttgatgctatgtcaatttagataacaatacccttcaatatctctctctccaggttatgacctccctgccaaggatttttgactaggtacatagtcccacccatggattctctacttaggggcaggtctcaaagccattcctagaagacttgagttattaatgtcattagtgccacaggggggatacatactatgagctgttggccaaaggggccatagaggcactcaacacaatataggctcttgctattcctcctatttgcctaccatagctagatgatttgaccctatttctgaaaacatcacacatctttattatatgatatagagaaatcaagctggacttgagcaggaagctccctccatgatgattaagctgttatagtcttggaaagaaaaggcatcaacatacctgtgaaccatacaaattacaagaccaactagccaggcaagatgctcccatttctgcaacagtggtagtactgttgcagtggtaaccaaacactctgtgtggccatgttctaacccaagtaaggttccagtaatatattgcaaaagaaacaataaaggttacacaggagtgtaggcaataaataatcatttctaggcagcaaaaggccccaagattctgtcattctacaaagctattgtcattgcagtggtaaaacaaatgatttcttgaagggtgaggagcattagacacaggtgatgggattattgacttgtaattatggtgttatatagaatgatgataccttcataaggagcctttcaggttctttttatgtctttgtttcttgtgcataataaaataaaataagaaatacaccttcttcctccttgatctatgctcagcaaactcctatgtatattcatgttcccaaatgcttgatctgttttcaaagatagccctctattatagatagagttcagaaaatactgtaacatatctagataaccgtattctctctctgcctatgaccagagaacccaggatagtatgccagaattgattgtgactcctcaatggggtcactccaggatggagtagttgaaagccacactgtgtgcagcactgattatgtgagaaactactctacgtgggtgtttaagccatgttttcaacatagaagatcatagtacttttcccctgtcacttcaatttgtagaattgaagtctagcaggttctctcattttacaaagagatgaacttaggttcagaataaaattgcttcaacaatataattagagagaatctgagttattttttttaagcccaaactatttgccagagtgacataccataaacataattaaagggcagttcttcccagacattgagaaatgaatgtgtggaacagcacccccacaaggcagtttgactagaaacaaattaagtaaaaggatatatgtaagggacaggcataaaatgtgcaccagcctggtctgctaagtagaaatgggctcatgagaccaataatcaaagcaacaacacgcctgtatggagcggcttggcacatacagtgttctaggcagctggtttgggttctgactccagctctgccacatagtatctgttggaatgatagacaggttgcttaatctctctttttctctatcccatactttccttagcatcagctggagacattcaaagtacctaacctggttaattgccatggaaggttaaatgagttaatctctacttgtaaaatcactcacaatggttcctggtgcccaggaacggctggtaggtaaaattaccttataagtgtgtttctgttcttcagattcatgaaggatcctgctgggccattttgcaaattagacattcagctcaagaactctgttgccagccttctcacacagcttgagttcaagccctccttggagtgactgtgaggccagccctctttcctctgcctctgataatgttcttacacgaagttttcactagaatcagactctaggacccacctttctatttggcagatgttcctaaagcaaattctgacaaaaaaaaaaaagtggtattttgagaattctaccttagtcttgggttttttttttttacttcctcatacttaaaaagccacaattaaaaggaaatgggaagattataaaacacacacacacacacacatacacacacacacacacacacaaacacacagagggtaattattgattttattaaaaacatctatcatacagccacacagccattgttatttcaagcctgggaatacaatgcacactattaagccatttgatgattcaagataaaagcatgagtaaatatgctaatgaaagtgccagcccgcatcaagatgcccaccactgatcaacctcagacagatctggctgcctaaatgatccctttgtgaacttcctattcaacctggttttctagcgagttagctattttatgcaaaaaaaaaaaaaaaaaaaaaaaaaaaggagagtaatgaaatgaaattctgtgtgatccctgggcctggctgccaaccctggactcctgccctctggctactgttccaactcattttcattgtcttcttagtagaaaaccaggcccctggcattctcttaccaatttctattctcctgtctgcaggggcaggaacccaatgcaatcagtggggatcatgtttgtcaagcctcagttgttggccagatctcatgctggattcttcatgcattaagacatatggtctaattttttctatttcatccttctccctgacctgccttacagagaagctgtaggctccaaaacgataagtattttagtgagataatcacacatttggaatactgttgttcctttccccagatggctcagcccctctgtcatcttgggtcagatgtaccaatgagagtataattgacacacgtctcacagagtgagagccgcaggggctagttcgagtatcaccattttctctgcaatctgtttcatcagcttgagtctcatgtaattaggattggtagagctgtattttaacctgcccgtggacatgtaacacttgctgttggagactacagatgcaagggtatacttttagtggagcataaccttgcctgtactgtacctagccaagcctgagcaactcattcagaccttgggatctgggatataaataccattctctctgttttcaaagatctcactttttctaatgccccaggcttttaaaatggcacttgggttagcctctagtgtcatggacacagtgctcaccctgtgaagttcaaaaagtgatgctgatggaaccttgtgagatgctttgcatggactctgaggatcccagtaggagaaagcataggtccctggagctcaaggtcagaataaaatgtattagttcattctgtaaccttacactggactcagggcagctgtctcctctcttctttcttccctgtgtgtaatggaaattataccatcaatccatggagtccctggcctctaagaaaccttgacatcaaacagtatcttcccttctttctcaagccagggaagatagatttttagggattatgcgagatactatggagcattgttcattacctcagtggaggaaaatgttatgagatatgagtccagttgaagaggagatagctgttaggtttcagactcacaacaaggggctgaggggcatattttacatgccaaagcagatctttcctccagattctcccagcatccctcagtccctacctggcactgcccaagcccaacctcaaacttttcagcccaggggctgggctgctcttagctcagaggctctccttatataatccaaacattttggtctctcctcttttctaccccctcccccatttccttctctctgcaagtaggctttctcttcttcttgccaccccttccctttccttcccaaggtgatttccttggcctcctgcgaactcaccctcataagagcaacttccaaataaacctaaacacacacatacacacacatacatacacacacacacacacacacacacacacacacacacattaatctggcttgagttggttaattttattggcagagaaataacttatcaataatctggagtataaatatgacatgaaagaagaaaatatatgaggaaagatgctaggaattagattcaactggaaggtgtagagtaccatacattcagatcaataaagaagccataatatgacctgagattacatgcaaagtccttagggctgggttcacataccagagcaagtgcactaccatgcttctaaatctgtgccataaaccattagccttttttactttactcgtaaatcacatcaataatacttccctgagcacacatttccccatatatacatttacttactagtaaaagtaaaaatgcattgtgtatgtattttgtttatctaagatgcacagcaaagggaaatattttaaaagatgaatatgtaaataaaaagagaccatataaatattctttcactttctcccatctcccagcatgggttgggatatacataacctactactgctgggccaatggctttgaatcattctgcctagaagtgactttgtggccactgaagatagaatccatgggtaaaggagctttcaaatgcttgctctggcttaatttttcattaagttttaaagaacatgatgaataaagcaagctattcattaatcaaattgcaacggagaggacaaagatacctttggcttcttttttgttttccagtgtcactgatgactgtgaataacctgtgtcctttagagactaagcaggaaggactagatacttctccatgctattcagagaggtattaatttgcacatttaaaacaatggttccggttgctcatgtcagagtcactctccttctctgaccctaaaaatctgtcatctcaacaaatagctgaagagtggaacttaccacgaatctatttaaataataaagtcatgactgtgtcaggcatatttatggaatggaagaacaccttgagatgcaggacactggctttggtgagtggtttgtttgggttaaagttaggaaaaagaaagagataaatcctgttaaatagaaacttgaaagtgatttctttggtgcaaaaaagtgggtgtttctattctatgaaatactatgttttgggcgttcagattcccagagcataggatatgttgagtctcattttgaatgtgtcaatttgtaaacatttttgaatatttaatccatataagcttgaagagtctggtaaagtgttatgaaatacaaaagggtatactttaattcccatctcatttatagatagtattcaaactcagatccaaaaatgtcaatagggaaagaaaatgcattaaaaagcaagatgccattagatcagttgtacaaataattcctaatttgcctgtactctcaagaaatgtacaaaaatataactcttcaaacattattaattagattaattagaaagcatcatacaaccaaatgacacatacttcaaagacacacatctgtaaaagaacaacatggggaattttttaaaccaagagtagcaaattatgtcacaaatacactaacaataaaaagctgacataatattaacagaaaaatgggccgaaattagaatgatacattattgttttattaatataggatttgatttgctttgctttcattcgtaaaaggtctaattattcggagaattgcaacaaatttaaacctaaatgcacacaacaatatggcatgtaacatttcttttcctccattgagtaaatgtttcctctcagtttgcctcagacaaacttttaggagttgagaagatagcagagtatatattagaattcctgcgtttatgatatgcgcataacctatgatggaagacaataaaatcatttaatatgtcaggtattgataagtgctaagaaaaaaaatgaaggttatgttgcagaaagttataggcaagggctccatagtttagtccattgtgaaggtgggcttccctcataaagtggcttacaggaaactatacagtcttgaaggaaaacacttcagatagtggaatccaccagtgtgctgacacagagcaggtagtgttcttgaacaactctatgtataacaaagagatagtatttacagagtgtgtgagagggcctagagagtctcacccatagaccactttaactgacagatcaagtagctggataatgaatgaagcacagatatttattagacatagtaataaccatctaattggtgaatatgaaatgatttacctaatttttggagactatgaattatgctctaaaacacataaatagtttttaaagcaataattaataaagcaagtttgagatctttcaagttagtctctcattacattctctgggcacaatggcattaagttagaaacaagaaaaaaacatataacagaaaatttaaaaatctgaaaatatataagaacttgtacaaaatatataggtcagtgaacacattgtagagaatatgtgtagactccaaaaaattgagtggcagtaaacataatatgaaccaaccagggatttgttaaagtccacacttgcaggaaaaacagtttaaattgtttataataatgaagaacattcaaatactgaatgatgtcatcatccatctggaaaaagtaaggaaagaaccatgaactgaatgaagaggaggaaaggaaaatagccaagagcagacattgatgaaataaatatacagacactacagtgagaccccaagctctttgaagacgctttaaaacatctcaaagtattaacaattatttagaaaaacacacacttcttaaacactcttctcaaagaatgaaatttgctgcacctactttgagaagcaatctgcagtcccctgaagatgtgtgtagcatagcatccagtggtttatagtctagaccagaaaaaaaattgtatttgtattctcaggggatgaggaggtgcacacatgcctttgatggcagaagctagaaccctcgtcagcagtatgcacctatgtcaagcactgacgagtaacttggaggttatatgtatttatttagcatcacattacaggacagtagaaatgagcaagccaatacaaaatggacaactgtcaccaacagtgatattagagtgaaagcttcaagatacataaaaatctatgtattttccctttaatgtgcacttgaaagcatacgcaactatatctgcagtgagatatatagttagagagcacctacctcccaccattcccaagaggtaggagacagaaagagatacaacaggaaggggcaggcagatttcaatgacattttgtttgttccattaccaaaggtgttcattatagataggagtaaagtttataatttttagctacatagactgtattatttttattttctaactgagaatcaaatgtaattgtttcatttttcaagcaaaattcatttttgttttttgctcttcccagttcttcccaatgcccagtccttcccttgtgccctccagtgtgcccctggtcacgcctgtacactcttcttactctggtctccaccttcccacctttatgtcaccttctatatgtaatttacaaaagcttttggcatatggtgtaatttcttaaaatattattgataagtaaatgttagaaacaataatttattgaggttagagagatgactgggcagttaagagcactgactgtttttccagaggacctaagtttgattctcagcatccacatggtggctcacaactctctttaactccatttccagacatctgatgccctcttctgttctccttgggtaccaggcatgcatgagatgcttagacattcatgcagacaaaacactcatacacataaaataaaatgataatttttaaaagcaataacaattgatcaaaaactcaaataagacaataaatcatggctttgaaatatgcaactgataataccaactcaagaagagatatgaaatggatgtaatttttaaaaaaatcaatagttgaaaattcttctgggaaggataatgcaaatctaaaccaatgaaacattcaaaattatttttaatatctgtagttataaaatgcacaaatattccccagtttgtctaataagtctcagatgtcttcctctgacctcctatgacaaaacaaaaacaaaaacaacaaaccaaaacaccaagaggaagttccaggcaaatgccacttcaagttaagaatgaattttagcactacatattcacacacgtcatggcaaaaacagtagaaagatgtgaactggaatgaccactttcaaaatctgatcaggacatagtaaaatttctgtaagagtaaaaaacaagataatgactattttttaaactttgcatgttgcacagtctctcgcccagccatttagtcctcctggtgttctaagttgactgaaaggtagctggaacaaaagcaaaggtgtcactctgttttgataaagctcttcttccaaaaacagttgtcaggcttaattttacctaagaactgtagtttgtctgttcttaacacagagagaatgaatataagtgtatagctatactgcacccagtgatttcacatgtgggtatgttcccaagataagtatatccacagtacctctaacgaactttatgtaattatataaaatgattttcatagcagctgtctcctctctgcatgtgtctgggcacacatctgtgtgcatgtgtgtggtgcatgcttacctgtgtacgcatgtgtgtgtatgcatctgcttgcatgtgtgtgcacatgtgtgtggcatatgcttgagttgtgtgtgtgtgtgtgtgtgtgtatagtttgagttttgtgtgtgtgtgtgtgtgtgtctgtagcttgagttttgtgtgtgtgtctgtgtgtctgcgtgtttgcgtgggggaaaggcagctgcatattcaatatgtgcttgcaaaagccaaaggttgataatggaggccttattcaaccactctctaccttatcttttcactattcttagtaggtgataacttgaaatgactgtaagtgctcggcagtagaatgactaaagaaatagaggaatgcttatacagtatagtattgtattccttgagaacggaggtaggtaaattctcccccacacacaaaaatgtgaggatgaagaaaataggcaaaaagaaatgtgtgtttctgatttcatggatgaaaaactccaaaagtgggtaaactattgcatgcaagtgccagctaggctttaagttacttctgtgactagaggacctggggtccaccatgctgcagcttctgaggtgctgtttgtcatgctggctgcacaagagtgtttgctttatggaaggacaccaagatgtttgcttttgatttataacacgcatgtataatagcaaatgaaacttaagaagggaaaagattaatagatggagacaaagttaggttcaatgaggaaatacaagggctgtctaacactggaaaaatatgttaatgtaattaccacattaatcaatccaaatagaagaatcaagctgaatagatgagcagaatcacttgctaaaattaaaaacccattgatagtaaactaaaaaggatttcataaatcttagaaaagaactttcttaatctgataaggaacatatttaaaaatcaaatgaagcaccatgagaatgatggagtatgaaaacactgtaccaaatgtcaaagaaaaatgaggaggaagcaaccatcctgcctcttgcatgataccgaagatgtcaggcacactcaagaatttttctaaggaaaattgttagatgggaagcaaaacaatacgccaatcacctgtggcatggttgtctatagcgaaaaatgttatgagtgaatactttacaatttgtagtatcttatgggtagtaaaaggctatgttggcttcactaaaaaattgaatcagtgatatgtcattttcagctctatggagcaattgttaattttaatttaaaattatcagaacagctattaccattttcccgtgatttatactatttatgtgtatgggtgtttgtatatatgcaatcatatgtgtgtacaagtacccacagagaccaaaagagggtgttggatagcctgaaactcgagttacatcaggctgtaattcttacacttatattgaaaaagcaaatctatttatttgcattcaaatttgaaagcctaaactggtgtctaaggtttttctaggtatatcaattactcatgttaaacttgtttttagaacttggctgcattgccaagggcatgatgatacccacataacaaaactaaaagctaaactactttgcatgtagttattaaaataacacatggaaatgatgtggatgccttttgataattgccagaaaaattgtcaatcttttgtctcgtaattctcttgctatggaatgcaaattgtaagtacagggaatggaaaataaggagagaaagtttaggtttggcttgtctggaccttgctgccctttcaagtaacctggctgaagacctggagtaggaattgctgatggaactatactgcagttcagaaaacactgctgagaggccagcctgcccagtaactgttatgggcctcacacagacttatcaatccaagtaggatgatcagagcaaagaaaatatagtatgtgtctatttcctggattctcttttctattaggttttctagatctgacctttgcatctccaaataggttcccctagtgaagaagtatagacacacagacaggtagaccactagactgataagcccaggatcctctgaaaggttcagcactctaatatggtgggtctaatccttctttatttagctgtgatcctttaatgcagatccttattttgtggtgactaacaaccacacaattatttcattgctactccataactataaatttgctactgttatgaatattaatgtaaatatctgatatgtacaatatctgatatgtgacccccaaacaggttgagaattgccattctaagagatcaacaagagtggaaccacttacactaagaaaacaaagaaaagttttaggaaggcatggtgctaaattaatgctaattctgttctgttaggcagagaagtaatttttgctttataaattttggaaatcacaaaggattgcgagcagagaaaaagtattatttcatatatcaataattcctccatctatgtaagcatctaaccatctatccatccagttattcattcaactacacacccactatctatccattcacctatttatgcatccctctatccatctctccctccctccatctatccattcttctattgaaccctccatccatgtatccatctattcattcacatttgacttcccattatgtgccaactgtgattttatacactgaaggaaaaaaaatagaaagaagtacacaaagttcttgcttttgtgtatcgcattttttcaggctaatccataactgactaatcacataaacacatgaacaggatactttctgcaaatgacaaaaggcaaacaaataaagtagtctactgtgataggaacatggtcaataaggggaagaaggtttctagttagctcatgaaatatctctctgattgcacatcaccacatcctggagctcacagagcatgatttcacaaatgacaggtggcacatcctttcctgggtgccggctcacctaccatctttctaaccctgtgctcccagagctccaacttcattattccttataattaaggcttccctgtgcatcatcataacatttgcactgagaaaacttgtttccctaattttctcaaggatcaataaaaacaaattaaaatagaggattagaggtgtcttcttgccacattatttttctgagaacaaaagatgcagtgatatcattgttatttctccagaggttcctaaccacgatataaagccatttagcacagtttcagatcttcataactcaatgcttctttccccttgctccagggaaccagagggagaagaaaatgtcggtaggcaaaaggatgggataaatgagaaaagcccctgcctccacattaaaagacattaagagatacatcctttgattgtccatttcttgaaagtaaggggagggctgggcagtatgactggggtatgcagctcctcatcaaatggagaagatgacaagggggtgaaatgagcttgccaaaatccaagtgctgcatttgagaatgtgctgagtatttgggggaatacagaggggtgtggtggtatgttctatgttccagcttccagtaaattgaaagagttaaatccatcaggaaagatgggaaatattcctctcaaaacctctatggaacagccaaaggaccaaggatacatgcagtaaaaaggcaacatttttaacagtgttgtggaaattgtgtattttagcatgggagacctagtccggtgttgtgattagtagcatgggacttagatcatgaccaccaagttcatatcctgtgtaccgctctgggcttttgtttgctcatctgtgatattaaaagctcagtacttaccttatgagatgtgatgaggatgaaaaaagattatggatatataggacttaaagaagaagagaatggatgtattgcagatgatgaaatggtgaatttctttacctaaaccgagcactcctcagatccttcatcactctccccttttcatggatgagtaaactcagtcctgccatcattaaaagcattatgtgtgtgtgtgtgtacatacacatacgtacatatacatatataattataatatataatatataataatatatattatagcacttaaatgtctgctgtgctggttcccagctgtatgacatagtcactgtgcttctgaaactttgacgattttacctgtaaaatagaacattgtggcttgtagttctagtaagttaatatgcggtgaacacagtgcttagctgtgtacctgacatatactacttaaaactttgagcaacatggacaggtgtttgcaaattatggctgatgctttttatggttatgatgtaaggtggaatcaagttaatgactgaactgggagataaatctagtgaaacagaatatcaagtagataaaaaatattcaaagatattgaagatctgaaaagtataattattaaactcaatcatagtaagatgctaagcagttagtgttgagtaattttgatagatggaaatctaaacccaaacaacagatattatctgaacacacacaggactgtcacacaaataaaatgtgcattaacctatgtaaaagaaaattaaatttaaaaaaccttgtcagaaagaccatgttccccaataaataatacaatagtacaataaattggaaattaataaccaaagatactttataagatctcgtgattttgacaactaaatcacacactgctaaattatattcagatgaaagggaaaccatcaagaaatcatggagtgaatagtgatggtgggtcagagaatgtctatacttgtatagagtatatcagagaatgtatatacttgtacagagccaaagccatacatacaagggaatagagttttaaagtaagctgctaggtaacagaggtttagaggcagtatataaatagcaaatggaatgagcaaataaatggaaagcaaaaacaaaaacaaaaccacaagagatgttacacatcaccagccactcagctacagcaacagtaaagcacaaccctgtgcccatccgaatggctcacagaaaagtagtgatgacatcaaatgctaatgaggacatggagaacctggacgcctcatgtactgcttggtggcagatgtcattgtcttaggatttctattgctgtgaagaaacaccatgaatacaggcaactcttataaagaaaaacaattaagtggagctggcttacagttcagaggtctggtccattatcatcatggcagaaaacatggcactgtacaggcagacatggtgctggagaaggagctgagagttctacattttgaaccacaggcaacagggagacaatgagcccctgagcctgggctggagcttttgagacctcaaaggctgccctctagtgatgcacttccttcaacaaagccacatctgctccaacaagacttcctaatcgtgacactccctatggaccaagtattcaaatacaactgtctacagcagtcatttctattcaaaagaccacaggcatgtaaagtctctagaggcctctctggaatctagggtatttttttattttagtttttgaatttttaattacaattgtgtgagtatgtgtgtgtatttgtgtgtgtgtatgtgtgtgtgtgtctgtgtgtgtctctgtgtgtctgtatgtatacccaagtgtatacccattgcaagtgcacgtggaggtcaagggacaacttgtaggagtcacttctcaccttccacagtgtaggttctggcagccaaactgagatgatcacagttggcagcaagtgtccttacccactgagccctctggccagctgtagtctgtttattttatgaggtaaaaaaacaaaaaacaaaaaaaaaacttgtttctcaatccagtgcctgtctgttgcagtaaatctcctcccaaatatgctctggcaatgaaaacacaacacagacaatatgagtatatgctgtgagcctagattgggcagatctaccactacactaccatcttccacagcttatgagacctcttagtacttgcggtttctccaggccatgtgtttctgctctgcttttctttgtcttcctcctcctctgtaccctctccctcttccattttctccttctctctctcactttccactccaccttcccttttatctgcccaatcatcagctctcctttattttacaaattaaggtaggaagcagttagttttacaggaaattacctgagtgctgactcattcctagttcacagccactcacaggagaatggaattaacatcaaatataattagcctcaaggctatccacaacacctgtcctcctggacattcactgtacaaacatgaaacatcttgttcacatagaagctagtatgtgaggacccatagtaacgttatctatagataaccccaaattagaaattatccaaatgcctttcactggctatataactgaactataacacctgtgagacagtggcatcatggagtagtactaagcaataaaaaggatcaaactgttggtatatgtgacagcttggacgagtctctagggaatagtgatttttccaagacaagatattacatgttcgttcacttctgtaattttcttcaaatcatacggatataaaggtgatagattagtggctgtgaggggtttcaatctgggaggaaggaaagcagggggggggaggaatgacttcaatcaggtagtataaataccttagtcagtttctgctacttcccacaattggagatactgcaggtggtcagggctcattctttgctccaaggaagcatcttatcactgaattctccagagctgtggttctcaaccttcccagtgctgagaccctttaatactgtttcttgtgttatggtgactcccaaccataaatttatttttgttgctatttcataactgtgattttgctaccactatgaatcataatgcaaatatttttggagctagaggtatgcccaagaggttacaacccacaggttgagaaacactgctctagagggaataagttctggttctccccatgactggctgggctgagctcaccttgagatgctttgtaagacactacccatccacatggctctacccaatcacctttgaaagggatacctcttcctaatgcacttggagctttgcagccaccccaaacattcgagacatagtaataaaggagtctattggcgatgtgcttctgtctcttgattgtagtgctcatcacaggatactgcacaggttaaaattacataaaactaaacacgagtatgttcaaggatgtagaggtgaggtccgaattaaccctgtggcttgagatagtgataatttcctgtgtgcactttacaacacatattaacagtcgaagaggctggattacaattctcagggaattcttgtgtgtttctttgccacctcttatgaatccgtaatcatttttaaatgctaaaaatgagcaaagcattcatctccagaatatcagaaaaagtccaaatgagcaaggaaaatgctaactgaatagaagagaattttaaaaatatgtatataatttagttctttgaaaagaatgctaaaaaaaataaagccagttgatgaaagaaaaacacggtaaacacaaatatttttaaagtaagaatataatgaatcctgagctgttgaactaagaactttcaatgcatataattatagaaaaacttggaatgacaaacccaacataaggacaaagagaaccattcagtggatcaataggattaaagaaattaaaatgatacccaagcagttcgcaaaaacactagaccctgaatgtaaagtcacaagatcaagccagtcaagtttcagtgtggatggggacacagcccccagttcctacatctatcaaagagctattgtcagaggatggatgctgaggaatggaaagtcattctttttgggggatctggctactgccagctaggttgttcaagtcccagtggatagccacaaatccatgtgctcattgatagcactaatgacaacaagacagagaacaaggtttagggaggtgtaagtgaggacaccttgaaaccagtgaactggaccaaactggatcaaacttccaaggcatgcactgagcaggaatcagacagagaggagagcatactggacgaaaaccaagtggattttacatgacagtcagcagggtggagggctttgagttgatgctggcttctctgttgatgagggaacattaagggagaaagctcctggtaaacagaaaacccacctttggccttctgtttacctagccagagtctctatatttaggactttgtcaccagaactgccttttgagaggccactttggacctaaagagaggcagtttaggttggaagcaccagaagttgaaggcaggtagtgatggatgtatgtgaccaaatacatttcataaaatatgaaaatttaaaacataaataaaagctatcataaaaataacagccacatagaccctgtctcaaaacaaaacaaaacacaattattaaaaagtgagtaaatgaacaatatcaaaaatcccactgagctcatgtgagtggtgagtagtcagttctaatacattatcggaagaggtttgacttttattgtaatgctatttttttctagaaaatgaaacaaaggcaatttagttccttttatgaaattgctggaatcttaattcaaaaattagataaaaatacaagataagaaagtgcaggcacattttatgtgtggatatacagagcatgtatctgaaaccaaatataggcaatgggctcgaccctgtttacaagaatattaatcatacacattggaagcttatctcagttctccgtgtatttcaataatagcataattcatttccttaatataaatgatataaatcatttggctatttatgtaagacaaatgtttaataaaatattgtcaccagtcgattgttttattttaggaaagagaaggaaagtttttaatttccatacttacgaagcagaactttacagcaaacatgatatttggtatagaacatttaggcagttaggggcaatcagaccactatgagttcaaggccggactactctacataaagaataccaagacaaagaagatttcatagtgagatcctgtggtgatttaaatgagattgtccctgtaggctcgcatatttccaggcttagtcccagtaaatgaactgcatagaaggattaggaggtatggccttttaagaggaagtatgtcactgggagtgggcgttgagatttctaaagcccattatcagtcccagtaatttaatttggagctactgctctggcatcaaatctatgtgccactgtgcttcctgtcatgatggtagtggactagccctcggaaactgtaagctagccaccaataagctcctttgtgagttgtcttggtcatggtatctcagcagtaacacactaaaacagaccctgtctcaaaaatgaaccaaataaataaataaatgaatagaaaagtaaacttatcggcatatagagaaaggtaaaggtaacaatacttagagctcagattgacaaaagatttgaaaaattggacagtgccactgatgaccacggatgttgctgcatcctcacacaactgggggtttgagggtattcgacagcactttgtccagttcagtttaatcatcagacaatactttttttctcctaggacaataaacactggaaagagacttatgcagattcacatagggatatagtgtagatggcccctgtaccatggtttatggtagtcataactagagggcagatccttcagtggagagtagaccgacccagcaggaggaggtaagtcttgaaatcctatgcagtggttggaagtggttgactaagggcacacaggggcatagatgtatgccaaagggatagtgcggaacagcaaatcgagaaaggagcttgggtatcttccagtttgtgtgtttaaaatgcatgcatactaatccattgcatgcattgcttcctaaaaattcattcaaatgagagaacatatgtggaaatgccatttctgtagaggaaaagcaacggaggtggagatagagctaaaggtacagaaatagacagaacggtgtttggggattgtacgggctctgttgaagttataagtagttactacacatacgtctatttttatggtcagaaattcaaaatagttccttggggctattccttttgctgactttaggtgagaatcagtttccttgcctttttttcaaggaggctgcctatggttttcttggtgctgctttctgtcttcaatgccagtagcaaggcagttcctctcttctcgactcttttctgatttttaaggaccttttgaagtaatgagaccaactacctgttccggggtaaccttccacttcaaattgctctacctaatcacatatttttttcaccatggaaggtagcaggttccagatgacacaaaaagtactatttacttctgatcacaggagacttggcatcaaggcaaaggatattagtatctgtgagtgtatgtggtctgcacaggcacttgagtggtgggggcattagtgactaacctggccagtttgtctgttggctcaactagttcagtttggcattcagaaggcaagaataacttcccaagctgtgtctctctgtcccagagaagcataacaccctagtccacataggcacgagatgccactgtcttgcatctcctgattgcagcagaaacttctgaactttcagacacctgatgcaaaaccagactgtccttccaatcctggactgtatggtgtgcttcctagccctgtaattgcagcatagacatgtattgatctgggtggtctgagcgatcattcagcaaatgttgactcatactgctttgtcattacatcctgtctggataacagccgactcctgttgggtttgcccacgtgatgtgccttgcctgctacagtcagtattcacaggcatgaagaagctttagaaacctgtgcacaggttgacttaattctggcaaatcaatcaaagaaagaacagggcctggggtatgctattccttcagcccaggatccagcatgaatagagcaaaactgaaaacagttcaaagcctcaaaccaagctgagcccagtatgcacaattcaaggatatgtaagaaacttacaaaatgaattcctgctcgtaaagcaacagcttactacagatcatgacagtgtgtcaataccataccaatatgcatatctgatttcattcaaacatcacaggaaccatgggatataggtacaggtgaatctatgtaggtttgatgggaaggagagaggaggggtaagaatggtcagcatctgagaaaggccttgtgcaaatagaggtccaatagatagcagggagagcagggtcatagaggactttcaacttggccttgattatctaagtctccactctcccataaccaacacaactcttataaagaaagcatttaatgaggggcttgctaacagtttcagaagcttagtccactattactatggcagaaagcatggcagcaggcagacaggcaggcatggcgctgagagctttacttcctgatctacaggcagtcaggcctagagagacactggacctgctgtgagcttttaaaacctcaaagccacttctcctccaacaaggctgtacctacttcagcaaagccgtgcctcttagtccttcccaaaaagttccactaactgcaaaccaaacatttaaatatatgagcctatggggccattctcatttaaaccaccactgtggtcatctttgaaattctgatagaaaaggagttcttgtttggtggcttacataaaggtctatgataaggccacgccactatatcaggctctataaatggagcttcagccaggaaacacagtatgtgcactttatctcatctccactgaaagatagaaaagcaggccaggaagtgatttataaatgaacaagaaggcattaggagggctaatgtgtccagctaatggagctactatggctctgactttccccacgtcctccctggcttctcttttggggtttggtgaagtcactggcacaaattgtttccttcatccagttcattttcactgtctttggctaggtaggtcccaagtgagacaggacagaaaatcgggtctctttaactgacagtagtttttatttgaaaatgttccttcagtttaatgatactcttgtacatttcacagaataaagctttggacatcataaaaaaaaaaaaaaaaagcttggtaggcatttctggggctgctgacacagcagggctcgtcaaggtccagcagtcctgagcagtgtctatagattaatgcaattcctcgtgagatcaagagtgtgtcctcgggtggaggagttctcagttgtgagctgtcagagctttgaaaaaccctagatctgaatataaaagccagactctctaactgaaaggaaaagtagcatttggagagggaccatcaaagtccaattaggagccagggcgctgcttgttgtccatagtctagacttgatttgatctacaacagggcttcttcaatagtgacaccaatagctagactgaagactctttcccaattccactgctggcattattcacagccaggagaattgaaatgttcggaatgtttaacaactcacctggaagcagcatgagttggcttttgaccatcaagagtgtttgtctcatttctctccagccttcctcctccttttctttctttcttttcttttccttttttcttttttttaacaacagacaaggagactgtccatggattatggtgaattgaaagaaaacctggaagatgttaaggcttggcttctcttcgcccaccctcctcaaatctccttttctttctctagaatctgaaaccatgtaatttagaaattgcttctctctttccaacccgattttctctgccataaagtaatttttaaacattctaaagcttttattctcagacttaagccttgtacctgtgtccaatgaatgtttcccagtatctgagcccttgaagagctgaggtgttgagagacatggctggctgaccaccttgtgccagcaatagcacaggtagaaaggagaggggagttggggatctgaaacagagctggtaaatgcagtgaattgtacttccagatttgtagatatggagaactcagtctccaggagatactgacatgggaaatgaagaccatggagcatttagctggttcagagagtataaagttagtcatgatgcttgttcctagctagtaatcttaattatcatggttctcagggtatgtgatgaggccaccaagaacctctaggatctctgaaagactcctgaaaactagaagctgtttctaaatgtagaaaatgcaacatcaaacagaaaccatgtaacctgtgaacctaaggtagtctttattttggtcactagactgtgtagcctgcatgcattgtcctaataccttatctttgcaaagccaggctctgggccatgtctctgatgaaatgcaaatattggataacaaattaacttggagctggcaacagatcgggcagtgtctgctttgaacccatagttgagaagctgtgtgatgctgtacacaaagatgcatgtgttcattagagagtggtgatggtaacaagtaaaagaattcattttccttttgatatgtgtgcgggttagttttatgttaacttgacaggagataaagtcatctgagaagagggaaccacaattaagaaactccttttattagacagggctgtaggcaagcctgtagggtatttttttaaattagtcattaatgagggaggaccaagtcccttacaggtgctgccatccatggggttgtggttctaggtactataccaaagcaggctgagacagccatgaggaacaaaccagtaagcagcacccctccttggtctctgcatcagctttggcccccaatgtcctgcccattttgggttcctgccctgacttccttcaatgatgaactataaagtggaaatttaagccaaataaaccccttcctctccaagttgctttggtcatggtatttcatcacaacaatagaaaccctgactaagaaaacgtgtctgtatcattttctcaaatctctcttaggatgccagggtgcaggtacttactagtttacatggactggctaaagaatgaagccactgagtttttcctcagcttaggaagtacaaaattaaattaccaaaacatcatgggcaccatgcactgggcaagtttgggaagttgtggataattgtatatgaagagtggtctttaaaacagaaacagtaaaaagaggcaattagacaaatgacgccactgtggggagcagtgattgcaaaagccagcaagaaagagaaggggctaaaattgtgaaatcctaacagatggaaacaaagagtatttttctggccagtgctgccataaagcttgctcctttccccatttttaattgaaaaatattttttgtgtgtgaagctggctctttaactattggggaaactgcaaactagacaaaatattgtaacaaaagctcctccagataacgaactggtgggggcatgcactcaggggaattacaaggaagcatcttccgtctcaggccctggcctccctctcatgccacctgttggcaaaagtagccttgaactctatggttaggcagatacgatttttgcagcctcactcctggcagtgtaaagtggggtatcaaaaggttgtttggagtctggcatggtagcacacacttggaatctcagaagtcttgacttcaaggtatcctcaactacatagcaagttcatggccagcctggaatatctgagacactgtctcaataaaacacataaacacataaaaccgaaacaagatagtacttagaaataaaacacgatgctttagtagctgcttcagagcccacaggctacagtcctcagccacctcttgagaatggttgtatctgactctgggttccccatcctggaccttatgggatagaaatggaccagtcatgattaaatcctttcatacatcccaatcaaattcagtcgtagcatggggtcatggattgggaccagagttcctgaccattaaaccaaggtccgagttgaatagaggctgagatagaagttgaacaatagaggtgagaagatcgacaactctttgtcaacacgccatctgtatatagccaccctctgtaactagtacaccttgcttggtgttatatacagcaggcctctaagtaggtttcttaaaagccatcactattttgttataacagaatgcatgatagttcctttagcatgtaatttggtcaggtcctatgtttggttgccaccatggttatctgtgtgtgccttgccaagttttaatctgaaagatggcagagaacctgtcacatgttctaaaggctgtgtccccaacaccctacctgccaccctgttgtggcatacatattttaatctgaatcccagagagaagtaaaacttttaagcaaatgtagagaaaagagtaaagagaacctgaaatcaaagtaaaattatgggcctttgtgcagcacagagcccctgcttggttgtctctatagtgctcattatcaagtgctatgctacccatttgtctgattcagtatttaatcctcttgcctttgatgggccactgtctctgtaagaacagagggggtatttggtctgctcttacatctagtatagcgctggacataaggtcagagcttaaaatatttacttaatgcatcctcatagtggtttttcttggagcaaagacgactgtcacttcactgttataactatcttgactgtcactatcattccttgtcagggatggtaggaggagccaaggcatgcccacttggtagcacaccactgcacaggggccatctgtttggtaggaggtataaatgactactccacttccctgcccttacctcagcatctcaatggtcactgtcccacttgttgtccttccttggacattaaacacagtatttcatgtacttaggctttaattttttttttacctccaacttctctcagtcccacctccaacataccttcccatttacctgttagtgtgcagctatcctgtgcagaagggaccttcccacagaacagtgctcttggaattcggactccaggttaaactgttgctcatttattcccaaatctgtaagcatgtgtccactggaacatgataagtgttttataggtaagagaagcttaatccagaactgagagccaaccagtcaagaccaagaacattacactcagtatgacacaagtgtttattttaggtcaaggagtctaagccttaaagaaaaccctcaacaccacagaggcttctgacatgtattttgataattaactaccattttgccataatcaatatctgaaattcattgcactctggagcctattgactaacataataattattataaattgtgagactgaagttactcgaaatatgtaggctattcaagtgtttattttattagtattagagatagaacctagaactttatgcagtttaagcaagcactttaactgtgtcacgctttcagctcccaaatatcttttaaaacattaatcagacttacatggtgaaaaacaagatctctgccttgcaaacttaagccgaggcccctgctacgacccctgaacagtcttgggactgagtgacttgcagggctacttgtattgacccttatatggaacagttgaatgaaagtccacagccttgactgcctgagctagacaaggtgttatggaagcatgggtctacccattatacatgggttatctggccagctgccattataaacacatgtatgcacagacacagcatagaccaccagaccttcagagtctgaaatatttgctatctggtctcttacatacaaggaaaatgttttcccacttatgatcctatcccatctgcctcaaatgatcctttcatacaaaatggtaagcaaattgcactaaaggacagatttctgggccttcactgagccatatggaacagactgacctattttgcgcttgctagctaatacatgttcatataataaatgttcatctgtgaaagagaattgggatcaagacttgctctcattataacctaataatgcacttatgggggaatcattaacccgaactcacctcacagttccttggtggctttggtttctatgaaaaagaatgtcagggttgtgcggactcgtgttcaaattggctcaggtgagttcccgaagtgaagctattcatttctgctctatgttcccaggcggcgagtacaacccctgtagaagatacagtgggctttgctactctgtccttcatggctatcatggctgtaccctgctagtataaacttcattaagacaacaaactgtctcatttacctttatctctacagcctatctgctccctctcagagatctaagttatgttcatagaagttaaaacctatctaaagtaatatctgaagaggcatccttggaaaattgataatggcaacttattgttggttaaagcacaagcccagaagtcacctaaagtagatataaggttaagagctggatcgtggtaataatatagatattctttcagttttacttactgtgtgcccatctctcctcctcctcctctgggcttgggagttgcaactgtgtcaaacatacagtgaatacgctgaattcttgtttcattcatagcccttcaaaacaggatttctgttgctagtaagagacagcatgaccacagaaactcttgtaaagaagccttatttggggctagcttatagttcagaggcttaggccattactgtcatggtaggaagcatggtgccatgcaaacagacatggttttgaagaagaagctgagagttctatctctggatccacagacagcaggaagaaaataagacactagaccttgcttgagattctgagagctcaaagcccacccctacttcctccaacaaggccacacctcctaatagttgtactctctatgggccaagcattcacacacatgagtttatgggggccatttctatttaaaccaccacaacatctatcatccaagtagaagagtaaggtgccgacatagatagaagggaattgcttccgggtcaggtgtttactgagataatgccatgccatggtgccttcatgatcaatatatactgtttaattgaagagtctgatgaaattgcaaatgaattatctcccacaggacattgccacaagagggtagcaaacactctacctcctcagctaatgtgatccacttctgatggttacagttgttgcagcggctgtcatcataggatgtctgtgtggtcatggttgacaaattcctagccaccaaacatctgccacaataaaagttagtaaaggagtggatggtgctggaaagaagatggattttaattttggtccttctacctttctcccctccctgcttctctacgtatcatttccatgcagaaattgcaaattaatggtcacattgaagtatctgtcaacgtattactgctcttgcagagccaaattatgttggcaataatgtttgcagctgcctagaactccgttgcaatttaatttgaagagaactcaaattgcatctccaaatggatacaaaattaattttacatacaagctatccacctccacattttcagccccatgccccaaattatctcaatttaggttcaactttgaacagtacatgtgcaccagccaactccacatgcaatgatgaatatatggtcaattcatgaattgaaaatcagatttctgctcctttttttaataacatgttctgcttcaactaaggtcattgggagattctacagctattgcctttgacaaaagaaatagaggctgagtccataccaaaaacagaaaacaaaacaaaacaaaacaaaacaacaccaaaaaaaaaaaacccaaaacaggaagcaattctctctcaaccacatgattacccttaaaattggaacacaaagagacctctggtataccctgttgattactgcttatctccttattatattagggcttggttatgatcttgaaaacagacttcttaggctttttagatttaatctgtctatctgtctaacctatctattatctctatgttcaagttatcatgtgaccaaacattgagaaaatcttcctgcaattcaactagaagttgacaaaagtatccaggtgtgttcaacaaagaattcacaacagtcacagtaggctatggaagtccttgggaaaagtttccagaaagtgatggttttagagatggactttgaatatattgcttagggatgtcttatgctgtctctatgggcagcatcccaaacacagataatagcacagacaaaagtaggggatgtcaaaggactgtgcgggtggcaaatttcactctatgagtatggggtttgacgtgtgaatagtagaaatacaggcagagggatttgggataggaaggtctcagtagaggaaagaaaggctaagctgcctttttggagtggcaatagtttctttaaatgtaaaggacacacaattcatatgcaagcgcgcacacacacatgcacatgcatgcacacatacacatgtaagtgtcacggtagggtccctggggccaacttctggtacattgcaggttagccactttagttctccatgagagaatacctacttctaaaacaagccattctgtgtgttatagcttgttactcactcatggtcaagttgtaggaactgcacaggagtggcctggttggatacctcacaacgttctttttgtttttttgtttgttttttgcttgcacatgcactgtactatgtggtacactctgcactgtttatgttgctatgtcacagactggttatgaagcatattggttcacaccaaagactattgtatgttacaaattataattatttaactgtacatggctcttatataaacataatgacttaattacagaaaacaaagacagtacttttctcccatcattcctcagttagttcatattttgattgtatcgtgttgggacttccaaaacctaggatacccaagatataagatacaatttgctaaacacatgaaactcaagaaaaatgaagactgaagtgtggacactatgcccctccttagaagtgggaacaaaacacccatggaaggagttacagagacaaagtttggagctgagacgaaaggatggaccatgtagagactgccatatccagggatccaccccataatcagcttccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcactggaaagagaggcccattggacttgccaactttatatgccccagtacaggggaacaccagggccaaaaagggggagtgggtgggtaggggagtgggggtaggtgggtatgggggacttttggtatagcattggaaatgtaaatgagctaaacacctaataaaatatggaaaaaaaaaaaagaaggctatgcagccaatgatggttgtgtttgccacagtcagtcaggtacacagcagatccagcaatgagacctcacaacgttctatttgttagctttcttacttctcctcctagtttcctttctcttgctatcataaaacactgaccaaaagcaacttagagaggaaagtgttttcttggcttaaagtttcaggtcacaagtcaacattgagagaagtcagatcataaattcaaggtaggaacatggagacagaaaccatggagggtctctgtttgttggcctttaggctctttttgttttctattttttatttttaattattcactttacatcccactcacttccccccctcctggtcactccctcccataaccacccttcatccctcatccgcttctcctctgagagggtgcccctccctgtgtatccctccatcctggcacatcaagtctctgcagggctaggtgcatcctctcccacctaggccagaaatggcagcccagctagaagaacatatcccacagacaggcaacagcttttgggacagtccctgctccagtggtttgggacccacatgaagatccagttgcacatctgctacatgtatgtggggaagtctaggtcaagcctgcatatgatctttggttggtggttcagtctctgagagccccaagagtccaggttagttgactatgttggtcttcctgtagagtttctatccctgtctgggcctgtaatccttcctcctactcttccatcagagttcccaatccactgtttgactgtaggtatctgtatctatctgaatcagctgctaggtggagcctctcagaagacagcatgttcctgtctgcaagcataacagagtatcattagtagtgtcattaattggtgcttgaccatggtataggtctcaagttgggccccttatttgttggccattccctcagtctctgctccatctgctgtctttgcatttcttgtagacaggatacattttgagtcaaaagttttgtggtgggttggtgaaactgttgctccacttgggtttctgcctggctacaggaggtggccccttctggttctagatcccttacactcttatgcacagatctacctgactaagcacaatgctacccactgtggtctataccctcctacatccatcaagacagttccttatagacatagaaactccaacatgatcttggcaatatctcatttgagggtccctcatatgattcagggctgtgccaacttaacagctgaataaaaccagattttctcaatccaactctgtaatacctttgtgttgactttctccaggggttcaccataacagactgaagccctgggaatgcaatcctgttctaaacaagcttcttaggttatattctcattcttcccccccccctctctctcccctctcccctctcccctcctcctctctcctcctcctccttcctcctcctcctcctccttcttcttcctcttcctcctcctccttcttcttcctcttcctcctccttcttcctcctcctccttcctcctcctcctcctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgcacaaattgtatggagacctcagatctcaaattttaaatctctctgctctgttgctctgggtttttttttttcctttctgtgccattttttgccccagcagtgctcatgagaagggacaaagaaaagtaaggtctcacaggccctgtaatgagtttgtagctatagggacctgaaattctggggtacctgtgacctgaagcatggtcagaagggagataaggggacaggtgggtacagtgcactggctgctgagcctgtgtcctgggaaaaagtcagtctgacaagagccaatatgagtctcaggatagggcccattgctacactgaaaaggtgttaggatgagagatactttgatattccacgagaggataactttcagctgctcagacaaaccagcagctctgtactgtctgctgtcttcttggcctgtaggacgttactgaagaaggtcagatggacagggctttatctagaggcagagaccagaggctacaggcttggatgtatttacacgggggatataaattcaacaaaccaatctctactgcacacacaagactttctcagcaatttttctccttgtttgcaccaggccgaatgtaaacccaggactttgcccacagaaggcaattactgaagcagaatctcagtttggttggtgaggcttattgggggtaggggtggggtcatcccattgaaagcatgactgttcccctgacacattccggaaactaccgtctcataggtaggatgacaggacatctctgtggttggaaacaaaacaaaggggaaatatgtgcctctgagatcctgctgatgcgccggcatgaacggaggagggagggcagaaagaagtgaccagagatcagtttcctagaacaaatcaccatctggtcatcttttaggaagtctgcttgacagatctgagagatgctagacaaacagaaaacagtccctggcaatctgggagacaaatgtataaacaagcaattcctgggcagtgtgacaaaataagtatgatgggcagtggtgcatggagctatggctacactcctttcatggagccttagtgacatataccatagagctattcccaaaggcagatgctaagggcactacctagctcagagatcgagccaaatagtcacaatgactgctttccagaatgtgagctaccacagtcacaaggcactttcagtcatacggatcttacccagactgccactacaatcccaacttattgcatttgaactgagatttcctgagcctcttaatttctatagccccagggaacctccaagaaccatctcccaaggtctgtgtagtatatgaatatgttctgagtcccacttttcctggtctctatgatcctgtgagagttttatttgacaaaagtgtgaatgcatgcatgcatgcatgtctcagctttgtttggagttctgtcatagtatacttagttttgtgatctctgaagaccatgttgaaggtcaaggagtcacgtggggaaatatttgtggacagccccatcattttactatttaacgacttccttgcctttcctactttattcatccccatctcagaccttggtatttatcctcctgtggacatttagtagggatacaagtcctgtgagtgcagctcccattcttaaaacactcctgtatatatggctagcaatggctgaacttagcaagttccaaacaatacccagaaaaaaaaaggcatgaagtttggaaggggttatgtgtttgtgggacttgaggcatgttggagggtaaatgggactagatatgatattttattacatacatgtactgaattctaaagaataaagacacaaaaactgcttaaaggcttcttagggcatttctccaagaaaggcagttctgtataagaggaatccccactgttagggaaaggcaattttctctctttacagttcattttatgctcattaacagccctctgagattagtgcagtaatttccactttatagatgaggagatggaggcacagagatgaagtgcccttggccaaggtcacttagctactgagtgcctgagtctggctgcaagccatgttctaactcaatcatgcatgctttggagaaccaggggctttgcctgtgccccaatattcctacatgtagggaagctctttgctgggggacaggctttcagctactcttgtgcctgagaaaagagggaaggccttgggctaagtcttcttctgagagagacatgaaggtgctttacatgtattcctgcacaatgtagttgcaagaaacagggtgtggatggaagatttgccaacgttccatttagcattaagtctcatcattgtccctttagaggcagatgccaggctcccaagagcaaagcaatccctgtgttgtaatttttgttttcccataagattcttctaagtctcctgcaaattcctggtggctgtggtctgtctaatgtttatgctcctattctgacctcagcttccaatggtgtcatagtagagaaaaacagacatgggacttcctcagattgtgaatctcaagcctgcttctccctgtgtggcctgaggacaaccattttacctcatggaactttggttttctctagagaggggtctttagatgccttctcaggagttttgccatttaccaagcccagcaggcatcccttcaatggctgtgttccagacctctttttacctccttttcaagctagacatggagtcagaactatacaaattccaagccttagttggtcacttgctagacttgttactttatacaagttcctggacctctgtaaccctcgatttatccatttgtcaaatgaggcagtccctccctcccaatgtcacgctacaggatataaaacaagtacttcctggatactgttccattgatgatattatatttgtgcttttaggccatacttgacatctcaaaaattgtattcaacatggaatgttgtagtattcaagatgcttaatagaaatgcatcttcagccttaactgagtattaaatatctgagtactcacttcctaatgagaggaggagaggggcccatgagatgactatctccccggtagagtattggttttgaaaaagtacccaggaggagtgttagaaaggttctacttgggtatatataccaacagagttctctacagatagaaaaatcccttctggacaaaggctacaggggaggctaacatttggtagataggaagttctctccatcactatgcctgtacacctatatttactgcagcctgggtcacccagagacatctagctaagtaacagaagtcatgcctggtcacagtctctaactctgagttacacacatgtttatatttcattgtacataggttcagcatagcaggcaactcatccaatgtcacttttacaaagtcactcttgcttttgagattcgactttcttttgcacaaaggaccctgcaccatgaataatggagctttaagaatgagtgtcagttcctcagttgaaaagaggccagagctactgatgtgcattgtttggggatggatcatcctcctctctgaaatgcttatgaagtgtgtgtgtgtgtgtgtgtgtgtgtggtgtgtgtgtgtgtgttccttggcaaagctctgttataaatctacacttcccacatcgaggtcaattaggaaactcagctggcatcaaaagccctcacccatagccatccttgttggtgcgttccttggtccaggggcaactgtactctaacagctctgggaattcaaagcctggaaaggcgacagtattctagtccgtcatagtgtatggtgattctatctagaactgccatttataagacatttgggttgtgtatagcatctgaaggatgattatacttattactcttcctattgctataaaacaaataaacccttagctattacatataatgtgcttattaagttccaggtgcaactctaatggctcaggataattcatccggctttaccctctcctgcagttgggttagctgctgttatcacttaatttacaaatgaagtaaaaagtagactcaaagccatggcatagcttgatggcatcctgtaagtagcatggggttaaatgtcagtcaggtctctagcatcactatcttgttcgttttaatcggttttgtacaaaagtcatctctttacctcccgcaaggtataaacatcgatgcacagattatgaaggaaggcatggctgttgctacatatgggggactgggacaaagattggaaagtaaaggaggttggggacagtgttgcggtactgaggagtggaagatggtgttcatggaggatgaggaggggacgggacaaagagtgaactactgcaggatgctagcagatgatatgatgtcctatcataagtgaaagtgcggagctgaatccaaaggccgagttcatggggtattgtgatcatacagatggactggaggctggatgtctgtttaggatgtaaccacagttccaggttgtgctgctggacaaaggaggggaaattcaactcaattccatggagaaaggatacagctgagttaagcatagaaggcaggacacaactccagcagcccatcttagaagcgtgtgcagctggtagctcccaagatagtcctcattggaactctcatgaagccctaagaaaccagaaattttatctgtctgtctgtctttctgtctacgtatgtatgtatgtatgtatgtatgtatgtatgtatgtatctatctatctatctatctatctatctatctatctatctatctatctattttcaagacaggcttctttgtgtggctctgactgttctggaactatttctgtaggccaggctggcttcgaactcacagagatacatctacctctgcttcccaagttctgggattaaaggtgcaccaccaccattcagctaagaattttatatttttatgactgacatatttgatcatgaaggaaataggacaaattttcaccctatgtattttgttttgtcttagacctgtgtgcttcaataggaaaaaactgatttaaagaaaaccttcctgttaattatgctgcaggtggtgagagccctgggagagccctgggagagcacagggaggttgagttgtgtgtggaagagcaacagtatccatctgcttcctgcagtctcctcaaaactcttttatcctgtgtgtattttacagatcccgtgcatggcccacagaatgtggagattgtggacattcgggctcggcagctgaccctacagtgggaaccctttggctatgcagtgacccgctgccacagctacaacctcacagtgcagtaccagtacgtgttcaaccagcagcagtatgaagctgaagaggtgatccagacatcttcccactatacccttcggggtctacggcccttcatgaccatcagactgcggctgctactgtccaaccctgagggccggatggagagtgaggagttggtggtacaaactgaagaggatggtgagtgagggagaccagtttatgggaatggagaaggttaagtatgcctgtgggtcatgccagtaagtgaggactttggtttttgcccatctgcttgtgtgtgtgtgtgtgtgtgtgtgtgtatgtgtgtgtgtgtgtgtgtgtgtgtgtacatacatcacttgtttatgcccatgtgtgtgcattcacatggagaccagacatcagtgttctaagtctcttctccatttttttccaactgacttttggggacatggtctctctttaggatttgggactcaagttatccatcttcaaagaccttcttaccatggcattcactgcactagggatgcaggaatgctctgccatacctggtttctatttgatgccagggatctgaacacaggtccccagtcttacagtggaagcactttactgatcaattcaactccttatctcctgtactttgtctttggtctctccactattctcaaggtctccacaaagggaccctgcagactgtgcatactatagctccagagtaaggttatatttccatgaagagtgacagctcagtcataaatatgtgctcatggtgaccccatgtctcccccattctctccttgtgttctatcactcattctacccaagtcttaactcttcagatgcctcttgaaaagggtcttattgtttaaacatgtcgagattgaaaatcagacaacttaattctgcacaaattaaaagaagaaaacacagaatagcttaaggcttagtgtacacactgaatgagctcaaagcagattatccacctggatgtcccacaggcatctcaaataccatgtattgtaaaatgaatgaatgtcctcatctatgctaacttattttcctgtgtgcctcttttcaatgagttacacctgggagctcaagagaaagagtagaaaatcaacctagggatttctcccaaaccaccccatctccccgcaacacttctacttccgccatcccaccccacctccccctgcatcatcccacattcccccataccactttacttccccctatttccaccatctatccccactccaccccacctcccccctactccaccccacctccaatcctacaaggatctacagtgtctgcttcttgcactgcatctttggacttgtctcctatcttgaagatgctgggatgcagagactttagtgatagcacacataactacatcttgacaatactattccttctttagtctgaggtctcccttcatgtgtgcaggacagactcttctgttgctattccaaggcttctcttaaattttgcttcctctgtaagttttctttgcctcaaacttcttggctgcttctttccagggttctagtacaatctgcatgcagctccacacagtagctatcttgtatgggatagaatttgtggtgtctaagacatacctaaaaaacccttgtctctgtgtattttagccttctccttggcctggctgtttatggctctacaatctgactcaatgtagatttgtgtacaagtaattaaggagagtttgagtaggggatggcaaagaggccaacaaagtggcgaaagccatgttacaagttctgggcagttgcatggagagttctctagggtgagttatgtgtcagatgtttcaagccatgggaggaagtgtatcttcacttatgtttcaagccatgggaggaagtgtatcttcacttatgtttcaagccatgggaggaagtgtatcttcacttatgtttcaagccatgggaggaagtgtatcttcacttatgtttcaagccatgggaggaagtgtatcttcacttatgtttcaagccatgggaggaagtgtatcttcacttatgtctggtttcattgcttcagaaacaaagagcccatacctccagcagatagaaaagtgcaattgagaaggttgactctctgggccagtatgcctgggacctcttctttaatctcttgaaattgattttttcacctaatggatttgattaaagaggatgctagattttttaaaaagtggcctaaacccagcaataaattttcaataagcatagctactacattttcaagaaataagaggaaaaaagaagccatgacaggagagcctctggaacaaacaactatgccaccaagatgctgtgggactcgtctccaggctctccattagtgttgcacggattcagaaagtatattgagggtcctaaagaattagcagtgtacctgggtcctgactggagaagcagggtggtagtagggagtggttagtggttaccatcaccaggctaaccctagtgctgacagggaggagcctttgttgaccaatcatcctgatctagccaaggagcaactcagagggaaccttcccaagtgttcgctcagcccctttgagctgcactgtgagaatggcctccatccacagcaagtcccaagtttcagctttaagctatgtcttctcctctctctttctcatttttaccaccaagaggaaaataaataaaccacaaagcctttatcaaaacaatgtgggaacagcagtgctttgaaattaaatttagagtaaacatcattaataaaacatcaattcctgctccaggagatgtgtggacattatcatattaaagacaccagcatgcaagacacccttcctgggtctgtagctcttctgaggccacagctcagaaactgctgcaaggtttcagtgggtgtgtggatagtctttggcagtttgcatttgtttctgagttttggtacattgccttaagatgttgctaaagttggtcttaaactcctggttgaaacaccagcatcagactcttgagtagtttggactaaggcatgcatcaagagttctatagacaatccctgaaggtcaggggcaggttcccttctacctagagggaaaaagcattgactctttctcttagaaactcattcaccttgagaggacattgaggttggagttggggctctggtgcatagctgaaactcccttctgagagccagagagcagcttccaaggttgggataactgacttcactttcacctgccctcaaaacttggatgttgggggagttttcagggtcagtcattttagcaccccaatacttatgagggtctgcagaatcattgtttactagaaagaaaagttctgagacactttgttctgtcaggaaaatggctgttggtttaaaaaaattaaatgaacttttaactttctgtcttttacaaatatctcagatctttacagcatcacttttagccaaactacagctaagcttgtggaaatgtaacataagaagtctaaggaggtgcaaagcacatgacatgaaattgggacagggtggagaggtggagtagtgggtctgggaggagttaggggaggagagggaatgatcatatcaaaatacattatatgcttatataaaattcttgaagaattaataaaaatatctcttcaatgtgcatagctgaagagtaaagatattttaatatatatggacaatattatctagcatctagaaaagttaacatttccttaaaatgactcaacatgtgtcatcaataagatatagtgggtaaaggcattgccacccagcttcacaccccaaggtttgattcctaagatccacaaagtaggagaggagagacccggaaaagtgctcctctgacctctactgtcatgccatggtgtatacatacacatgcacaggtacacacaggcgctcacacccacacatgtgcatgtgtatttatctgatatacttgtgtaaacaaaataagtaaataatgtaattaaaaatagccccaaacactgttcatttcacagcttttctaacaataaactctgctttatatgataaaaaacaaaatggaagacatttttgcactaaagcattaaaagatagtactgtgtatttctcattgcatcttgctaagggtcattggagttctgggagcccctctgtggtgatgtcacatgtagttaattaacattgaaagcactgctatatattatatataaagcataaatatatatagcacatatatacatatgccagatataaacaaataaatctattcccctcttgatacatctcttttgtgatgctttgagatgatgtaagtaccctatgatcaccccaaatctttgctcaatgattttagcatgtcttcataatccttacctaaaatcaattgctatactggtgctttaaggtcttccattttgcctacagtttctgattaacatgtttcttcacagagaggcattttctcatcatcttttctgtgtctagaattctgactaattcacaatcaagttttgaaacagtgtactaagctacatcagtatccttattttctccagtgatcaagttgtctttgccatggctagaaagaatcccttaaagtggaagagactataagtaaataatagaatttaaaaatagacaaacacactgttcatttcttatttcacctatcactaaacttagctctgtatggtaaaaccaggacggaagacatttttttttccattaaaatattcgaaggtagtactgtgtacaacctttacactttcttatcacatcttaacaatgatcatgtaaggtctaggagcccattttgatatatcctcattagtcatccttgcttttttgcatggatgcaatgttccagactgtctgtaatgttcccattcaagacatgaaagtcatcacctgaaaattcctgcttgcttctacaagtagtagtctctgggtactaaggcaggtcttgggtatgttcaatggatcagtggtgactctagctgctccaggaagaaagagctagagaatttaattcacctgttttaaaacatgaacacattgtggttgaatcccaactcctctagatacttctgcccattctacacttgtattcaaacagtgaggaccctggagtctccacatccacttctttattcatctccactcccctgaattgtaccaacctacctacaaacagtgaacctaccaagttaggcagaatattttcatttccctgccctaagctctgtactgctgaggatgtacactctaaatactatgctctaacattcagagtttccacctatgttttcattttaaggtttttcttcccgccatgttttaaaaaataaatgttactactgcttccaacatgcaaattagttgcttcataaaaaagtcaaaattgtatgtttaaaaaggattcatcttcagaaacaactgtcacaatctttatccatttgtattcttcagtacagacctgaaagagtgacattttaaacatagaacagcacatttccttatttacttcctatttagtgctgtttgcacagtacatgtgtatgtttttaggcctgactactctgggggaagagtgattcatattctctctctctctctcccctccccctccctctctatctccagtcattcattgactatagctcctagagagggaccttatgagatttctccatcttgttggcatgttggttggtactgccattgtacaggttgttgagttgtcatggttgcatcttcttgtcatatatagaagacactatttcatctcaggtgtcctggtctgctggctcttacatactctctgtcctctgcaatgtgttttctgagctttaggcagagggacttactgtagacacagcagctgcgactagagagagggattgcctgtagatacatcagctgggactaggtaccccatgaccttgttttctggttttggaccaattatagcttcatcacccacaaaaataaacttcttctaagagggatgagagctaaatttacatttatcttttcaattatttttatttctattttatatagtttatttagtaacaaagtaaataatcttttcctctttctcctcctctccatccttctacttgctcctctcctccttcctccctttcctcctcccttagtcctctccacaacccctctgagcgcaaagccttccacatgccagaactcaaggtctcttttcctttctatatacttcatatttaaaatatggaaaaatgtgtactttgcccgtttttagttttatgttctgtcctagaaaacagtccatatcagaaattgccaattctgctaaatagtgtcctggtcttcatgtctgtgtggatagatgtgcctgtgtccagtggtgctgtttcagttattcactatgtcctactttttctcatctaggtcatcttgtgtccctccacttcaggtatcatatttgctggttgattggctggttgtcataaagaggcacactgtagtcacactgcagcaaacagcctgcttgttaggtgtctatggaaatgtatcttcaggtaaattcttcatggaaggattgctgaagtcaaagggtaaatgcacaatcaattaagttctcctttggagaaggcctgtcatttttcatttccacgggcaatgtgtactgatttaatcttcaaaccaaatattaaagaacaagcagtattttccctattgtataatgtggggatgtaattttaacaatacataaaaatgtaattgattataataagtaacagtataaaatatattaacaaaattgatatttaatatgcttaaccacatataataggtatataatcccaatgtggcaaaacaggtttaaactcaaatgctttcatgtaaggaaaagtaccatggctcagtgccttaattttgtgtacagttctaatgagcctaacttacctggttccttaggtaatagcaagccagaagggggatgtgtgttgctgaagataggaacatctacactaataagaggtagcacctaagtcctccaaggagggaaagtgtaattaggaaataacaacaaggcagatgtaatgcaatgcaaagtcagattataaggatgaaaaactacgtaccctaagaggtcctaacagcctcatttcccctcagcatgttgctccgtaggggttataaaggtgagcttgtagtattgtgagtgataggcagaaatgcagttatgttttccatatgcccacagtgagtcaggctttgtgctcacactcttatattgccaaacaccatgcaggtattgtttgccatggttgctctggtgaggaatccatacatttctaagtgttgcctacatggcttcccctgaccatgtgttatgaaagcctagagctggctgaagcccctctagtgtgcttctcagccttctctgtctcaacatcatacatcatttgttctttagcttattctctctctccctcctcctcctcctcttcctcctcctcttcttccttcttccttttcttctatcttcttttcttcttcttcttcttcttcttcttcttcttcttcttcttcttcttcttcttcttcttcttcttcttcttcttctcctcctcctccttcctcctcctcctcctcctcctctctctctctctctctctctctctctctctctctctctctctctctctctctnnnnnnnnnnnnnnnnnnnnctacagacctacagggttttgggatgtgaccccttgccagagtcgtcatgttgccgggattaaaattcctctacaaggatgttctggggaaggtattgatataggtcatcaaaagcaactccagactctgttaattgttcaaacatgggatataacaggggttgagtttccaaatttataaggagggcaactgctaaagtaccaatgtccttacctttaaaattattgaccaacaagcctgggttacccaatgctgggtaaaattttatttttcttaacatatttctcctttcttcttcctcctcctcctcctcctcctcctcctcctcctttctctctctctctctctctctctctctctctctctctctctctctctctctctctctctctctctctctctctctctctctctctctctctctaatagagacttcattttggtttagtccctaatggatattttctcataagaggaggaatgctggtctataatatgtgctcattggcttagggaggaagctaatgaatgagtacctaacaccaaattccatgcccctctcatgatcccagtattcatgaatcgataccatttcataagctgggggcttatatgggtcctttaggtacaatcaaagctcacttgccctggctcgctaaagctgactgttgttggcaactcttcttgcctccaagttcaataccatattcactgcttgaaatcaaccatggttgggaaattcacaccatgaaaattagaaaacaagttattattttcttcctagacagcttgtagcaaaatatttagtagcatactactatcttcctcaaataaagattatagttgatgtcttgagctatgaggattcatctgaaaggaataatttccctccaataaaaccagaaaattggagtagatccaaatttttttctgcgattgaattaaaaaaaaaaagaaagaaagaaaggaaaggacatgacttcctagatattgtggaggagagagtttactgtagataaaagggaaagcatagctagagacagggacatctgagagagtcctgagtgggcatgaccaaactgagctggtccatgtgtgagagaggagtgagaagaaaggtagtcagacagagagaccaggaagataagggtaaactgaaagagcaggtaaccaaaattgtctggattatatagggaggggcccctgggggaaggacaacccacctcagggctggagaagtttagagtaggtgacagagtataccagccattggtggtaatatacagtattgccacctgtaataggtaggtattgaaggatactggaagaagctggcagccaggtccactttgttaagttaaatagtcacctcagccatttgtatgaaacctaacactctgtaagactcactcaattgcactggtatctgctgaactctttgctaagcggtttgacttttaagtgagttcctggcctctgtataaagaatgacctactggccaagcagccagcgagacacctcagatacaggggtgaaaatgtggccaggacaaagaaagcagacgcctcggcttccttgtccatggctctgagcttgcctgtgtacaacttttacgttttcaatttctgcctccaaaattctgtgatgaacccattttacagacatgtaaatggagaactgaagctaaaagagaggaggagaggctacagaacagacaagatgtgaaggggacagaaagggagggaaagaaacaaggactagagaagctttccttgacaacaatctgttctttttcctattgaaatgaaaatcccccttaaattaccacctgacttgaaagcataagaaaacatctggtttaattacagtgaatttacatgaacccactgacaagaagcacagttaaaattagcaattttagtgtgctttttttttaagagaatgaaattataaagtaattaacctttgttgtagaactctgtcaagaggatggaaagttccatgctgtgacagaagaagaaatgaaattgtggacaaggaaagtgtgggttcattaaagaattatacagaattaaaaaaaaaaaagaatggagggaggcacaggtttagaagaacacaagaaatctctcagcacagcagagtcttttatgagaggagggagagagagatcctgtttcatcaaatgaaagtcaccctcctatactggaaaggacatcctcacctacacaagcagtaatggggtgggagggaagagccttggcccagggctgaaacatcttgaccatggctgtgacacctggtagatataatcacctatcagcctccaaagtaccaatccacaaggttatggtagagaggagcgcatgcacggaggcatgaggatgagctgtatccagctctttcttccctcattaggacaccgtgttcaagtcacctacatcctcaacatgtgtcccctcacatgtaaggtgggccaatagtaccagcaggcttctaagacatgctgtacacagtagcagcaatcagtacagagatgcatatttgctcaaagggactaggaaagtgctcaccccaaaacaggacacctttatcaccatcactacccaacttaaccaaccctccatccctaccaagactcagggaacatcaaggaagagtctgagagaatgtaagagccaaagaatgggaaggaacaatgtgatgtgctatcttctagacatgacatggctatcacattcatggactcaaagtaggtggggttatctgcagcatgaccaagatagctacaattctgtcattaccagaagaggcggtactgtctaggacacatctcttacaaaagcgccttaagcagtttatagctggtatagggaggatgaccattctcctctgaaggtgtggccactgctaggcttcccaaagctctacatccatacagtaacaaaatggatagagaggaggaagaagaagaggcagcagcaagagtagcaggcttgaaactctcaggagcacacattagggagtatgggcaaagttgggtggagggaagcaggagcatggttgtatttcatggtgaacatggacaaagttcttaagaataaagaaaaaatgtttcagagatctactccacagatgtctgaaaataaaacactgagctgtgctaagtggagccagcttcagacagataatataactcttgattggaaaaagccaggccaaggagttatgtgtaatttctcctcactgtggcaagggataactttgagagagcctccagcctttatataatccagattacatctcaactttgaccatgaccttctgttttgcatcttcacgttctgtggatataaaacatcaaccccgctgcaatgactcttgtttcctctctgcctcctctcccatgtgactagccaatcgttggtccaatcctggccttacagctcttctcaacatctgagcccagttcttattttgatagacagcaacagggtcccatgaaactgtgtgcctatacgttaccctccttttagagctgaccacacaccacacttccagttgttccaactgaagccaggaacactcttggtgtgtgtcctgaaaagcatctcctgtttctctggttatttctttctttctgaaaaataattgccccatcttcagaccttatcaccaccttcatactgctctcacacttagatggtaaccttgctgtctataatactaagaaaattgaagacatttaatactccttgacccacacaatgcatgtagtgcccacatagtcagtcttccatcctgtttctggggagaaagtatttgttttctaagtgaagaccagtttctatgctttatgtgccaaatcctacttccctttgcctaatggaagtcattactctggtgatagcctactgtctaccctgcagcaacgtttctctctataagtgatcattacactttacacagaggcttcattccatcattgttagaaagacaagcaagattccccagtcttaccttcttttccagctaccgttccatccactcttttccatatatccattttcccattctgaacttcttgaacacacccaaccaaggctgctcaattccacaccatttctcctatacggttcctctgaaatcacctgttgacttaatttttctgtcactgtgataaaatactgtgacaaaagcaactcaagagacaagcaggtccttttggttcacacatgtaggtcacaatccatcatgtcagacaagtctgagcaaagcagagcattgaggcatctggttacattattacatccaccatcaagaagcccaacagcataaatgtttctgttctgctcattttctcatttgtatatggtccaggatcttgacccattgatctccctacctcaattaacctgattcaagatgatctcccagggcacatccagaggtccatcacctagatggttctagatcttaccaagttaacaattgagattaaccattactcctggaatcttaaataaacgcaaccattgctattcttgaggtgagcatttatttagccagctgttgtgattgggtatgtttggctattataccctctttaagtctcccttttccactcgatttctgggttatcacacttctagatatgtctctccctcaggaattccttttgtctcctggatttcttctaaacatctcagctttattgacttatatttttgagactctttgcagtcatttctgtgccaagggctgaccagacctagcacacgggctttgtagaccatgtagatctctttgacagcttttacatttttgctgctgctgcaggaaagcatccagcaacaatatatacatgattgggtatgacgattttccaataaaattttatttacaaaggcaagcagctagttggatttgtaccaagggccacagattgctgactgtgggtccatttatttacctaattatttctgatcccatggctttgcaatccacacacaagctaataatttttctaattgatgtctccaggccagacctctccccagctctccagagtgatttattcacctgccagctatacctcctcacttagattgctctggtcctttggtgtaaaacattccaaacagaaggaggtagacatcatcgctcaaccaacaccaacatccttctcctcactgtcttctctatcttaattagtagcacctatgttttattagtggctcaagccaaaatctttgactcttcactttggtccatctgagactctggattgcacaacattagggacccccttcatgttgtgttgtctgtaattggtacagtcggctttgtgccaagcaaagttttagcttacccatctgcataatctcttagccccaccttcagtacagtagcactgagacactgaatagcctacccctacccctagccctaccccattgcttgctcccagcctctactgctggctccctgttttcagccatggtgatcaccagtgtggattaggtggccagttatttagtcctctacttcagccctggcctctacattctgttctcaacgatgcagtcagaatgatttttttttttaaaccatggagaaactcacagtagccttctgtataatgtcccaaagtcactaggaggcccagttctgtgtgttcagagttcatttcctacttctgtctcattacatgaatccagtcactggcttcaagtagaccaagcatgcccctgtctccaggcctttgcccttgtcatttccctcggactagaatggccttcggctatctctttgactacatcaggtcttcattcctatttagagtttagagagctctttctagcccatttcatttaaatgtggcagcctcttacatgacactttgtctctcttctctgcttcatgtatccccttagcatttatcaactgaaaccacatttacaccttacctcttattatctatattctcccaaatagaatgcactccacagagacagacattttctctcttattttgtttaccatcacaatgcaagtacttagaacagctccaagtaggtaatatgcacacataaatatgttatcaaatcaatggctcctgagtcctaggagacaaaatgaattttgcaattatttaccaaagaaatcagaagaccattgtaaaagctgtttagcatcctaagtaagctatgagaagatccggcttctgcagttagcgatataataggaatctggaaaaggagattgaggtaaagacaccattagagataggaacagtttttattggatctgtaggattcaaagtatggtatccaagctctgttagagcagctcttgggggaatgccatgggagcgagcctaaggagggacaacaacactgggcacttactttgtgccaagcaccttgttatccatattatgatgatgaaatattaaattcccatgacaaactatgaggaagttgctggtttcagacccttcttaaaacaaggaaaggtccccctaaagatgttaagtaatttgccccaggatagacaacaaacaagtctaaacaaaacacaaatcctggcagtgtgggttctaagccatttcctggtagtgccttataggtccaagtgatggaaatatgaattttgagttaagtggtgctatgatcatctttcttaagatgcatgcccaaagaaatatagaaacagatccctttcgacttgccctgagtaccataagaggctccaacacaactatactggaagctacatgggaagctaactgctgggcacaagggctaaaggcaggaaaaggctacctggagctccgtgccacaaaccactccagatgccaggccacatagtagaggatgggaaatcttactgcaaactgatgtccagggtatatataaggaaagtatctttttttcacttctgttgctatgatgaaatactctgacaataacttaaggaggaatattttcttttgacttgacagctttagcatcatagcagagaaatcaaggaaccagggccttaaagcagtttgttacatggttcctgcagtcaagaggagaacagtgaatccatgtgctctgatctttttcccttcctttacatctaatcaagttgagcattgggactgaccattgcaaaatggaaagcactttaacaggaagttatcatcggtaaggagacgttccaattagaggaagtacagtgttttggatactacaagctgctcctccccaaacatctagaaagctcttctgtagagaatcctccttctacctggttatttctctaaatgctctgagtacatcctcacaagacaagcagaatcttgtctggccaaataatgccttgtttcctccttttccctctgacttaatgaaacttaaaacagggactcattcactagcagaatgacacataaagccaggccacctctaataaccccacttctggtaatacctcttagcacgtttcataaaaacaggtttctggacagatcaaaagtgactccattttaattaaggaggaaaggatctgatattgcaaagcaagtgtctctagaaactagaggggggaaaggcccttatgttgttgtttttataaagcaaatgctaatatccagtcttaagaatagctaagtaaacactgttatgggatatgtccctggaagggaaattaacatttgtaaagacatgagtttccccaccctgatcttttaaaagagttcaaaactgttttctagctgtgtggttaaggaataaaatctataaataaaagcaaggtcaaagaatgaagttcgctagaactaaattaatgagacgtttatttgttttatccacttgtgcagagttaatttcacacagagaaaagagtaaaatggtttttataatgatattaaatataattttatattaatgtttgaaaattatgtgacatgaaaaacttcttggaaatacatttaaaacctaataaaaagaaaaaatctcatgtggttatatagtatattcagaaatagaatcaatggcttaacatttttcaatgaagaaaaagtttaacaatttaagtttgacttgtttttatacatgttatcagatcatcacccagggattttgtattcccctgttactcacaactcttcagagagggaaaacgccataaacctcctgcctcaaaatgatgtgaccataaccttgacttccaagccagcggctttgaaatcttctttcaagtttgcaatgagaaagaaggaagttaggtgcagatatcccaatcaaaatataactaaacaacccagtaacactgtgggaatagaaaaaaatatttcaagaaatcaatactggttaaactttgcaaaatccatttatataattcactgcattaacatactaacagagaggaggaaacatatcattactacaatggattcagttaaagcccagcatgattttaaaacaaaatttctttgaatatgaggaataaaatggaccttttaacctgctaaatgataactacaagtgacctacaaacaccacatgaaaggataaaagaatagcatcattatctttaaaattggaaaaacacatatgtctatcattattcccattaaatgctgtattggtgaccctaaaagacagaaataaaatgagctaaaaaattggaaagaataagactgttattagctacagatgctatgattatttacgtaggtaacccaaagaactctgaatacaaatattagaattaaaatttatatatttcctaagatatccacatagaggaatatatcacatttctattcacctagcaagtatgtagtatcttttaaagatactatttataatttcaataaaaacaaataaaatggacattaaagaagcctccaccaaaacggtacattatacttgtgataggaagatataatattataaaatagaataatataaaggcaaattacctttaagcaattacaatgaaaaacccaaacattaaagaaaaaagtgtatgctgatccaaaaatgtatttatactaagaaaagatggctagttaagacagttgtgaagacgaactttaatattacatggctaaagacaaagtttaagaattacatatgtgtgtgtatcatgtatgtattatcacctaaacatattatatgtgtatacacatatatatatatatatatatgtatatatatatatatatatacatataaacctatacatataacatataatatagtatactatataatatagtatagtatagaatatagattataatatgtatatgtgttttgcctatatgtgtgcagtgcccatggaggccagaagaggatgtattatttctcctgagactagggttacaaatggttgtgatctacaatgtgggcactgaaaattgaacccaggtactctataaaagtcatcttccatctcctggttttctatctattgagacaaatcattatttattaagaaaatatgatgttcatgcagggttggtctaaaagaacagataaacaacacagaactcgggacccatatcctcgaggaaacatggtagacgttagaagtggcacagcaggaaatcaagtgattcatgtagcgaatggcactgcactgcaggtgtgcatttactaaaggtcattttatcagaagcataaattgcaagcttttcattgcaaacatttaaaacatactgttggaccttggaatagagaaagtatctcttcaaaaaacacccatggaaggagttacagaaacaaagtttggagctgagatgaaaggatggaccatctagagactgccatacccggggatccatcccataatcagcctccaaacactgacaccattgcatacactagcaagattgtgctgaaaggacccgatatagctgtctcttatgaggctatgccggggcctagcaaacacagaagtggatgctcacagtcagctattggatggatcacagggcccccaatggaggagctagagaaagtacccaaggagctaaaggggtctgcagtcctataggtggaacaacaatatgaactaaccagtacccctccagagctcgtgtctacatatgtatcagaagatagcctagtcagccattattggaaagagaggtccattggtcttgcaaactttatatgccccagtacaggggaaagccagggccaagaagtgggagtgggagggtaggggagtggggggaagggtatgggggacttttgagatagcatttgaaatgtaaatgatgaaaatacctaataaaaataaataaataaaaatactatttttagggtttttcaggagtccaatctacaataagtattttgatggaagaatatttaggaggtcacgctggacatagagagggggaaacggacaggaatgaatcagggcaagacacactaaccagcagctccatcaaatgctggattttagaacagtgccattcaaagtgtgacgcaaacacaggcattgaatcattcactctttctccatgacagatgagaacaagcacacacgccaagtgttttaagaagagaaatgtttgtttttcattgcttttaagtgttacttttagtttttaattttatttccccagtgatccatacttaaagtgatttattatagcatcagtctgccgtgagttggaaatgtctttatcatcttcactgtcctaaccacccaccactaccacccttccccctgccacatgcaagtcaccaggatttcaatgtttttaagactttgattagagccagtggaatatgaatttatcaaaccaggggtgagaaaacatggatgtccactcatcagcttcctatctttcgtgactggtggatgttttataaacttaacagcacttcttatctcccctgtgtggtgaccacggttattcccatggccttgggtaaagagaatgtgaggtgtttgagtatgtgtatgttcagttggatagggctagggtaccaacagtgtctgctactctctctctctctctctctctctctctctctctctctctctctctctctctctctatatccctccctccctccctctctccctccctctctctctctccctctctctctctctcacatacacacacacacaaaatgtgaaggcctctgataaattcaaatattttaaaaattaataactgatctatatccaaaggcaaatacaaggcacaaactgagaggtttactagtttgtttgtttgtttgtttgtttttttcctgtgctgggaatagaatccaggactctgattgaaacaggctgcctctgaatgcagcccagccctcagattgtataaaaatataacacttgttttatgaaataaagaaaccaggacatcaacacaaagaggcagtatagccaacaaacattatcacatgttcagctcacttagtacataggtaataacagagaatctctgcaaagtgtcatttgcacttaccaggtggcctagactttcaagactgatcataccaagtattcttcaaggatatagaaatgtgggaacttacagaagactgcacaagagagtccaaaatgctggtaccactttggcattactcagaacatgtgtagagtgataagctctttgatctacctattcctaagtacaccttggcaacagtgtgcactatgggaggaaccatctattttccctggatagagttgagaaagaaactgtaagcactatgaggcaccatctcaagaagtaggcatccagaggtggaagccccctccaagccaaccagaactagtgagccacatcccaaatgacagaagataaaagccctcagggtataaataggtaggatcttgaagatgagctaaagtccctatctctccttccagaagattctcaactacagccacaaggcttgagtctaccttagtaaaatctggtatacattcgaagagatttaaaataaacatacattcatgtaagccatgcacaagagagagccatctggaaataatccaatatttaatctaaagtagaatgatgagataaagctaaaaagaaaatgacaatgtcaagaactgaagagaattaatatacagttgatggattgccagatgtcctagaatggcaaacagaagtctaggaacaccttatctgtatgaaagaaagaaagaaaccaaatgacctactgtccaggtggcacatgtatatattgatgactccatataagaatttaggctggttaccataaaattttgtagtcctcattgtgttgatgttggtggaatggggaaagaaggagccaatgaagaaaggcacaaagtgagtaacaccttgctttttgtacagtcaacatgctattatttttataaacacttggtaaacacagccaaactttatatatatttgatatcatgcaaagcaaaagagaagcttttaatgtaatgcaaaacaagagtaatgcaattatgaaaatgcaattagtagaaagcaacagaaattccatagttttaatcaagggacccaaagagaaacgtgagtaggggaagctttaaatagtgttactgtgtagagggacctgaggttacagagacggcctttgccctcaaaagaagaggaaaaggaaaatgcaagaatcagttctgttggaatagctttgaatttttataaaattattgctaagttcttctgactactatttctttgacacaaggtctcatgtaaccgtggttactctcctatgtgttctgtagaaaggttggctttggacctctgatcctctcatctccaccgcccaagcactaggtaggattaggagtatgtgttctccttgaagaataaatgggtaactgtaccccagacatatggaaagggagtaataatgaaagagaagacctagctcttctgcatcttaaaacatgtcatcccatactacagggagatactgtcatagtaggagctatgactcagtgaaggctgaaaacatatgccagggtataaaataagccaccgtggaaagatggcattttaaatcatagtggaaagttttcactggccgagtaattttcccaagaatgttgcaaggaattatgggtaaatttctactctgtgcaatatagaaaatacattccagatggatgacagttttagatcaaacaagaaaaatggcagtaacataaaaacgtcgtaataattactcactggtgttttttatttgcttgatctgtgatgagaaagataatctgccctcagctggaaagcctagtgctaccagcttgagtttcaccaccatgacctccattagacaaacctctctgtccatttccatcccacagaatttcccaccaagcaaccctctctaccaaccagggaggccttcttccactagacaaacctcccccatcttcagacaagctctcagatgaatcagcagaaaccccctttctctccatttcactcctcaatgattaaaccatctccactctccccaatttcttgcactgctggaagacagattatctccaactctctgagaaaaattaagccatcagggtactgaagctccccgtctgagcagctccatctgttcgtctgctttccatctctcacagtgggaaggggacttctccccatccattcctgctcttacctttactggggactcccaagtcagccctctttctctttcttacccttccagtgtgtggccccttttggattatttttagcaacgctagccatggcatacccccactgccatctttggaagtggcctttgtccttgcttcacttctcacctcagctgtcttttacattttcttacccatcataatgaaatttctttgctcataccacgtcatcttcagctccttttcagccctctccagggtagtgttacacaaccagtctccctaaagtgtgcttattctagccaccagtgttggaacactcgattcaacagtaacttcaaggccacttctgagttgaagttcagccatatccctcactactaatcaatcccttccctcccctatctccttctatagctgctgtagtgacaactcaatgtcctggttccctgcagctcccagtgttctagttttcctcctcattcttgagaccagtttcccttagctaagtctaagagcttcttcactcccacccctcattttgtctatattcttgctgctggacctttttccaggacatgatttcaatagtcaaacatgggtctcagtcttgttttttccaaaggctatttacccactctggctggatgttttatatataactcaagtcaaagagaagctgagctcaccagattcctctccagaactagtcatcctttaagacccttctctgtatggataacagtctgattcgtgggctcaatttagcagtgctgggtctccctgatacatcctatcatcgttaccctcatctatcaccatcaactcacactggtttagcctgacagaaatctcccacagttcatttctcttctacactccttgctctgatgcaagctaacatcctttgtctccaaaatgactacagacttcctaactgatttttctccttccacccttgacctcagaaagctatccaccacactccccctgttccctgcatttaccctagatacttgtacgtatccatcaactctaacttacttcccattcaatatcctggcttgctagcctagcgtgtctctgtctattgttctcctagtactgcatacccttacctgagagtgctgataataacttgaatgaaattatctatgagtagagtgacttaacacatgtctgctccctggatcgcacgctttaaaaggatttgaccacagttctcttcgttatttgtgtatctctaatgtcagtagcagtcctctgatcacattaagatttatttgaagagagaagaagctagttagggagaagcagtgggtattttaactcattttcaaagcgtctacatacctcaaagctttaaaaacacaaatgaaaatctggcaaaataaaaacaaaagtatttggaaactatgcaaaaagtgtccctttagtgtcttcacatgtggatgtgagtaacaattcgctaagacaaagatgagcaaaaaaaaaaaaaaaaaaaaagagacacagcaagatgagcccagggtgtagaaagcgtgttctcaaaagaatcagtgcaaatgactaattaaagtgctttccagtattctaaaaatgacacatatacttaattttttaaatagtcagtgtgggcagaaattgggcctaggcatgttcttttgttgggagtccagacttatacatattttctgggaggcaatctggtaatatgtgtcaaaatccctaaaaataagatagttgatctacttaggcctactaaattaattgccacaaatttgtctggaggacatgagcaaagttgcatgcagattctttatacgagtgttcatcgaagaagatgaaattatgtaattatgtaatttgcgaaatcatggatgaaactggaaaatattgtactacatgaggtaacccaggcgcagagtttcaaatatcacgtggaaccgtaccagctcaggaaccccaagactaagttcttgtgcaaaagagattttagaggccaaaaaatgaaatctaccttggtggctagctaaggaaaggctgtccagagactgccctgcctagggatccatcccatccatatacagctaccaaacccagacactattgtggatgtcaacaagtgcttactgaccagagcctgatataactgtcttctgagaggctctgccagtgcctgacaaatacagaggtggatgctcttggctaaccattggattgagcacagggtcccccaatggaggaactagagaaagaacccaaggagctgaaggggtttgcagccccataggaggaacaacaatatgaactaaccagtacccccagagctctccaggactaaaccatcaaccaagaagtacacatggagggacccatgtctccggctgcatatgtagcagaggatggtcttgtcgaacatcagtgggaggagaggcctttggtcctatgaaggctctatgtcccagtgtaggggaatgccaggacagagaatcaggtgtgggtgtgttggtgagcagagggagggggaagggataggggtttttggaggggaaaccaggaaaggggataacatttgaaatgtaaataaagaaaatatctaataataataataataaaaataaagaatgtaatctaatgtttgttttgttttgttttgttttgttttgttttcatggcagaaggaatgggggagaagggcaggatctttcagagccattttgggctggctagaatccctttacatgttgtctgtcatgtatagctctcagattctaatttttaggtgtgcgtttttgtgggattaagttttggtaggagtcttgctacttgaaagaggcccccaagaggggaaatacaggttttaactaaggggcgcagggcaggaaacagaacacacatgatgcggaagtggagtaggggaacaggaagcttaagtgcgccggcagggacaggagatgggagaaggagcttcagcaacaaagtatgtatgagcatttcataaggaaacctgtactttgcacggtaactgaaaaaagcatgtttaacccagtgctatccatagtcataaaaagttccaaccattgctaacactcaatagcgagagttgctctgaccataatgctgtcacctgcccccaagaggtcagtacgtgttctcacaaaatacctaagaattttaggaattttttagttttggttttgttttgtttgttttttgagacagggtttctctgtgtaacagccctgactgtcttggaactccctctgtgaggtgacaaactcacagagatcctcctgcctctgcctatggagcactgggtttaaaggtgtgtaccaccatgcctgcaaaattttaggaatttttcgtatctatgatttgtctagttataaaagaagtaaaaatatgagcatatactgtatgaattaattttgaaaaaatgtaaattcaattttatatttaaaatgtatgtgtgtgcatatacagccatgaaatactggaaaactatgtttgggtttgaatggcagtgattttgttgttcattctcttttaaaaattttggcttttttttctagtgttttgtctccttttccctcttgtattgaaaatagattctgtccccccatacattgtatcctgttttcagttttcctctcactactcctccaggctcctccctaccttccttcccttccaggtccattcactttctgtctctcattaacataagctcctaaaagataacaaaataataacatatttaataataataaaatatttaatatttaatagcaaagcataacaaaataaaataagattaaaaatatcaaatttggataaagcaaaccaatggaaggaagagagcccaagaaaaaggcacagaatagagacccacaagttcacacactcaggagtcccattaaaaaatattaaactgaaaactctaacatgtattcctatgacctggtaccaacccgaagatcttcttgtatatacttaataccaacaaattatatgcatcgtgtccataatgagaaaagctaaatgcattttaatttgacaatggggaactgattacagcatgtgcttgaggctctatttagagaggcatagcacgatgactaagagtgtatactttgaagttgggagacaggtgttccactccctcttcacaacttaagagtgctgtgaccttgacagagttagctaattctcacagcttcatttcctttatcagcatgaaggggataatacatacttgaccgatctgttttgtagcttaagtgaaataatatatgtaacattccaatcaaagagtaagcacttagtaagagtacctgcttttataatgctgagtaagcacataggaatgctgagtaagcacatagagtacttgcttgtataatgctgaagtataaaaagatctggtaatgatttacatgaattcttcattctctaagggcttataaatggaagtttggggaatcatttactctctagctcagcatcttctagactgttgtgtgaggatgctggattcagccagaagatactgatgggaagactagcctattactgaagcagtccttgggaaattgtgctcattagggccaaatactgggataagtcatgcatcagcctctttatccaaccagcaagtggatattaagcatctacccaacaagggattaagagactcagcagaattatgagttagctgacttcttagagcaatatgaggtctcctaattgggtacatggttaaagatggatccagaaattaagaaaccaagaaagcattttctaaagttggagaaaatttggcaggaccaaggcaatgtattattaaaatgatggcaaatctattttgcatgcatcaaatcacattcctaaagctggctggagcctacttacatccctgtgcctgatttggttcacatcatcagtgggcttactcaataggtgaatgaaaagctgtcacttcatgagtcaaatccatctcactgtctgtctacggaaataaagatttgtctaaatatatccatatttattcatttacagatcctcaatggccaattttttttttgttctacaataatagagtcaagaacatggatcagaaatagtgtcagccatcagtcctaaaatgacgtagaaggtaacattaggctcacagcatttcctttctgtagttccaggagctgttcctctcgagtccatccaagggggtccctttgaggagaagatctacatccagtggaaacctcccaatgagaccaatggggtcatcacactctatgaggtaaggaggctcctgggctacttcagttggctcagcttcattcagtgagtgaacacctgctccttcaagggcataaaggtgagtaagacacaagcagggcacagagttgggccattttgatcatgccaaagagaaatacatgtggacataccaggcattgacatgatcatggttagaagtgatctctttggcaaatgaatcaatagttcaaagcatcagattgccctaatgtacaagggaagaccaacacctggaatgtggaagctaaagttcatatgggacatgacaatgcacaatgttcatgatgaatcattacatatattatataaattatatatctattttagcatatatattatcatgtttaggtgtttacttggtgaatgtgttcctcctgaagatgctctatcccatgtctaatatgataaagctttgctgatgggtggggaggattatgaactgccatgtgtgtgtttatatgtgtatgtgcatgtatgtgcacatgcatgcatgtgtgtatcataccttgggttttgagaaaatcctatagctattctgtttcaagaggaaaagattcctgagttttaacttgctctgtgcccaaagcctattgtgtcattagctccctagtagttcataatacttcctacccattagcaaagctttatcatattagacatggatcaggccattttcaggaggaacacacttaccaaacaaacccctgaagatggtgaactaagctatattgaaggccattgcaggacaaaggcaaaactgtctccatacaggctgatacctaagtctaggatcaacatgggggtaagactgactttccttttattgctgtattctgagacactatgagtttctaatactggacagagtagaaaaacagggtgaaacagatgagaggcatggatggtgaagtttaaaaagctatggccttgtgtctgataagcttgtctgtattctcagattccccttggttgccccctcctctctttagacctgatgtcttacctaaacaatgaaggtaccaatcactacttcagaccacagcacatctaaagagacaaaaagcccggggattcacaggctgaaacatgaaccctgacttataaagtttatatggcaaaccacaatgctcttggtgaatcacgccatatatataagaccttgggttagtctcctgtgtttcaagggtaaaagactcctgagttgtaactttctttgtgccaaaaatataatattagcgaactggtagttaatacccccacccctctgcaaggcttatatcactaactgttcatgaagaaacagtcacctatagagggtgggttcagggaggaagctgggggcattataaagtcttttacagtgaaggatcaggattggtctaatgaactcatatgatttttagagatatgggtggtcctcaagtgtctctgaaacatattagcactaggtacaataaaaaacaccttgtctcaccggacacctagcctccaaggatctagctaacagcttcattttacaaagtgcagggatcatgatgctatccccaggcttagcacttggaaggaggaatacaagcacccgaatgcctatgaacctttctgggccacagagaacaatctttctttcttcccgtgttcatcattggagaagcattcctcttggcacacttggctaaggatatggtcaaaacattatctgggaagaaagagagacatgaatcacattgattcacagtaactcatagttgtgtgcttttcactgtagagactacaacccgagagaaagaaagaaagtaaaagaaaaagagaaagagacagaggaggagggagagggaggcagaggaatagacagacaagcaaacaaacacaggcagacagagattgacagaaggagacacagagagaaatttattatgcatagcagcctgttctttatgcagaaaggggaaagatccacgatttagggagtggtagtattatcatatgtgatttctccattctagaagtatatggatttagaattcaaggaccaggaacattgaaaagattttaggactcaacataagctattttaccatcactattaacatttaattttgaaaaatgtaattccaaaaatacaaaaggatatcattgtataataaaaggctctgaaattgaatgaatttagctttatgaatagctcatgacaattgccttatttttttcatttgaaacgatgatggcttggtcatgaaaaggctctgtacttgcacttaccttattttggaaaccacgaagttccactgttttggctctgtgcctgtatctcagcatagacttctttctcaagagcaacatcagtttctatatcacagggctattgtgctggactagcaaagcaacactttggtgttttgggattagaataaagaagtagatgattagagaaggtagcagcaacagttatgaattagacacattgagtaataactcccgaacttgtggcatctgtgtgaggtacactctggagcactagacacaaagaagaaagcaagatggaacagcttatctgccttacttagttgtgaaccagccaccttgtggagtctcaaagacctaattctatttccatgatggattcttggaaatggctctgtggagacatttccaagtaacttcttggcttctcctcaggctatgatgatagagaaccagggccataagattaaagttgactgatactaccatgagccttttgggaacacaccaaaaccttttgggggattctgtgaaggaatctaggagtttatatgtttagtccattgtattctgtaggtaagcatgactgtgatggcaaatgtcccaagctaatgtggcccaagcattgtaagaatgttgaattacagatcagaagctaagtttagttcattatgtggtaagtgagctatggtacataagtgggatgtagtacatctcttaggattgcaggcttctcaactggaaaaaacatagtaaataataataataataataataataataataataatagatagtaatgtattgttaaccttacataaaaatgaagaagttgaggaatggcaatgtgacatgttgttgggtcatacagccagggtgacatgcatatccctgtctcctgagttcaggtgcagcctctgatataacacagagtagttcatgggcttgtatcacctggggacttcagagatgtaacatgttaggccccatcaataaacagaaaagttagattctccagtttaactagacccttggtaggatcatatgagcattaaaagatgagaagctcttttctagaaaacactgctttttagaaaatattttgcaactgagcaaatagtatgccctcttgagcaaagagaggtggtattccttctaccatcaactcaagccaaccttgcccctgagagcaaatagggggtccttgcttttagagacatacattacaaaatgtgtttatggtacaaattccaaatttaattagataaaactaacttgctttttaaaattaggatcccactataattttcagagataaacccataaattacaaaatgttgtcttctagcctcaaaaagaatacctttgttacagagaaaaatgggatgacacaaatggaagaaaaaatagactgtttatgcctttctatatacaactcaacctgactctgcaaagccgaagtatgtatatgctagagttcacacacacacatatacaaatgcacacacacacacacacacacacacagagagagagagagagagagagagagagagagagagagagagagagagagagaacttctcttccattgttaaaaccatgtatcttaaacagagttggtccaagcagtgttaaaataaaatttcttcccctttaaatccacttcacacaacaaactctggatttatccttaaacagtcctgcacacccaattctaaatctaagtggtttttgattaagtaccattctgtctctgaactttggtcttcactttatgatctgaaagtgtcaaactgtcctgggcttcaactgtgtaagaactgaggcatacataaacccatgtcaacaggccaagcaaaggttataaacctctgtgcgtttactgtgcctttaacctgaacagagtctgggaaagacaagcaaggaggacacaaagaaactcagtggtgcagcagccctgcagtaggaatgacagacatgtctgacaaacaggcctatagctagctggtctgggcaactttgtggattcttctttttccatccttttatccccacccccacccaggtattcaacccctaacactagataggagagagacaaggatggaagggagaggggaattaggaagatcctcgaatctaattatttcccttttgtttcctctttgatcaaggctaccaaactgcagccaatctccctaaacagccacacacctccaaccacacctcccagggctctaacatttatataccctctgaaaagttctcagaattcaagatgtcacataatcgaagaagctgtctacagctggcaaaactacacctctgctagagcacagggcaaagcataatcagctgctgtggacagtgaagtagctccatatccccatacctgggtttaaaatgaaaacatacacttagaatatttccatggtttttaaagaaacacagattccagaattctcaaaactgtcatcacagaggcacacacgcgcgcgcacatacacacacacacacacacacacacacacacacacacacacgcacgtggagaacagaagatatcagatattctactctgtcactctctatatgattcctttgaggcatgcatctctcattggacttggagcttatcttttctttttttgttttcattttgttttgtttttggctaggctgactgaccacgtgtgatagccacgacactatctattcttctcagtgctggggtttcaggcagatgcagccatgtcttcctctctacacagatgccacagatctgactccattccccatgcttgttcagcaaatgctcttccccaccaagccatctacccagctgggagaatcatagtcttaaaagagcacctcactgttctggtgaatagtacactctgggttacacaggtgtcttgtgagtataggaaatgcaccaggaggcaagaccattttcatcttctatgacagtgtgacgagggctcactgttctattgtacctggatagaaaacttgaagaattgttatagcttcctctttcttatttctgacagaccttgacagtttccactcaatcacatgtttttatttgtttttttgttgttgttttgttttgttttgttttgtttttttttgttttgttttgttttgttttttaccttgatgagcttttggagcctgggcgggttagcttctggactttcctcccgtaaaggatgcgagtctcaccgtgactctgttcaccttctgtggaccagcagtagtcagcacaacttcccagagaaggaagaactcagacttcgcagcagcacctgtaggaagtttggatgaagggcctccggtcactgggtattcttacttctgcgcaagatgacgaatgcatgtctgtgatttattccctgactgagtgacaggtaatggtccagatggcagtgtcatcagcacaacatggagccacacactagatggaggtgccaaatctcaggctccagaaccatggaatcagatcttctcttaccaagatcccccaatgacccatgtgtacgttacagcatagaaagttctgttctaagagatactctaaagtctccccatttggaacttaagaaggaggtggtagagtttgttagggaattatcagctcatctggtactatctggctaataaaagcatggcagccatcacatggaggatttgaccatgtgctaaggaatgcctcttttcaacaggctccaaagagctgagtgtcttcattaacagtataaaaatcttgctatttacaattttgttttgttttgtttttatggctgggtgggattccaacgttcatcagttaggacttggatacaagagaaggacagtacagcaccctgattcacgttttagggacaactatgactcttcaaactcagaccatggcaatattggactgaagcttccagccagaaataggtacccaagggcaaaaacctgtcaagcaattgtctcaaagttcttcaataaaatcattgggagacaagctgctcagagttcatgaaaaatagtaatcaatccgtgtttcagttcaattaattgtgctcatctctgccccaaaataaaattcacacagcgtgagggaattgggccagaagatgttacacttgcaactgggttaacgaagtgtgaaaatatttaaaattcagacatatgaagctttccagtaagcctttctgtttagcagtcaaaatcaccaagtttctaattacagtgtgtaaatctgagaagcttaaagggaatgagaagaccctaatgaggcaggaatgggtgtcttgattatactagagttgattgacatttatcttgcaagctattctaggtacccagcattcagagttaaataaaacacagactttgcctcaataaaacaagacagcattcttgtgtgggagcgtcttgcaaaggtacggtaggtcggagaattgtcaatatttttccagcatacagatggctggattcaatctgaacagtaatcaggggccctagaaagcaacatcctaagtaaatgcactgccggaggcccctgtgagttcagaggcagaggagctttgaacaggatgggaacagataccaagactgatggagagaggtggcctgctatgtataagttcagggttaagtgcttaaagaggaagctactagatctggatagatgcatataccacctcctaccctttagctttatcacagtgagtacttgggcctcatcaacactggactttcttatctgtggtccacagaggcacagcaggaatgatgtgataccttccagatggacaagaggcaggaagggatcagctgaatcatgactaatataactgtaagcctgaatttgaataatttaagccagatctatgttaattaggatactaaattttcatactgcaggccactacggggtatgttaagcctggctagtaactaaaaaaagaaacctcttaactctgttgagttgttcatgccagaaatgagagcgttatctattatcctagatgctgttcaaaggatctaccagaaagttccatcattcctcctgcctaaatagtcccaggccggaccaaatggccccctttccacctaggctgttctgagtgccaccagatgcctggattgtctgcattccatccacatcccactctcagtacattgacagtgttatcatgttcatcctgttccttggcctcgtctgcattttaaggcacttcatcctagactggtccctccagtttcttcttttagccacttgctttctttaatgccttttaagagaccatattcaatttgtctacatagtgttgtgtagccttatccaagctgttggaccgttaacaccatgatgatgttggccctgtggtgttggattttctgtgttatcttgacttaatcacaacatccagatgtgtgttcacacatgctctcgtgggggtgctcggaatcttggaatgagattagctagagacttgtactgttaataaagaaaattgatatataatatgaatggggcctcaaccaatcaggtaaaggtttgggtagagagaaaggtgatctttcttgagcaatagaggttcagcccgcagactttcagacttgaacttcaacaccagctctctggttccctgtcaacctttagaattgacatgactaatgcaggccatttttgtttgccatattactgttgttgtgttttataaaaagaaagaaagaagtcagggatatgtttggtagaggcgtgatatggtgagatggaagggggtgcctctgggggcccatgctgagacattccttccctctgaggtaacaatcagacaacaggtatagtatagactagagttcatttggggcatgggaatgggagttgagaagggagtagagacagagtcagagacagagacacaggggtggggggagcagaaagtgtgtatagacgagtagaggccagccatgaacacatggagagaaaggtgtgggaatggggagagagggacagagagggaagagagtaagagagtgagaagggggacaaacagtcccttttatactgagtcaggcatacttggctgttgccaggtaactgtgggatggagcctagaagaaattctaacaaattgtgtcttggagacccaaagtaatactttgtgtataatatgtactcaataaacattccttaaatgaatgtatagatcttaacatgaggtaggaagaaattttgactgagttctcgagtggtttttaagtctagttaaagataagtattacccattgagaaattcactcctcaactttgctttgactaaaactgttctaagaaaggcaccttttgttgttgttattctttttttaatttatttttaattagatattttctttatttacatttcaaatgttatctcttttcctagtttcccctctgaaaaccccctatcccctacccctccccctgctcaccaacccacccactcctgcttccttgcactggcattcccctatactagggcatataaccttcacaggaccaagggcctctctacccattgatgaccaactatgccatcctctgctacatatgcagctagagccatgagtcccaccatgtgttttctttggttggtattttaatcccagggggctctgggggtactggtttgttcatattgttgttcctcctatggggctgcaaaccccttcagctccttgggttctttctctagctcctttattggggaccctgtgctccatccaatggatgactgtgagcatccattttctgtatttgtcaggctctggcagagcctctcaggagacagctacatcaggcttctgtcagcaagctcttcttggcatccacaatagtgtctggttttggtggttgtttatgggatggatccccaggtgaggcggtctctggatggtcattccttcagttcctgtttcacactttgtctctgtaactcctttcatgggtattttgttcctccttctaagaaggatcaaagtatccacactttggtctttcttcttcttgagtttcatttgttttgcaaattgtatcttaggcttgaaaatgtaggtaaagaaatgatgagatatctagtcaaatgagtgtgtttcaggatgggcttcattgcagtctaaatacctaaggatttcttatggagggttctagcttatagaatctgagagtatttgcttgcttgttataaagaagcacaatgcaaagaaggaaacctagcttctgctggcatatgagggacctgctaaataaacagcatggaccctggctcactccatattccatcttattggactatgctccatcatcccctttggatgcagacacttgagccagcttattacttactcacagctagatgcaaggtgcctatgtagtttaaggcttacatttgagaaggcctggttggtctctttccctcaagattaccacatgaatagggtatggagtaatggcagacacacagggaggcatcctgtgtgtctgatgtttgcttcagcatccctttataattcaaatgccttagctcaccacaaacttcatttatgattctctcccacttcctagatagcagaggtggtactattgttttttgggtttgttgttgttattagattaagaaagcaacatatatacacaacacttaatatttgcctagaggtcttctctaaatcttaaaagccagggctctgagatgcctggaagccattttttttttgtcctgagccctcagctcaccattcacttctcataggattccagagatgatgttaaaaatgtaggcatctctgggtagatgccatagacagagcatctgaggatgagagggagggtgacgggtgtgttactaggaacagctctggttggaaaggcagatgtctgacactcagagtctagaagggagggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggggaagaggaagaaggggaaggggaagaaggagaagagggggaagaaggggaggaaggggaagaaagaggggaagaagaaggggaagaagaaggggaagaagaaggggaagaaggggaagaggggagagaagaaaggaaggaagggaagttagtaggttcaatatagttgcctgttcatcctccctcagcatatggaaggtgtctatatatttgccttgggtgctctttttcttctattacaacatagatatttgtgatggagtcagggaacatgatagaagacatcaaatgcacagtgtgtgttagctaaaggacagaaaatcattctcttggcaataggtggttcagaaaagataccagtcattgagttcagctgtaaaccgtaggtatagtacacaggaatgcagtatagacaattcaaatgcatttgtgtctgagtggtggtagtggtgtgcgtgtgcatgtgtgtgtgtgtgtgtgtgtgtgtgtgtgtgtgtaagaatttgtattttgtgagtttattctgtggttgctagtatgactatgaacgtgtcacatctgttgcagtgtctacatgaagtgtttagtcttagagaatcctcagcttctcagctccctccaggtccctgtggaggggacactgacctcttgggagaactgctccatcatctcaagaggctcccaggcgtaactcctggacttcttgacataatatcatttagaaatttactgagggagaatttcagattaaagaaaaaaagaagaaaaaaaaaagatccggggagagataaaggatgaacataaagttagactctatatttgcccagcatgggctcttttatgctttttctatggaattgtgttttgatgcactgcgtgggaccagagcctttgtaggggaccctcctgtacacagtcacatggctagtgagggaacccttcctctggtgaccatgtcctttcaacacactgcccagaggcggtattaagttgcccgagaatctctttaaacatcacaggttgtttccttttcatgtctgatgttttacctcctcactccagtggaattctgccaggctgggcagtgcagcatgaatgtgtcgcttttaaccagctgcctggtttgtttgttttggtccgagcccttcagtgttcagcacagaaatgaagacaagctgcaagttttcatctactatcaggacaggtggaagctcagagcccctggagactggaattcaaatctgcgattgattctagcttatctctgtctttgtttaggaaatagcagatggcttttcttctcctaccccaacccagtgggctcttttctcttcattactttttgctatactcttaacaaggaagaagtaattccattataattggcaccaatgcaaagaactttgatctacttctagtttcaactcagacagcccattggttctcaaccagtggaccagaccttttgggggttgatgttgggatttgaccaactttttcctaggggcccctcagagtccttcaaattgtcataaaggtgcttattgctctcgtggtccctcatcttgtcctaggcatgtttttaacgtgagcctttactgaaaatcagattgggagttaatcagctaaggaaggtagtattcacttttgtttgctgttggcaagtactgtatttgaattagccctttcccaggttaggtctcagtttccacctttactaattagggggttgtactctagggaacctgcagggcccacaggttaccacttgagtgccaaaacctagattaatcatacccctagttttatgcaagcctatccttattgctatgtgtgtgaccttcttcttttccattcattgtgtgatcgtcttcatccattcattctcgaacagtgcattatttattagacatctgaaattttatctacttgctatctacagaagtatgtgcatttacttatatcggctcaactcgtcctccttcctctcctagtgttcagaatcctctaataattccttcacattttatatagctttgtaatttttatacatttgtatataatcttttggagcattttcattctagattaaagtcgtaccatgcctccctattgatgaatgtagttgtacttcattcatcttaactgctgtataatattccattgctaatgtgttttactaatgtgtattgttaacacactggagattccttccaggttggcagttttagcagcgtgctgaaatgaacatcccttcaggtcaggtgacatgggcctgaaatctcagctcctggggttaatgaggcaggagaatcataactgaaggtgtgcctgggctccagagtgagatttcagcccagcatgagctcagctagagcatctgcctagtatttacaaggtcccaggtttagtccccggtagtgacaagtgcaccattatacattcattctaattatccatgtgtttgtgtatctaggaaatgggtaatatgttatagtatattaacattaactgtaatatgtccctccacaagccccccaccccaccccaacaaagcaaaacaattttccagactagtttaatcagtttacatcactggaagccaaatacaagcaccgtgatgactttttagagcctgtctatctttactatcatcaggctcctttggccaggtaagtatcaaatgacactacctactgtcttcctgtctatgtcctagatcatacacagatcgtgaataaggttgactctcctcctcatcctgttcatccatgtcccctgccctgtgaggtttctgctctcaccatttgcttggcttttgattaggttgtaccatccttcctcctgctagatgataaacttcagagcatatttctatacttgtcctcttagctacacacatagcttggcagctttaccccctgtaatgtatctttttgaaaacaaaagtctttgattatcagtgttttagtcttagcttattttggcaagactcgcactgctcctaacaaatccatcttgaacccaagtcaagaagaacaattcttcagagatccactaatatttgtagattttgaccctgaactatgtatgtttgatctatttgcagttatttttatgtacgatatagatggtatataccagtgtagttttatcagttacagaatagatacttgggccaagttgtaccaattagtccttcttttcccttgctttatcagctgtatctaacttatccacaaattctgatgtgttttaattgttttcctgatttccctctttcacaggcctccataacaaccacacatggccgtaattattatagtgccacattgaatctggatctccgatatagcccacccctctgcctcatgcttcaaaaatatcttggttcttcttgcccagggggctttcattttagaatctactcatcaaatttaatgaaaacatctgctgccattttgattagaattgcattgactgtgtaaaactatatgtgtgtaattgacatctttacaatattaaatttatctatatttaggtttgctttaatatccccataattttattacctcacttagagaggtgttgtgtttcacataaaacctgaactgctaacttggatcaggaagcattgtgtctctcactctcatttccctccagtctctgacctttgctcaagacctctcatgtgctgtgttttccctgcctcaggttcattgtatatagaggtcttctttgccagaaagcccatgtgcctgctttttcgtggacaaatcattttattaaacaccttctaccctcttagaaaggtgtcctatcattgccctaaaatggactttccccacatcccgttattctctaccattgcttctcatctctacataatatgctatagacaatttataataatcacatatttatttgtgcctctctgtattgtaagtgcatgtgcgtgtgcgtgtgcgtgtgtgtgtgtgtgtatgcaatcccttatgtggtcccagtaagtacaaatgtattaatttataaggattagggtgattattttgggtggctaaagtacagtgctagccaagctcttcatcacatagacatgacctgtgaaatagacaggaccctatgaaaactcagggacaccatctcagattctacaataatctctacccatgcaattcaatttcctagccacacacttgctaaagctatgagtcttcatttgtaagtgtattccaaattctagagtggtagctatttccaacagacagaacacacattagtacttgcctgatgactaaaactgcattgcaaatttgaatcaaatctataggacttcttaatgtgtatgttcatgtttgtgtgtgtacatgtatgtgcaggtatgcaaagtatgcctggaggccataaggtgatgttgtgtgggtttttctactattctctaccttggtgtttgtttatatttttatagtgcttcttactgaacctggagctcactggtgggctagactggccggcccatcttcaactactctggtgctagtgtcccaccccctgtgccactatgcctagaaattagagctaaaatctgcatttaggaccctgtgtttccatagtagccacgagcctccatatgagatatgaactgagccatctccccagccctgagtgcttaattttttttaagtaatataatctgtgataatattagtggcattccaaaatcgcatccttctagtcagggggaattaggaagtgactcctatgtatactctttcacacaccagcatgttataaacaggtccgttttctttctagacaccggtatctctgatatgttgatgatcctgtttttacttttttactattccaacacgcttccatttcggtgtaatccactttatctcatttaatggttctctgacaacatagaccatgtcttactttgtaatccctttatttggggatgtgttgattgatctttctagaattgtagaacagaactgcggagacataagagtgaactttctttaaacagcttggtgaggagagtctgaccccttgccttgcttccttccccctcttatagattcgtcagcaggcagtgagcacaaacactcgtatgcttcccattgattgcagaactgtgctcaaaataatagctctctgcgttcaatagaaatggatctaagggaggagggtagaacaatatgtccagatagggatggaaatctataaactcaaggttagaagtctaggcatggattgctccttgttttacttaactttcagttggatatttcctaacgggagatggccaagatgtgtccttgttttccctaatgcccattcccatataagcactagtaatccaacagggaatgctcttccccccaaatgggtggggcctctgaacttgtttcctcgtgtcaagacacctgaggtggttatttccagtcagatgaggtcagcatccaggatgctgtctgctttcagagagttggtgtgtggcgaggtgaaactctaaagttatcagtctatctcgtggaagctgtttttatggcttcttgttttgtttttattgttgttttgtcttaattttaatgttctatatagtatgtaccagtgggacttttgttgttgtttgattgtttccttgtggagacagagtttctccgtgtagccctggctgtcttggaactcactcgagtaaagcgggctgactttgaactcacagagatcctcctgcctctgcttcccaggcactggatataaggcacgcaacaccactgcccagcatgcaatggaggtttgcctgcctgtctgtctgtctgtctgtgcgacatgcatcactacagaggccagaagacagtatctgatctcctggacctggagctagagacagctgtgagccatcatgtcagtgctgggcatcaaaatagatcctctgaaagggtaaccagttctcttaaccactgagccatctccccagccacatgcagctgttcttataataatttgtgcatatctttctcagtctaagcatatttcattttcaagtacttttttgcaatagttataatctttatggactttgtcataataccctcaggggccttagaattatggaccaggaaaatgagacagatatgaagctctgttaaaagccaccagcactatagcctactctgggttgtggatatccaatgcgaagtatagcaaaacaagacctacacatatcaggatcaaagtcactcttatcttacggttagaactgcaattagaatcaacatggagagtcaatgggatcagaagcattacaactgaattgggcaccaggctgtggttcttgatgccaattcacagcaggatccaagcctgtgagtggaggtacagagagcatgtcaaggccagttgtgtttctgtaacctgctagaaaggaccactcgggactcactcattgagacgccttttgcccagattccaggtattgagagaaacctttgaccctaggtaggatatggttaaagttgcccaggaaggcatgaagaaaacagaaactaagaagagaatccatgaatccccttctccctttgctgttttccttcctaatacagtgtgactctgcactttttggagccctttgggccatgcttcatgaaaactgacttaggaaaatagtacatcattcccagcaatagccaacggagtggtgacttttcctactgatgtaataagataccgggacagaaaattggagagaattgattcccagtttcatgatccagtcatgaaagtcatagccacaggagcccacggtggctcgtcacaccgtgtgcacagtcagaaagcacagtgtgaagggcactgcagcccagctgactttccccttttggttcagtctgggagccctaggatgctgatgccctcagttaagatgggtcttttgacctgtttacctcatctagaggatcctcacaggtgtgtctagagacttgtctcccaggtcttttgggatcccatgactttggcaagagtaagctttacagacatgtcattagctagaggtggcactcactcccttttgtcattttttttttcctactgagtcggtgtgctgtctgcagtcttaggatccagttctcaatactgaagcttacatgtctcactgtgtggaagaagggggtggggctatagaggctttcctgaagaaggggctggaggagaaaaggccacccctgagcacatcatgcacactcatcaggcccgaggatcaggaagatgagcatatgtctgagcatctcaggatgtctgaaggaccttgtgtgagcatccttttctgtatgctccttaactgcaccctcattctagaatcttagctttcctcaggtaatctttatattatagaaaatttagatattagagaaaagcacctataattcccccaacttcaattattttactttgggtttatctttattaatatgcatacattttactaacaacaattacataaaatttgttattgtaatttttcatcaagcattttatcacaatcgcgatgcctttaaagtaccatggaaacagtttatctttttttaatgactgcataattgtccattgagtgtgcattccctaacttacttttccatccctatattgttttcatgtttcagatacccatatgataaaccataggctcatggtagcaatgatgaaaaaagaaacatgacctccaaatcagattaacctgagttcaaaccctgattctaatactacttgaggatctttgaggcaaatgaacatctttgatgttaatttattggcttaatgtattaaaacagtgtctaggcaaagcaatcttcaaacccacagtgcttaaaaaccataagagttagatatattgttatctagctgccaagtgtccattcaaaatcatagctgacttttttcctcctctgggtaatgtgttttctatgttcaacaaccatacacacaaacatacacactacacacatacacacatacacacacacaccaacacacacgattataggattgaatggagtgagtacttcttgtaactcttggtacatattgccaaattgctctccaagtagattgcaccctcgtgaacatgtgttttgagtcttgtattgagcttttatgccaatcaacgagcctgggaatcaggcctttggcagcccaccagagatttatgtcagctttcatgataccctcagagcaggctgatgcgtgaagagatcattacacatgttggcagatctatttgcactctccaaggacgtgctaggaacactcttgcctcatcatcttctgttccctccccttttccttattccataaagcagaaagtaacatgtcaggcttccagtagtatcccaggggactctgacaccctatggaaactctgagctggataactcatggctaggttactacagcatctattattaatttcccctctgctatatcaccagacatgcccatttattgcccttccaaagcttcagagaacttatcttcaaagggaatagcagctcacctctaagtgtggattctgtgttcctagaaatgtctgtctcatggcccatctcagatctcctgagagctatggtgtccctgtccctaggtcacactcatttaccttacagtttgacaactgcagtgctaaactagcttccagccaagactttctgtcataccaggctgacctcagatttagaaacatttcctttctacttcagtattcttctaccctgcagagagtcttgggtcagcaccagaaccaccagtgcctccttggctgaggtgatcaaaatcaactttctgaaacattgaaaataaagtcactctattgtttaaaatccaccattgattccagttactctttagaataagatttcaactcttcttcgtcatgactaaggatgctcaatgagtgttccagtcctttatagctttctccatgcctttcttccatttatatattccacacagtccacaggtttccattccagccatgtcacattccctgctagacttctctttatctagaacatcatagatatagatatatctataccaggcaacttttattgtatcctctgtactctattaaagaatctcacactttgtacttccatactacctggatcaagaggtcatttattgttttataataacattttctaaattctgtactgtgtttctttacgcctacatctgttagcagatcagacatctgaaacttcctggaacatgctctgttcattgttaagtctcaggacctgtaagtattaggtcattcatagttagcagttgttcctgtgtccttccaacttgctgtcccttgcagaagattgactcatagttcctgctgtgctacattcctttcttgcttctgttcctctggacccattccctgcaggacccaggagccctatctttgctgtgttatgcttcctcttaattggaaatgtcacagatcctctcaacgtccccttccaggttctgacacctgtcattccactcttctctacctctgttaccttcctcttccactgggctctactgttttcttcaaatgacatataggttgtaaataccactcaagcccattggtctcagttattcatttctttatggaagattctgttaaaaaccattatcattaccaagcaattatcttatttagtcctcgtaattggaaagaggaattaagttacctacgatgtcaggactggtgtggccagattgagaggaggattctgtatgccccagtaaaagtagcttcatcatcatggttcagtttgcaaatctcattccacttgaacacttttgcagctcaatggaggtattcagccttgtccctccccttatgcaactgaatggcatgcttgacctggtggctttgggagggctctgacacaaatttctgacacaaatatttgccttctggtctgtcagcttcaaatagaaaattgcagaaggcaaatttgggataatatttttttcattactgggggaaagtttcccattccaagtcaattttgaaagataaaaaaaaaaatcatttccccacatctgcacagtagatatcaaaacaggcagtgctctctgaattgcaaccacagcactgcataaagtttctccttctcaatcagttattaaaaagaaaacaaactaaacaaacaaaggaaaacagccctggcctacttgaatggctccttctctcttcaatagtttagtagttcagtgactatgttccatttgcaacttgaatttggatagtgaacactgtgtgtttaagctattcaaggcgatgtttcccaaagagttgtcttggaaccctggtacacacttgtggctcagggtttttaatgatgtaatttttgagtttcccatcccagatttatatgttgaaacctaattcccaaagtggtagtgctgccaagtagtaagacctctgaaagactaaagagtaagtagatgatcaaggagcttccccttcatgttagcattaggttctttataaaacgtttctggagaagcttggtcacactttatgccaatattgacatagctggaaggcaccatctataaggaggagaactcttagcacactaaatctacaaggactttgtcttcagtcttccagctcccataagtataggcagaacatctctgctgcttgagacgactcatctgtggtagtttggtgtggcatccctaacagactaagacagaggtttaaaagcttttacctggaaaaacacttaaagtgaaataaacggtttgctttatttttgcttattcttcaacttccaaagttcttttagtaaattgttgccatgcagtagacagcatgggatcagcagaggggatcaggagggaagggagaagggaacacattgcattccaggcaaaggacttccaacccagccatgaagttcctgagcatccaaagaaagacaggttttctccttcctgagatctactaaatcagaaactctaaagtggggccaggagctaggaattcaggagataggagtgcaggagattctttgtgcaggtgtatttgagagccactgtgggaaatcccagtggcctgaggtctcagatttgcttgggttttctacttctccaggagtcccatgttctcccattgcctgctggggtttctccctctggcattagctatcatgtttctaagagtaaattcaaaccactttactattaagtccacctttctatccagcatgttttctgacatttatgacctttgtgttttgtctctgaatacctgttttatgctgtgttctgccaatttcaaacagcttactgctgccatcttcttttacctctataccttcatgcacattaatacagtgataaattgcttttgaggctcctcccttcagctaatgactgtttcctactccaatcaactcatctgaatagttcattgctgcctttctttttatttatcatgctttattgcatgtatttgacaaaagtgcatctatttaagatgtatatacacatacacacacatatatatgtacatatatatacatatacatatatacatatatatatatattctcagatctggttaggtttaatatattacatattatatatatcacacatatatcatattatatgtgtgtgtatgtttgtattgtgaagtgactaccacaattgaacaaattaacatatatatcccttcaaacaaatatgattttttgtgtatgtaataaaacccaaactcataaaggcaaaggatagaataaaagatttctgaagctttgtggcagagtgcttgcctagcatccatgaggttcttggtttgattcccagtactggaaagaaattaggttgcctaccaccttcttcaatcagattttgcattccagagaaaatatgccattgcaatgactaacttgcattaaactactgtgtgtgtgtgtgtgtgtgtgtgtgtgtgtgtgtgtgtgactaaacttcaaataaaacttatattcatcaatgtttccccaacaagtagaatattcttagtggctcctagtgatactcatgaatgcatgacacctgtgtgatgccagtcgactttcccccaccctcccctaagtcaaacagaagagctagagaggtaagtgataaagagctatggataagagaagtgcctcttttgactttctttttccacattatctgttcatccttgtttctttgtccagattcatcctcttccatcagagacatgcacatctccttaatttagaattcaatctggaaccagctcctggtgtaataccttcatgccatcccgactcccttctgaattcttgtcttgaaaagaaatatgttgctaagaactgttttatatttgtgtccttatctggagtaaaaagcctatagctacatggcaaaatctatttcatgaagccttgggcactgcactttatatgctctgatatttgtcctctccccagagacagacttgcagtgacacaaattaatcatagccgcttcagctacatgttttaatgagtaaccaacccaaattagacacagagatggtcatgttatcttgaggtcttaggatttagatgtggaacctttcttaccttgttccccaggaaatcctatcagacaggtattatgctgtcgcagactgaaatggaggtaaaggctggcaattaccagccctgttgttgtcttctgcctggaacttgggaatccactggagggaagcttatattcggatccacgggagtccgaggatgacaatacccatggtataaccttggacttactatccaggctttgttaagtttctttcagtaaactgagactatgtttttgtccagagaaagtgcacctgtgacattagactccagcagggagaagcaacactttcattgttgaggcttggaaaacctcagctgtgcaaagtcacagtaacaacaaaactgtttttaggagtaaagaaagcagggctctttgaggatggctccttgtgcgtctcagcaactgtgggctaggttgttgttgcaggtgctaactgaactaagattgatggcgcaggggtgctgttgaatggaagctttgggcaaatttttgatccatagtaacaagttagccatttatattgatacaatataacaataacagcagacaatgaaagcaatcccagtcacccagactctcccatttttctttcttcaagtcctgctattccttgtctccacgcatatgaaatttttatgtacttgtaattattgcatctttataattttaaatgcttttctctcacttaaattataccgaagttataacattagcattttaatggccacataatgtcccatcaagctcactatcacactttatttaaccatcccccgtgacactcacgtagcctctggtctttaccccttgccaatgagatttccatggacatgtccaggaggtttttttgttctagtatcaaattatttcctttaaagaactttccagggctgttattctagtgtcaaagaacataaccatttggtatttctctgggttgctctgtgcccatcaatatcacgtgacatcaagcctaccctgaaaaagaggcctgtaactgtagcccctccatcaggaagtgaggtaaggctagtggatacctgggcacaaagtaatgtttgagactgaaagttggatccacgctgaggatgtggtaggaggaacaatggatatcataaaaagagaaaacacagtctacttttgctataagctatggacattgctctactctttcttctgtccctttctttgtttgtaagtgagcaaaatcttagtggctgaaggttttgatgcactatgagaaggaagcacctggcataacaagttctttctttatatcctttccttaatacgtacttgagctgtgtgtacacacatcattagatttgcagtccactgtaaatccagcatggtcctctctaaagacccttaattacatctgcaatgatgcctcttccaaaccaggtcccattcactgaaaccaggtcaccttcactgactcaaattggacatatctcctgggacccatccatcatcccattacccagggcaacttgtcctttgacaaggtgtatgtggctggggaagaacttggtggaaaacgattgaatatgtccatattaggagggtgagcggcagcccattttcatatgaaatgggaggtaattagacccttggctctgtgtgggtttatgcaaggttgcctgactccaaagggaatcaggagatagtaaaaagcatgcctggtggagtaggaacagatgcctgggctaatgttgacccgagtttgggagagctatgtgttacctagaggagtaaagcagtcaggctcaatactaaacacagagccatcttttctactcttccaaatctctccctgtttcaaccccagacacaccactttatactgggaatgtcacacctctcagcaatcttcaatcccaagtcctggcagtagagggaccctaagagtcctagaacctctagatctttgaaacaggccacatagggattggcttcataaccataaaagttctgtccatttcttgaggcacttattgctctgggcatatactagagtatctttcaaaagttggataatgggaatagtactgctattcctcagagtactaaggccactagctgaggtcccttagcagttccagtgagatgacaagaattcctctgtcaagtaagcataatgtagaaagaaaaggaaataccaaaatataagcagctactcacccagataaggagaattgaggctaattcttttccttttacctcttgtgttctctgtctgtctattggtctatctatcaatctatctatctcccacaaaagcatgaattttgtttgtaattagagcaaagaagtgtttgcattggggcaaaggaatgtgaagacattagataaaacacaagagctcagagctttatctgagcagaagccagctcagtgctcttggccaagataatccaaggtggagattcaataagaattggattcaagttctcacataaatgtgttcacgcaaggaccctgccttagcatcaaagttatgcccattggtaaccaaattatctgtaataaccaaaacaccagactgtcacacatatgatgtgcaaacttgtattagcatgcaagggctgccatcccaaaatagcacatgctggatggctttaaactccagagatgttttctccaaactctgtaggctggagttccaaagtcaaggtgtcagctttgccagattcctccaagtgtagcagggagaatgtgcaccatgcctcctttttatcttaatagattagtaattataaaatttatgattatttattcatttgtgtgtgtgaggggtggtggcacatgtgcataagttagagaacaagatgtggaagttgaatatctccttttagcaggtaagacccaaggacagaattcatgttattagcttgaagggcaagttccttttcccactgggccatcttgctagattagtaacttttaaatatatttaggacttcatatattatatgcctgtatgtaatatatgttttgatcatatgcaccttctgcccatccccaaatttcctcccagactagtggatccctactcattcacactcttccaacttcatggcctctcattttctttcttagaacccactgatagtgtttcttaaatatattccttttgttcaaaagaaatagaaacataatatacttcatattagtctgcagcagagataactactaacatactgtggtcaaaggaatccatgccaattttttaacttcccccattgccagtcttggcattccttggcttgtggccacccccacccccccagtttctgtctcatcttcacttgcctttctcccatgcatccatctcttctgtgcctacttcttctcttcatttgagtgctacttgtattgaatgagggacctccatgatgtccacattttaaccttactacctagaaggacctcacttcctaaagcacatagttcaactgacaatgaaatcccactccaacaattcccttcaggttcactctggggcctatgttagcagacagccacgtgtacatttgcagaacgacttcctttgtcttcagcctcccttgcatccagccacacacttgttactacttctgaccaagacataaacactcaccagtggcgtgttacacttgtctttcttgggtttccttgtcccttaaagcttaaacatctcctttccacaaggctcaagcagcagaggagtggccaacatcttgtccacatattctaaggaggtcaacacatcaacttgcatcatcttaggtcccagtctgtctcacctctgcctatctctcttggtccttgactgatacttaatgtcagaagaactgggaagagaaatgatgtgtaattgcatacaagcaaaggctaaaaataaattgacaagattaattctaagaggcaggcagagaggaagaatgaagagagagagagagagacagagaagagaagagagacagagacagagagagaagacagagacagagacagagagagagacagagagagacagacagagagagaagacaagagggaaaggagttatccacgggactggctttgagttctaaagtttacatccaaaccagggatgggtgggtgattgggcatagagtggagtgacagggacagagacacaaagttctaagaggagatggtttgcttcagcgtgatgccaagacaagaaatgttccaatttcctccaaaattctaactcctgctgtcctagcaattgcaggcacctgtgaggtcactgctcatgttcctttctgctcagatccattagatgcatctacagaggagctcggatcttattccacccctgatgaatgtgctctatctcagccacatatattgggtgagacagaatgacatgaagtagttcgaggccatcatagtgaaaagcaggctcatcatagtctccctgtggagactatgggaagatcagtcattcattctttaacttgattcttcaatgttcagtgaacacctatggacagcaaactgtctcagggagctaggaaacatcagtgcatcagtgagccaattagacaccaaattctctcctccagaagctcatgcttcagtttcagcaggaagcatctctcacgaaatcttggtgagccttttccaaggcagattggtagagtattgattgaatggcctccacctttgtcacaccggatgtttcctcctacaatggagttgagaatagtctatggccaagacttcaaaaccaggcagtcctagtttgatgctccaactcatctagcatcattgagtgctaccacagtctgcagctgagaccccagaactctttgtttccaccagtataatctgcattgtctctgatctcatctgatttagacattggttccaaggatgagctgatggctctattcttctcattcctttattggctgtaaaccacatgctgattacttttgtcattccccagtgtttttgttaaatcatttataccttgtttctggaaaggtttcagacttctgttcttcactgtaagggtggaatattaagaaaagagatgaacatgaggtgttctgttgtccttagtgtgtatctacaccagacctgtgccagttctgtctcttacgccagaactttccaataggaaaatactgtgagccatgtttgtgtcttaaaagtttctagtgtctgcactaaaacataaatgaaagagaaattaagaacatttattttaatcatactttacttaccacatccaaatagtatcagttctatgtcattaatataaaaatgttgataagaaactttacattcccttcccttctttgtgctaagatttaaaaacatggtgtgcattttacacccatagtacatttgggcaaagaataaccacactttgaatgattggtggtaacatttcaagtcctcatttgttcaccatgcacgcaaatgtcagctctagtttaatgagagtaaaaaaaaaatggtgatttgtataaaaaccatggggcccctttaatggatcaacaaatgttaagctcttccaacttttgtattatttatccattttgagagtgttaagaaggggccaaaatacacatacgcatttaacacctgataaataacatgttcaatgcttttattagctgatgtttcctttgccattatgacattaatacttccattaagatcactctctttgatggatcaaattatttcaaaagatatggagaagccttcccatttacacctgtgggcctgtcttcactgaagaatctttatggatatattaaaatcataattatatcaccctgctgaattatggattaggttgggtcccaagacaataacttccatccatagaataatggggagatttgaatgcaaggacagacacattgggggtgaaccttgtaagaagagaggcagagagctatgattggtgcttcagagaggaaaggaatgtccaggattcctggcaaccaccagaaaccaagaagaggcaaagcaggaccctcccctccagccttcagagagagcctgatctatagaacccagaagttccagaaaataggtttctattggttgactgcatttgcatatgaccatatcttttcttagcttgctgctacccttctctcctcccacatgctcctcatcccattccacctgggcattggcctccatcattactgtcacagcgctgttccaggtcacccatggtttatactccataaaaaccaggctctcctgtagagttctggcccctggtacaacagtagtagatgcaaatctaaggaagctgatcagtctgcaagattctgagctccatgggccacagagtcacagagcttgcctctgaatgtcagtgtcctcctcagcatgagcctaaacttccttatagatggacaccaattgtatggtctggccaagaagatttccaagggatttgtggatgagcctcccaaaatgatcgttactatagctgagcctcacaaaacgatcaggtggcttgttccaaaagaagagaaggaaaaaatgaacagcctcttttgcatttagcaggaaatggaaaacaggaaagagagaggggtctccatgaagtgggtgaagcaaccagcagcaggaaaaggtaggatccaagagggccagagggtgtcaggacaggaatctggctagcctgcctgctgtcacttcagacctggtgactagaaaccactccctcaatctgccagatggaattggagcttcactccaatgtgaatttgaatcactgtacaacattgcaatattttatagtaagtgttcaactctctcccaggactgtttgatagaacttctaggtggactcttggccaccttttctctttctgctagggtatgggtagatgacctttgtcattttcactggagcacaacgtcatcaagctgatacctctaagtctctatcaaaggaagaagtaagataaccccatagcccaacaaataaagctgttggtagtcattactcctattgaaggagtatgttattcacagcgattatcgtgtagagttgatcagataacacactttctttagcttggtgttacatcaaaatcccttgactcacattgttagtgtttatcttacttggtgactgtgaaatatttcatcaagctgacaccctaatctgcttacccaggcctctcttattggatacagttaccctaaccagatagtgcttgtgtctctgtaacttgtggatcaagagctgacaaagccaacacagccacagtcagcttgaattatgcataggaccaggatttcattcatttaatttcagggcagtgtggtgagtagctcacacacacagtgagtagaaaaggatttttttttaatgtaaatacttggatttgataggcttgtgtattattcattgtaacaaatatctacactcctggtgtcttaaccatatgtgtgtgtgtgtgtgtgtgtgtattatataactatatataatctatatgcacacacacatatatatataataacataaaaccatttctaatccttctagaagtcagagcctaaatcacattgccaatgggactagcttttctgtgacctcctccaagtcccaagtcctgcctgtgaccctcagtttcttttgatttgtgaataaatcagggcaccttgtctccaaggccatcttactcccttctgtaggtttcctttttcccatggaaggatgcatttcactggattaaagctcacctgctgtggaattctctcctcagaaattcataactcactagatattctcatgtggttatttttctagataagtggtagagaatttctgtgaggttgtaatagaaatccccagcggatttatatcatacctgcgataaattcatagattaacttagaaagaattgatactatttgccagattgaatttcttgtggccttcataaacctttctccatttctgagtaggattttgtggttttattcacatcgtttcttcacgcagttatgcctatttcttgttaagcttgggcctatcacactgtttcttcacatggctaagccatgggactagctaggcatttcttgttaagcttgggcctagggttgctcttgttttgttttgtttttgtttttctgaatttttttctatttataaaatttcccttgctctaccttttcaaattgatcattatttccattgcatttcttgtttattccgtgaagctattagctttttatattaattttgtaaccagccactttggtaaatgcctccatttcttttctagtatgttttacagatgtttcactatggctgacttgcaaacaataatgatttcttaaaatttcttttttaacagtgagagtgccttttatatcaatctctagtttaattgctttggcaattatatctggaatagaggacatttcctcttgtcctgagtctaatgtaaaatgcttggattatttcaacattaagcacgagaggaagatttaaatatgagatagctttttcttttatcatgttaaaatccagtcatttatttccattttaccaaaccttttatcagggatggatgctgaatttctttaaaagcttttttagaaaggcatctattgatattcatctagcaaatatttggtgaatagaggagacaggaaataaagtctcttccttcgtgaaaagtgatggtccttttgctagcgagaagcaaattttcaaaggacacagtccatgtgagaagggtgcttctcagaggggacgccatctgcagaggaggttggcatgcagagccttgtgggagctgggaaatctattgagcaatgagatcaaaaattatcaggagattgtctctgtaacctttatttgggctttccatttgcctttcaggaaaatttgttaattcatgttttttgttcgtttaggttatttatttacttatttatttgatgttcgttaagaatagtgacgaagtcgagcaaatattactgcaccctgtcactttaagtttatttttctgtctgattacttgctgttgtttcataaataattttgtgggtatgtttttaaattaagtttttcaagctattgttagaataaaatgtacctttcctaagagcagtttatcatgggataatgtcatgcccgctttcagtataaagtcaaagaagtacaaccaatatgtaaggtaaaacatatttataatgtccataaatgttccccgtgcctttgtagtcaacccctccctcttcctggccctggaaaccatggccctgacttctgtccctaaagtttttcctctttcaaatatgtcatgaatggcatccctctgtgtgtgaccttttccacccttttctttccaaggccacacaggtctcaaggttgactcactcaggctgttgagcatatccactccatgttgtctctcttttctttattttgtccatctctcttgatacctgtcaggctgggttaatcaactcttagatttgttttattctgtaatttttcttcattgtctattttcaattgtaattcttttgcatctctttcttttgccttcttttcttgcttttttttttgttttatggttttttttttttgtttttctttttttgttttgttttgtttttgcttttgtttttgttgttgttgtttttttctcctgaaaacttcacatagttgtcaaatctttctctgtttctgtctctgcatctgcctctgaaggtttggagcccattaagccacttctctggttttcagttttgttttagtttctccctatgagtatttcccctttagatactaatttggcttatccagttctaggcatagttagaccacctgaatgttcctttccaaaaaaatgttctatgttctcatttccctagtatctttttctttgatctatggattataagtaacatttgtatgaaaaattaaaatacagatagactttccagatgtatctcttttgttgctttttacttgagatacattgtagtcagaaatcacaccccacctgatcagggttcctttcgattcctgagatgtggattgcagtacagtatacagtttctctgggtgactttgtgcagtgcaatagaaaggatgcgcactctacctttggcaggtggagccacttaaaattaattaggtgcagttggtttatagctttgctctgatcttctcaaacttaatgattttctcttatttactctatcaaatttcaagctcagttgtggctttgccaatttctattctctactttgctttctgcatttccagtgctggacatctttgtattgctttatatagccctgttaccatgtgcatctatatactttatattcttcttcttatcagttgttagctcctgaatgctattgtctgcaatgaggctttgttttaacaaccttgtatatttctcttaatgtattcttctcctaacttctcctttgtgaatttctcttcctgcttgcctaagaattttgttatgcctttcccatcaaggttttagtttacatgttttcaataatttatctctactcttttggttgtaatgaggcaatgcaatattcagttgtggcagtaaaacttagatttttggatgaaacacaatagttattcttttctgaaatatctagaatgaactgtgattttgacttctttgaatcaaattttgattgtatttgtttgtgtatttctacattcataattttttaaaacttaccaagtctcagtcagttattgtctgatctgtttttagaattaaccgacttttctgtacgcccaagttggagtattgtgatggcagctgcaggcaataatggacaaatgtgtgtcacagtattttaacaatactttacttacaaaaatgaaggaaggcaggctttggttcctgggccaaaatcaacactgaaataaagaaatcaattatcctctaattcttagttctcttctgtttcctttaatttttattattctgaagctaaataagataacaaattaagatataaccacagtgttgtggttttttaaaaaaaacagtgtaattattattgtttacggttttactatgctaaagaaggatgctttcacataagtatactttggatatataagtatactttggatatcaaatgattccacagtttcatattatgtcatcttccattaaatgacttccagcatcctgttaatgcctttatagcataagaaattgttaaagcctcagtttatacaggcaaagctttcatgtgaccttacccttgactttagtccaacgtttcattgtgctgttacagttcaatgacagttgagatttactagatcagatctattagtggtatggtttcaatgtatttctccctactcaaatgtgaaccttagtcattgatgtgacagtagggaggcaaagccttagaaaggttagtcatgaagtattcctatctcatgagtcagatcagcacttaggaaagcaatatgaaggagctgtttgctcctgcttctatgtgagaactcaacaagaggagccatatagggaataaaagagtagaccttatccaacgcacaccacctccatcctgaacttcccagtttctactaatatgaagacacacatttctcttgtttataaattacccagtttccagtcttttgttacagcagcaaggcagatgaaggtgatcacacagatctttcttcttattctttcatgattgaaagcttgttgattggcatgatcattggacaatcaattgatctttaatgctttgttttgtagtttaggggataaaaccaagggcctcgtggttttaaacaagtcatcagatcccttttacatccccaactctgttattgggtttagttctgtgatgattcaatgtatagatggtaaatgacatattcttaacacaaataaggacttcaagacacatttaacacaaggagtccagttttccatcaaagggaaggggagatattttacatttgtaccttcaagattccctaaatacatttcctaattttgctagctgcaaaatagatatttttttcttaagtatctcaagaaaagatcatctcgaatatttataaatctttctcaaataaaaatgtccatgggttcaactgagttaaaatagcattctagttactaaatgcattgtcatagagtcctgaaatttctattctgttccaccaaattatttcttgtgcttgggcagacaataaacttttattgtcactttaaagagaaatggtgtctccccctactttccatagtgttctggatagtcttttacatagattgtttcacatagactttaatatcacctggaagttaatcttatgaaagaaaatcattaggattctgaatgaaattctgatccattcatgtactgacttcggaagtattgatttatttacaatttagagtcttctcattcaaatgtatggcaatccccaattcttattttggatcatggccataacttttctatttacaccaattctagccaaataaaccattgctatataaattccaatagttttataagctgcctcaaagtttctaagtttataatcacaccatttgccaatgcattcacatatgtatctgctgtttctgtattttcctgagcattttccttactgctcatggaatgcattggcttacgccatgagaataattcaaaataggaacagaaatgatggccaatctcattcttggctttaaagcagcttcaatagtttacatcttaaacctgacatgtactgaagacgttttaaaagcctttttttattctcgatgcccttcaatccctgttttagttaaagttttcattacgtgtgtttaccggattttatctggttcatcttgacaaatacatcaaagaagacttctgtgacaaataaccaagctctcttaactcaaattggcctaagctttaacaacaggatatgttggcagagggccagcttgatagaacgtctcaaactaggtcaccaaggtctgataactcttacagactgtcactgtggacacccaaggggctgcagcaattcaagagtccatgtaattcatttcaaatccagggctagggaaagagctggtgttcttgctattcctgaaaagtgaccatgcatttcactcacctcaatgctgtcctgggcttatctctgaatccaaaaagcagttctaaccagggggaatataatatactgattgactcaggtgtagatcacaagccctaccctaagttgggtacagtgccttcttgtctaagtctgctgagaggagaggggcaggtacctctccagacaaaagctttggtgtcagttaccagagtgagggaagagggtggctcaatgacatgacatttcaatgtctattgattcaaccagatggctttgcttattattctctggttgtaatgcaagtgctgtaatatattcgctgattgtgaaccattcctgcagcagttcttgcttagtcatggtttatccttttgatgtgctgacgaatgccctttgtttaatattttccatctgtttcataagacagaattgatgtctcgtctaatattttgtcttgtttgtgtcatatcttaagatcatctttgatgcataaataaatgaagaatctttgatttaaatggactgagaaattttacacattatctgcacacaaataaggatttacatattatccacacactaataattagagttgctttctttaaaagatatgttttaagtaagttgggaaaacaggatctagatttgatgggatttggtaaaagatgtttcaatgactttttaaaccaattctgtggtttttcatcttcttggttgaattttatttccttttttgtctcaggaaaaacattactctctagttttcaaatttgttgctgtggggttatacataaaaatctctttaaagttataaatgcatttaatctttttcctacttgtggttacaatgtcctttcctttttaatattttatattacactctttgtctttgtttcagccaagcttcattttctcctcaaaggccagctttatgtcttaattgcctctgtattatttgtcattgttttaagtttgtgtatcctcctcattttatttgttttgttatttttccttaatatgtaatgttgaaatccttggatcacattcccttggatttatctttttgctacttctaggtctttgggcttgaaaatgtctctcttcatttcctgggtttagttcaccttgtcagtgggatattctatatgatcttgggtctgtggcttaggataaagtttcttcacgtactaaataaataaataaataaataaccatggaaagagtcaaactgtgacttgtaaaattgctcctgtaacagattgtatagaaataagaaatttaaacgcacacccatgcacacatgcagagcatttatgaatatagttcagtgtacattcagttaaaatggtcactgtgccctgaatgatgctttgctgcataatgtgattttttttcccttgatctctgtcttagtcactcactcattgctgtgacaacatactctgaaaaaagcaaagtaggagaggaaggatttgcttgttttgttgttgttgtttttgttgtggttttggtttagtttttttgttgttgttgtttttgttttttttagcttagttccatagggatacagacaatcaaggaggataagatatggcagcagacaggaaaggcatagtagcctttcaagtcttcttcctcctcctttttgtttatataccaaataattttattagtgataagacactacattactcaataaacattttgttgtgttcaatatgcacatataagaacctcatctctggtaccagtatccctctagataaaccccatgccttcttcataggaaatctgcaattttttattagatattttctttatttacatttcaaatgctatcccctttcccagtatcttctctgaaaatcccctatcccctccccactccccctgctccccaaaccacccactcccacttcctggccctggtattcccctatactggggcatagaaccttcacaggaccaagggcctctcctcccattgatgaccgactaggccatcctctgctacatattttttatatttagagccatgagtcccaccatgtgttttctttgattggtggtttagtcccagggagctctgggggtactggttagttcatattgttgttcctcctagagagctgcagacccctatttatctatagttttcattgaaagcagttgtttctccatatgatgtattctggaagaggaggggaaagtaggggaagcagggagtcactactaatactaaggggcatttgatgggtcacacagaaacctattactatagaagcttcctaaactatatactatacttatatgaaagaaatcaaaatggagtcaccaaataataagagagataaggccccaactagacatctcccatcaccaaatgaaacatccagtgccagaaatgggttaaatttacttgagttgttggcaaaaagggcctcatggaaacccctgaacaactcaggctgccctgaagaacttgccaaggctgttgattgttctctacaagctgatggtaaggccccaatcgctgaagataacactcccatatcttattggacatggaaaattcctgatggtgcctaactagagccttcacccattttcggctgttcacatttgctcacacactctggaagcagaggatggacagaaagtagaaacaggctataaaacttcaagaactaccctctgtgactcacttcctctagcaaggtcccacctcccaaaggctctgcaacctccctaaacaatgccatcagctggggatcaagtactcaaacacatcaacttatgggagcatttcatgttgaaaacaacaacctttatatgcatattcatttttattccatctacaaagtgtaaatatgataatgctttttaactgctaaaaagattaaaatctcacgctcagctgaatttaccaaattttcttcctatttgcaataatttttggctcttgtgctcttacatatattatcctagttatgtattacaaatgtgttcttcatcccccatggctgaaagtttcttgttactttagatctttcacataaagaactgttaagtccagagacattcttcaagccatggagaagagacttgctgttctaagaagttgaaccctgaggtccccccaaagtgttatccaaagtcataactcttgaatttgatggacatggccactctctaacaggccaaatacttgtaagtaagttcactatgattgaattgttttctatgaaactatcaacctagctcacttaacatgggccccaaatggaaatcacaacaacagtaacaacaaaaaacagttcctgttttctaagaatagttgattgagtgttgacaggtgtgtgaaggttagttcttcattcagtgcaaggacctgagttctttctggcatcttcttgatttctcagggaatttcagtgcttggcaggatctgatgggatatctctaagtgagaaagagtgatggatttcatatgtgtcttttgagccaggatagaagtcagatgaccctttccacctgtgttccagtagccatgaatcatgcatatggccatggctgagggaagaactttgtctaaaaatatgcccagaacaactgtgttcagtgaacactagtcaccctctgttggtagagttaggtagcgaatagctctaagtttgaataaagaggatatagcccacatgaacccagatcaggatggggctccaaagtgggttttgatactgagataaaatcccagatggcttggaatgatgaagaggtgggctcctatccaaaaggacatgcacagtctagtatggctataggcaccagaggcaatagaatgactccctatgtcaaatgatgaaaacaggttgcctgtaccaatagggcatttagatgggctaaatctgaggcaagataaaaacctggttctcagacataagcaattctttaaaggactctgtagacctgataactattgatcactgtaatcacaaagtacctggtatatttgcatactgatggggttggggctcaataaaaagcaatggacttctctaaaactaaaatttaacaccaaatgtcttaatcaatatatcaccaaaaaacttcaattacaacccatgaaacctagaacccacgttccaccttctatgaagctcttgagaaaaatgtgtatctgtggcaccataaaaaatttaaagtccaacttttaaaactcacttgcttacacaaccaaccactttagaacaacttagaattgtaaaaatagaaaaacaggtaggtaattaatacttgttcgtgatgaaatatcaaaaaaataattgaaataatttataatgtgattcacatgtcaagactgcagatttatgcaacaaaataagtatcatgtaatataagtcacatataacaaaattttgtgtcacgtgtgactgaaactatgaaagaccgggaaggggagagtaaatgaggcaaggggctaccacaggaggatatatggagttgctactccagagcaatcaaactaggacttttttcctcttcttagatatgcttcctaaattctgcatcatatacttaataatgagacaaacatgttaaaattgcatcactgtcatatccaagtattttcatattttttggattcacatgatgaagccatatttcaaatacccccacacttgggagtaatagagaaacacgtacatacatgcccatgtacaccacagccctccagagccaaagcagaggcaccatttgtaacagatgacgagaaatcacagaggtttctgagattaaatggcctctaacccacagcacacttcattcacacgtttgcattgttagaaacaagatttgtgagtccccttttttcttgtgtgcctgaacctcaccatttcatggatgctgtatataattggatataggtcattgggtcagactagatcctgctctgaactgggttaatactggagtctttggctctttcacacagtttcccttttactgtttgtaatgctttatcttccagaggcaaatgggacatctttctgaaaatgagcatgtaaatctctgcatttctcacaaatatgttggttgcctgcttgtctccagcctcttgggcccaattagctgaaaacagaccctcatctgttttgtcccaggcatggatggttccaaataatagaaacccatccacctggcttaatcaagagagaaagatttgctggaaagcatgggatgaatcccaagtctcaaatcagggaggctgtgggaaaagcagcactaacctgagaaactgagacgtcgacctcacctttctttctgtccccttcatgttccctctgccttctctgttaccctgtttcattcagtccctagtccagtcctcttttctctggctcctatgctatgtcttctttacctggactactgtaacattctgcatcccatcctcttgtaattgttcttagcctgtttggagtgagatcaccagacatcacaaaggatatggctatcccaagacaaaacgtgtgttcaccagctttgacactgacagcgtgctgcctggccccctcagccactctcctttaagacagtgctgggcatgagagttatagcgtgtgagcactacaatagtagtactcactgctattgtttaaagggttagagtttggtgagacttgtctatgttcctgtgtggtatttgatccagctgactctcattgctacctttgtattatctatgtgtgtgtgtgtatgcagatggttctcttacctacaaaacagagtgtagaaataatagattctctttacgtgatctctactatagtaaaacggattgggagaaacatttcaaaaacaacttctcactgtataaatattacactcttaccacttttcccccttcccaggcttcttaccaccctgccagggtttacaccaagtgttggcttggttctgctgaactatcagggagcgttcggaagtgatggtattcaggatggggagatagaggaagaaatcattaagttcctgggaaattaaacctatgatacattaaaatgccaagcctgataatgtttttaaataaaggttaatttacttagtattttaacatttatatttgagttattctaagctgaaatgtgagtcagccaatctgcttttctaaacttctgctcttagattcctgtcctgataaaaagtagatactatgcttctgagccagaaagtggtggtggtgaggtatcttaagcttcgccatctccctcacatcccacatccacctccttaccaaataccccttatagcttcatctgttaagccttgcctcaactacagaaatagcccagcatagccctaccaactctacctgctcaaaatcccttcatggttttcttctctctcgggcttgaatacctagtgtgactttccaggcaccttcttctgttcccatccttgatcatgtcagcatccttgtcgtacccttaatacaccgtaaaaatctagttttggcccttgcaatcaccatttctttatagagataccctcttctacattctttctgccttttccagtatcccttatccaataatatttggtcccttgatgttgtatttttgaactcactctgaaaggggtagtcctgtcattatctggcttctcatcttgtgaatatctttctgaaatccttttcaaacacagcagggatttaaataccatctgctcttctggcagaacaccttgaaggcagaaattgtagcagtcacaattgtagccttagaatcttgcacaggaccaggaaaaggggactctgataaaaaaaaaaaaacaaacaaaacaaacaaacaaaaaaaaaacttgaataaatgaatcaaccaatcagtcatgtgtttccatctagatccattcttactagggagagggaagccatatatgagtcccatatggttggagtgatatatgcaaatcaaagtccagcattttgctaagatgccagcgatctgttgtactctgccctgtagtctcattaataaagagagcatagagtccaacccaagatatgctgtagatatgactctgactaaagatagagacatgacatgctttcagatcccattgtaggttgatatgcaactggatggtggacacattccaaagtgagcagggactgttttcttgactgtctgtaatgaccatctggattcaattgttaatgttcaatcctatttgttgctaaggcaacccagttataggccatcctcactttaccaaaggtgatattgccagcgtcatcttataagtcagatttggaaagacacaatatattttcctaggtgaaaagtgatgttaatggtgactagaacctagagaattgtatttaactcatattgttgcaatacttgtgcaaaatgagtcagtaaatatatctcatgatgcccagctcacagcaatattttggaacaatctggtcatgagaggaaaatcagcctccttccaatattctccaaaagtggtttgagcctcaggatatcctgtgtttagaccgtaatttccccaaagttgtttgaatgcctggcttatcctggaagagtttattaggatccatcattctagtcatatgcacatcaaaataaggatcttttgtgggctccagaaatatgtggacttaaagagaccccaccctggtgattccagcattctttgtgtattattacctaaacctcttcaatagctctcccgttgccccctccccacttcctcggcactggggatgccttcctacaacactgtcaagttcaaagtcacagttctataggaagttaccttatagggtaccataattccaactgatccagttctgatcatggtatacttggaagatgctgaggagtagacttgctttgctgatgctcacaggaacaggctcttccatctccactaagggagaaggctgacaacccaaacacagagatcaatgctgccatggttacaagctccattatcaatatcatgggattcatttaaaaaataactaaaatagctctgtttcttccttgttcttattacatttggtcagaggcatgtgtctcaaaggcaatctacatataagacactccatcctattggtgggatgcctccccagatactaggagagtccatactatatcactgctctgaccatcttgatttttataataaactacaatgatagagtaatgaaccactgttcatgactacgtcctagtggagccatgtcatcagaccccagaaaactcagacaaatcttaaagaggtacctaatttaggttcaaaacaggatcctgagaaggcatttttcaatgagataaacatagttaataattgactgcagtagttatcaaatactctgctagattttgcagagcgttataataaatgttctcatgccccactatcactcttgcaagcaagagagagagagagagagagaaagagagagagagagagagagagagagagagagagagagagagagaatgagaatgtatctttctccattcctttaagtctttgctgacatagggattctttgacccacagaacaggacagaaatgatgctatgaaggtctagaagctaggtcttaaaatgcctctttttaccttgttgatccctggggtcattttttagagaacctgagtcttttcttctaaaacattgggtttgtcaaagcttcctaaggaacattccaagtaggagtgaggctgtctcagaacctccagcctcaggcgagccttcaggtgacaggtatctgaatgatcccaagcaattccagcgcaatagcctatgcagctgatttccaggatgataaattactatcattttaagccactaagtattagagtactgattgataatctgatttggtctcatattaaaatacataaatggaaaattatcacccatgatctttctgtgcaggcataattattattattaaagttgactttcttccagaattttaatattcaaatcaagacatatgcaaagaggctttgttcttgttgacatgctattggaattctgctgtacgtgctatctgaaaacctgtatttttcttgtaataatatactcatcactttcatgtctcataaataatctttcacatcattttaatgactacataatactccatcattgtagtatatataatttacttaaccagtgcctgtgactgggtcattttgactattatacttaacactgtaatgccataaatctttgtacagataaatgataatcttttgtaatacattatgggtatagctgcttaagggttttgttttagtataaagtaaacaaaacatcttaattttacttcattttatccatgagtttaatgagagtcttacatgtctgttggctatttgtttatctagtgttttattaagaaatggcccttgtgtatgtttattcaatttttaaacaatttgttatgtaacacacacacacacacacacacacacactatggaaggatatcacagaacattagataaaagtgggtcactctcaattcttttctagctactgggcactaagtatattacctacatttttcaagccttatttctcttatgtggggagcgagtatctatttccttacattgtgattttggtgatttaagaagtgttcaacaatataagttatagagactaagtgtctaataaatactgtttttatacgtgtttgccttacaaaaaccaggccatactatattgcattttttgaaaggatttatgtaatttatgtatatgtgtcagtgtgcagatatgtgcatattagcccatggaggccaagagtatatgggatgggatttgttttaccctttggaagcagttccctgcctggtaatgagaggctcttagaagatgaggggatgctgtcctattccaatgtggtgtgagggaggttgtggtacctgtctcatgaggagggcagcctgcttaagagagcacaaggaaatctaggtccataataatgtatctatgtatatggggtactcaagacatggtggttgcatgagtagaggccaaaggacattagaaagttcctggacttggtggcaggtatctttaccaaccgagctactttgtcaacctcatttttaaaacattagcatgaattgttgcatggtgacttatgcttgtaataagagcacttgaggaagactgtgacaagaggtgtgacaagaatttgaagataaaatgggctatatagtgagttccaggctggtctgaggtacagaatgagaccctgtctcaaaactcagattatttataatgaaaagtccttattaaattgggtgatgatggggctatagaaaataaagtgaggcggaagcacagagccgctgaggcagcaccctttgcaggccgcagacagccggccactgtccggaccagaggacaggtgtctgtctggctcgggaggtggcctcagcctcagcagcagcagtagccatcttggttccgggactccgcggaacttaggaaattagtctgaacaggtgagagggtgcgccacagaagctgacagcttctgggaactgccaaagcaacacagcttctgagaaaggtcctgttttgggccttcttcttcggccaggaggaggtccaaacacaagatatctgcgcaccttccctgtaagagagcttgccagcagagagtgctctgagcactgaaactcagaggagagaatctgtctcccaggtctgctgagagacggtaacagaatcaccagaagaacaatctctaaacagagtcaactataactactaactccagagattaccagatggcgaaaggtaaacgtaggaatcttactaacaggaaccaagaccactcaccatcatcagaacccagcactcccacttcgcccagtccagggcaccccaacatacccgaaaacctagacctagatttaaaagcatatctcatgatgatggtagaggacatcaagaaagactttaataaatcacttaaagaaatacaggagaacactgctaaagagttacaagtccttaaagaaaaacaggaaaacacaatcacagaaaaagaggaaaaaacatacaaacaggtgatggaaatgaacaaaaccatactagacctaaaaagggaagtagacacaataaagaaaactcaaactgaggcaacactggagatagaaaccctaggaaagaaatctggaaccatagatttgagcatcagcaacagaatacaagagatggaagagagaatctcaggtacagaagattccatagagaacatcggcacaacaatcaaagaaaatggaaaatgcaaaaagatcctaactcaaaatatccaggaagttcaggacacaatgagaagaccaaacctacgcaaaataggagtggatgagaatgaagattttcaactcaaaggaccagcaaacatcttcaacaaaattattgaagaaaacttcaataaagaaagagatgcctatgaacatacaagaagcctacagaactccaaatagactagaccagaaaagaaattcctcccgacacatgataatcagaacaacacatgcactaaataaagatagaatagtaaaagcagtaagggaaaaaggtcaagtaacatataaaggcaaggcctatcagaattacaccagatttttcaccagagactatgaaagccagaagagcctggacagatgttatacagacactaagagaacacaaatgccagcccaggctactatacccggccaaactctcaattaccatagatggagaaaccaaagtattccacgacaaaaccaaattcacacaatatctttccacgaatccagcccttcaaaggataataacagaaaagaagcaatacaaggacggaaatcacgccctagaacaaccaagaaagtaatcattcaacaaaccaaaaagaagacagccacaagagcagaatgccaactctaacaacaaaaataacaggaagcaacaattacttttccttaatatctctgaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcannnnnnnnnnnnnnnnnnnnacattccaaagtgagcagggactgttttcttcactgtctgtaatgaccatctggattcaattgttaatgttcaatcctatttgttgctaaggcaacccagttataggctatcctcactttaccaaaggtgatattgccagagtcatcttataagtcagatttggaaagacacaatatattttcctaggtgaaaagtgatgttaatggtgactagaacctagagaattgcatttaactcatattgttgcaatacttgtgcaaaatgagtcagtaaatatatcccatgctgcccagctcacagcaatattttggaacaatctggtcatgagaggaaaatcagcctctttccaatattctccaaaactggtttgagcctcaggatatcctgtgtttagactgtaattttcccaaagttgtttgaatgcctggcttatcctggaagagtttattaggatccatcattctagtcatatgcacatcaaaataaggatcttttgtgggctccagaaatatgtggacttaaaaagaccccaccctggtgattccagcattctttgtgtattattacctaaacctcttcaatagctctcccgttgacccctccccacttcctcagcactggggatgccttcctacaaaactgtcaagttcaaagtcacagttctataggaagttaccttatagggtaccataattccaactgatacagttctgatcatggtatacttggaagatgttgaggagtagacttgatttgctgatgctcacaggaacaggctcttccatctctactaagggagaaggctgacaacccaaacacagagatcaacgctgccatggttacaagctccattatcaacatcatgggattcgtttaaaaaataactaaaatagccctgtttcttgttcttattacatttggacagaggcatgtgtctcaaaggcaatctacatataagacactccatcctattggtgggatgcctccccagatactaggaaagtccgtactatatcactgctctgaccatcttgatttttataataaactacaatgatagagtaatgaaccactgtgcatgactacgtcctagtgaagccatatcatcagaccccagaaaactcagacaaatcttaaagaggaacctaatttaggttcaaaacaggatcctgagaaggcagttttcaatgagataaacatagttaataattgactgcagtagttatcaagtactctnnnnnnnnnnnnnnnnnnnnttagaaggagcaatttgcaaattcatctggaataacaaaaaacctaggattgcaaaaactcttctcaaggataaaagaacctctggtggaatcaccatgcctgacctaaagctttactacagagcaattgtgataaaaactgcatggtactggtatagagacagacaagtagaccaatggaatagaattgaagacccaggaatgaacccacacgcctatggtcacttgatcttcgacaagggagcaaaaaccatccagtggaagaaagacagcattttcaacaattggtgctggcacaactggttgttatcatgtagaagaatgcgaatcgatccatatttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgagccctttcgctcgactcgagactcgaaccccgagccccgggctaccttgtcagcagagtcttgcccaacacccgcaagggcccacacgggactccccacgggaccctaagacctctggtgagtggaacacagcgcctgccccaatccaatcgcgcggaacttgagactgcggtacatagggaagcaggctacccgggcctgatctggggcacaagtcccttccgctcgactcgagactcgagccccgggctaccttgccagcagagtcttgcccaacacccgcaagggcccacacgggactccccacgggatcctaagacctctggtgagtggaacacagcgcctgccccaatccaatcgcgcggaacttgagactgcggtacatagggaagcaggctacccgggcttgatctggggcacaaaccccttccgctccactcgagccccgggctaccttgccagctgagtcgcctgacacccgcaagggcccacacaggattccacacgtgatcctaagacctctagtgagtggaacacaacttctgccaggagtctggttcgaacaccagatatctgggtacctgccttgcaagaagagagcttgcctgcagagaatactctgcccactgaaactaaggagagtgctaccctccaggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcataagaacgcagcactcccaccccacctagtcctgggcaccccaacacaaccgaaaatctagacccagatttaaaaacatttctcatgatgatgatagaggacatcaagaaggactttcataagtcacttaaagaattacaggagagcactgctaaagagttacaggcccttaaagaaaagcaggaaaacacagccaaacaggtagaaatcattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagagatagagtatagaaaatttcagtggtcaaatccctcccttaaaaaggaaggaaaaaaatcacttataaaagagtcatggtttctaacatgttaaataatttttaagcatgtgcatgtaaatacgtgtggcattttagattgtaaactgtttgagatttgcctgtaaatgtgaacgctgagttactactgttctagactgagtgtgaagtgtgggaaaaatgttgagctgataacgtcaggcagactggagctaagaagcagctgggctgaggcagctcagaggtcttgggctgtgtgtgtacatttctgtgattctatagatgtggaccctctggatgatggctttctcccattgttactgtttcattcccacagactggtagacactcagacatggatgctatgcccttaactatgtgttataactaagagatatggcagaggagctttctattagaagagtctaccaatcacttggtcagcccttgaagtgagagagtgattaaggggagggagaacattctacaagagaaagtgatgggaacttgaaggaagagaaagctattaccctatccagtacctagctccttggcacacacaatcatgtggtgtagaatttcctgtactcatccaacctacttggcccccagtcctacaaccatcaaagtggtgcacttcctggaggaaagaaacaccttttagtgatactaaagaatggacccagagaagaatctggaagtctttcgaaagcttcacgtcacagataattaccacatgctatgcccttgtctaatcagaccgccgcacaagtgtccattcttcatcaaatctaagcagaaatgacactggtgtctatgtctttgtaccttcatttctaaggactctttgtcacgcaaaacttttcttcaataattgtctgtgcctttctcttactggcctgtcttttgttagtgattccttagccatgaacctagcacatgtagcaaagaattcttttttttctggatgaagatggtaaagtcttagtctactcggctacctatgcctgtctccatcacgttctatctacatgccacccccttgagtctgtcactgtttctcatctatggaggataccccctcctaggtcgcaggttccattcaggcttttcccatttatattgtgatgcccaaatctctggggataggaacagaatcatgcaattatgatctcacaataatcttttctagaaacccaacagtgtaccgtttacatctgtggcttctcactttattctgtgtcaggtaaagtgaagttctggccactggcaaatggtagtaatttttttttaagagaaggtaaatatgtggtttggggtaagaaaaatgaagtcgatttctttgaaaacccatcagaagaaagattagtaaactccagtagaagaaaatgtcaacttccatttctttattaaaacctatcattttccttctttctcctttttcttgatatatgctaacagtcctcttacctttcaggtccatagtgattcacagttagcacagaacaaaggaacaaaggcattccattcaaggtctaagcaaaagtagagaaagaaaggtttgtctgtgaactgagtttcagaaccattgcctccattagaattagccgaaatagaagcaggagagcagaaatgcagagcctactgggagcaaattaaccctggaagtgaaaaggggacatctggtagagagtctgatagaatagcaggaaagctgtcaggaaggaggagggggacatggagcagattatgctacactttatttactgaagtgaccctctcactgtacttggaatcccatagcttctggctggtctaactgtccatcttgcccaggaatctcctgtcttcataggtgctaggattccaggcagctattacatctgcctggctttttacactggcttgtggagattccaactctgttcctcacgcttgcatggatcaatgctctacccactgatcccctacccccattttaatggaaaagaaatgcaatggcatttagctctgacagaacacttagctctgtcttcagttgtgtggctcacttgcttgatgggaaacagggcaatatcacctaagatttcttttactttgcagaatgtaacaaaaagtctctccctctggcatggtttgacaatacctccaaactgcctctctttcttcaggctcttcaaagaaccctcagggaacatgctcacttcgagaagttccaagaaagaccttttgtatatggtccctccaagatactatgctagagcctctattgattttgcctgttctcaaccctccaaggacagcaacaggaacatttcttgggttgtacttcctgagagactaaaaaggtgatgttggagcagcgtgtgtctttgcccccgcaaatctgaaccctcttccagccttcaagctttgatatcatattgaaatctctgaatttttttttcttgcttccatttgattataagaggctactcctatgagaggcactggtgtggactctaagaatttacaaagaagagaataattgttcttaatcattggcatccacgggtgcttcctttcctcccttaccccccagagaactgcaaatccctcttccttcatccataatctccccagtacaatgatttagttgtgtgtgcctagttgtggctcttaaagggaatgattctcattcttagaagcaatgattatgtgaagagaggtgagcgggatagtcggcctctgcgagtggcaataatggaagtcagaaagctattcgctgggtgagttcattttatattgctaaagtacaatatcacatagttagcagagtgtgattaatagcaatgttttggcttacttttgggaagctaagaaatccaatattgagaggttagcatctagtaggagcttttgggctatgccatctcatgacagaccagcagagaaggttagagagtaaagaccaaactcccattctttagacctttaaaaaaattctttgtcattatatttaaggggcactcccataactccaactccttcttatgggccttaactcccaacagaggtgcagtatatattatttctaaacctaacacagactttttaaaggacatatttaagttcatagcaatgaataaccacacaaatagatcattacaaaatgtaatggtaggtgttttggatacagagttgatcttgtacaaagaccatcaatggtagacatctcttttattttacaatcaaggaagggctgtctccaccttggcactattaacatttggactggatacttttttggagtgaggttacttaatctacatcccatgtcaattattagcagcatccctgaattccacctactagatgcccccctccaattgtaacagacaaaatgtctccaaattttccacatgttccctgtggacaaagtctcccccagtaaagaactatatgccttatacaagttcccaaataagcagcgttgcagtatctcaaaaagaagggagggggtggtaagagttttgacagttatttccaaaaattaaacttttttttaaaaacccagcaatatcaaaaatcacccaaaatataattttatgttaaatgcttacctgcatgccatgccaatgtccctttaagcagacattcatcctctggagcccgtctgcttgtcctgaataaggtgtctaactagagttgccaaagaaaaggcagatgtagcctgaagctgtcttccaaaacgtattttaacttattgaatctctgggctggttaaagttgtttggccttcagcctgctggtttatatcactgccccaagcagggtattatcatccagaaatacatgacctcacttttattggaaagatatttataggtactgtgtagactctccatgaataagtttaatgtgtttagagtgtataaccaggctgggtatagtatcaaataattttcactaacagttgccttatatcaaattttgaacatacaagaattatcatgtataaaaaataaatacaatcttaagaaaaaattagagatttagtatggaaaaccaatgactgctaagtcaaatgtggcatcaggtctctgatcttggacatatcaaccaacatcaattttctcatttgtaatgaacatgataatttttcccttaaaggagtgttaggaagatatattaggtaatagcaatggcagatatcctgtaaaagtataaacatgacaatgtgtccccctttcacataaattgtccagtttaactcctcccagcctcatccagatgggatctgccagaaatgcaagagagagcctggccaagaagcaatcttcatccttcacatccaggggagcttcagagcccctcaatttaacctccctattttagttagactcctataatttcttattggactcttatagtaattttccaattaggtaattatgaccagagacatgattcttactgtcattctctaactaaactctgttattactcccaaagtctcacagcataccgacattccagctccaagggaagagtccatttctcattgctcttgtgttgttccactttgccctgggttctagccgtgcctatgctctgcaggagtaccactctccacctctgtccctgctgggccacagagatgtgttttcatcgttttcatcggtgtgtgtccctcccaggccctgtcaatcatcgttcaagtctctgcatcttttacttttgccaatttggatgctttatataaatgcaatcatgtatgtgtcattgagtggccggattatttcacctaccatgtgtcaacatgcatatgtgtataaaataacagatttctgccttacatgtgtggtataaagtagacttttgtttgctggttttaggaatgaagatagctatttgttttacttatgttatgataagatatttatatttaatataaagatctacctctttaacatggtttttaagtacacaaaacaacattatcaactgtaggcataatgttttaaagactctagaatatattctcctatagcactgtcattatatagcatactagttgaaaattggctttttatttttccttcttcctctcagtccatcaccatcatcattttgttctccatatattttgctattactactttagatgcctcatatacattgaatcactcatgtgcccttctatggccggattatttcacctactgtaatggcctctgagttcatgtatgctgtcatgaatggcagggtgttctcattttaacgatgaataatatagattaaggatttaaatgtaataaagtagactaagcattaataccacctgaagctatcaaatatggaggaaatgagtcaagacactggttgaggcagggatttcttggatgtgacaaaaacaaacaaacaaacaaaagcaaagacagagacaagctcctccaaaaagatccccacaaattacaaaagtgatggctagaagaattggctacagccacctaaaaagctttttcacaacacaggaaccggtcatcagaatgaagagagagcactagcacaagggatgaaaaagaagtatttataccatagatctgataaagtgttcgtatccaaagtttagaagggacttatgaaactcagaaagagaactgcgatgcaagtgagcaaagactttgaatagatgtttctgcaaagaaacagatgaatgacccagaggtacagggaatgacggggcatcactgattgttgtggaaatgcacatcaaaactaaatctgataagaaggaaactattcaaataaataagcaacccccaaaggcaacccctttgggaagaatgtgggggagctgaaactctgtattccgctaaaggaaacctaaaatgctgtagaaatgaggacaatggtgagcttaccaaggaagtagacatttgatctggtaacaccacttctacagatctatttttataaaattaatatcagtctgttaaggaaattgaattcattctcatcttaattgtagtgttatccatagtactagtcaagctaaggagggacccaatgcccatcaaagagttaatggataatgataatgcaaatatccaccatactgttttagcagcttcctgtcttagaagcaatgtctcaccttgtctacccttgagcatcctccagattcatctcgaaggatgggccacatgcctgagcaccatctgacctcctgtatgcctccctccctcttctcattacccctttgtcctgacaactttgtacatatttctgttagtttgtgtgacatgtcattggtataaatatttgtttatggctctatctgctccacagggatgtgaatggctaggaaagaggaagtacagcttattaatcttgtctttccagctattaccactgaccctgcgccagcccatgttccataagtatgtgatgaatgagtccatgtttagtttgaattcccatagtgatgaagcgtgcagcagtggaaagtaaccacctgattttcactgtgtcaaattcaaatggataaatctttatctctattgtcctatctacgtccttatgcattcgatccaaattcctaatcaaatgcctagcctcttgatgactacaacgtaacacacattatataataaaaatggcccctcttaaaactctccctagagctaattccatgatgcttagtgtgttctgacaatacgattagctgagctcttattctaaatccaacattgtagtaagaagaggacattatacctgccgtgctcacatttattcctgtatcttcctgttatagcaatattagttggaacactgtaggggcagaatcatatggatgcgatggaagtgttcctggtaaatctccctggactccaatctattagcaatgaccagttcagcccaagtccatcaaaacttcaattttatcaaagccccctctatagatgccactttatgtgctattaaacagaacaatgcagctcaccagtaaaatcatctacaataacagcccattaaaagctttccttaatatggaactttctaattaatgtaaatggagtgggaagcttggtaagacaagttgattctaatgttcggaacgtaggtaaaataggaaagggtctgatttttcattagcaatgtattagagagcctaatgaaatctttatggcttggatatattacccaaaagtcacaattgctttgtttcctgcctcatttcgctgccacctttctctaaaaattttgctctgttatgcattagatttgagaaaatggaattttcttccacacaaagaagcatggattttatgtccgaatactcccggggttctcagaatattggagacaaaaggaggcagtggaagatgatccttagtttccaaatgtccaaattagaagcacataccaaagagggtagaaaactaattctgtcatttacttctttcccccgtctcttcctctaataccgtcttccacacttcttttttcattctatcccttctttcctttcttcttcctctctctcccaccccttcctgtttcatgttctctgtgcaatgtgtaaggtttgtatcattcagcttaggctagttagcactgataacttgccaagcctagaatgatctggggaaaaaggaaaagttgctcattcactgagctgttgtttttaccaagttgttctgtggctatatctgtgagggattgtcttcagtgatataggaagaccacctcctttctacatcattataggctgtgtagtttctttggcctgtgctgtataagaaagctagctaggcatgaggctgtaagccaatgagtaagccagcaaagaccatgcctccacagtttctgccctccaggtttacaccttgagctcctgccctgacttccctcaatggtggatttgtgacctcgaggtatataattcaagtcagccctccttctctcaggatgcttttggccagagaacagtagaacagctagtttacactgtaatgatgaccaaacaccaaatcttaaatgtttaagtatccaaagctcatctttgttcatactatgaagccaggcagcaacttcatacataaactcctttcctataataaggcagtaacaaccagagccagtcaaagactcaagctgattgaactgccattgtgatgagcattgtcactttgtatggcagagtgaaaagagaatatgacaagtcagcctgtagtcctttaagggttgtcatggatgtcacaggtcacttctgctcacatttctttgccaaaagcaagtcagcttgctgtgcctgacttcaaagaagttatattagttcatcctacgatgaatctaaaaggtcccctgagaggcagctaatgtaatagtctatgattccaaaatgaattaggaacatatcctgctgctggagagctccgggtcctgttgaagaaccagaaaaaatccgagacaggactagataaagcctggaaaaaattgaccaagagccctaagaataagcgggcccttccccttccctgtgctgaccttcttccgggctttacatcattggatgacatcctgcctttctcactggggtacagtgtccagtagggaaactcacagtactctgcccacaagtactgacaactctgcatgtccatagagttaggaggagaactttaggcatccagtgcagacatacctcctttcaaggaggcaatgcacaagggaggagagagtgcacagctaatcctgatctttacccggcgtgccaaatggcatctgttgcatctgaatatcaggaagtaatccttggttggagacagctctatcctgtagaagagcagggtgatttaggacagtgagaggcttgggatgttggactgtgaggtagggagactgaagcaggaatatggcttcatatccaggcccatatgaaagttcagggttttttcttaagcttctgaaaaagcccagaacccatacaaaagttgagcccagagtcttagtgcatcactgaccatgcacaatgaccttgtggccttgagagagttggtgctggaacccaggggaccagagagggacaggaatcctatgctttggtgataggtacacattatacactctatattcctctgtaattgaccttttttaaagcctagagaaaatgttctgcctggctttacaatcacattccaatcagctttacagaattgtgaaattgattatccagtgggtctcacaggggttttgagtaggacagaggggtaccttaattctttgctgagctccacatgctgattcctggagactttggctttcccatctatcaccaagaggaaaggagttcaaattgccttgaaattacaatttagtggcttcaagctttggccagtctcacagctagggctgagggcaaggaatgaagtaccaggcacattagttcctgttaagccgcatagaaaagagatggtgttgttgggggtggaggaggtacccatggaagttcggataacagtgagaattttgagaggaagatgtgaacctctgggaagtaaggcagcagttgccttaatctgggctgagtggttctgagtttcagcaaaggacaacgaccagggcatcatattcagctgagctgtgccacgtgactcacactagttatttcttcattttaattctctgttatgaggaaatggttgggatttgcatattgttagagtgaaatgaatagaacatcattttctatttcactctactcaaggcaagaaggtctgtcacgaagaaggccaacctgagacaagaaataactaaggaaaatttgagggctctgtaacagacatgtcaactgcatatgcccaaatatagaagcatgtctccagggcaaaagtgggtaaagagaaggtagaacatgaaactggtgtgacctaacatgctaaggacacatgaatgtgaaagcagaggcaggtcatgcaccctacaaagaaaatgtggcgttctaaacacaaacatggagctgtggagacacagaaggaccaagcacggaccagtcacactcaagactggctagaccaagtttattcagtgtcacatatctatccacttgggtggaattcacaatgaatattctataggtggcatgcatagtgatgatgggactctcataatctaaacatgtacgtatattaatggaatggtctgtatagactacttactgtgtgaaagaactgttttaagtgcttttcactaattatcttgacctttatatatattgtatggtacattcctcactatctggatcctaaagataaagaaatgaagcctaagggtgttgtaaaaggccagagagatggtaaatggtggggttgagatttcaaattcagccagtctgaacctcgagggtactcctcagctagcacagcggagcttccagtcattttagccaggtcacctttgtcaggtcagcaaatggtcagtgaacctacagatatacagttatgacccagacattgtgccaagtgttgggcacggaggttgatcacgatggtaagtcagatcctcacgtggatcgggcagaaagcctgtgaatagctagcacaagactgagcctctaactacagaacaagaacagaaacggagaatcggaagagaaatgaccatgacatgaaaggatcttcactgcactacatctcagatgctggcttttacagatgaaaactgccaaagccaaggagtacgtgatctgctaagggtcatagtaagttagcatctgagccaagacaggagtcaaagaatgctaacatcacatcagctatagatacttacatagtcctcctctgtgcctcccactgtcctagagagcatgagtgtcacgtggtatgagagcctccatgatctcacctctctccatgcaccgagtgctgcccaggttctgaagacttgcaatacacatagattccatccatttctggttctactatatgatgcccttcatgcttctttcttccatgtccagcctatgaatggaagctctgaacaagcacatttcatttcttgctcgactcaaattctcctgtatgagcagaatgctgggagaaagtgcaatagaggacccatgcttttctcctacttcccaaagcaggaaaatcttagcctttataaaccataagaagatcctcttgaggccataaatacagagtggagcactcctttactcaaagagtacatttgtgtgtgcttgtctgtatgtgtgccacagtcatatggtgctgagagtgcagaagagggcatcagatccccctggagctggagttataagaagttgtgatctaccatgtgggtgctgagaactgaaccccattcctctatgagagcaagttctcttaatcacagagatatctctccaccttcggattactcatttttaataggagatcagagaaaggggaaacctcagagaagcaaagagttgtgaccaattcttcaaaaatctcttctagcgtgcatgattttctttttcttcccttcttctcatcccaggagcaacattatctggctgagatctcagctttctgtatgccccaatagggtctcactaccccaggactcccacagcaatgtctttagaggcagaaaataagggaatctgttaggtagtattcctggtatcatggtccattggggctgttgtagacctgataaagtagaatcgactgtcagttaaagagtaatgcataggggtctccaacagcttggccctttctcttccctgatgacctccccttactatgtactacctacaggatttatgatctccatactactcgctatgcctatgctacaatggagcccatagtgctataactgtgaccaataaacattactgtaacctctacttcatgatggcatcctcctcctctgcatgcactcctccaaagccctcaagttttcgtgtcttagctatgtccacttatagatgacagactaaggcatgtctccttatcaggctgacgaatggcatagatccaggtcactcactctaaccccagtgctacttgcaaattgatacaaagagctcagagtctacagcagtcacatctggctatttcaggattgagccactaaggagtagtagcagaatcacctgaggatgagtgagaatttcacgatgccagtcccagccactagacctactcagagtctgattcggttgcacatgagagcttacagatggttttagaatatgttcttgaacctaccttaacacacaatccttggatccctgaatgaagaggacacaggtgatcatgttcccaattaggtcaaggcaagtagctctaaaccccgaataagaacaacatgctcactaccctttaagagcaagaaagagaagggtattgtagagccaagcagagggtattagatgaaccaggctatgtagctttcattcatataaaagagcagtgtctgctagtattctaacaagtatggttggagaagcacatacatgtatgcatgcatatatacatgtatgtgttggagtataaagagggacagtataggggagaagtcactgcttgggcttctctgtccttaggcatgaataggtttgttgtagcaacattaaacttcagcattggtagagctagggtgcggctgagctcagggactggctgaataacactccttggatttgcactctactccatcagctccatacagggcaccacccctttatccctgagagcttccagctcaggctgcttcagtacggggacatgctgggtttttctgagcatgagctgtggtgcagatggcatttatcccagttatcagagaaaggcagtaattgcaaagtgaacttggagacaggcagccgacagcttcactctctctctcctgctatgtatcttctcttacatggatccagaccatcaccagcttgttctccctttaaaatgggaaatgtgataatgtcagtctctggtttaattccagggttgcattcctgcagcctctgtcacaaagcttgaacctcttatcagagcttctcaaggtatggttatctgaccccagctcaccactctctctcttaccccaccagactccacagtccagaagttcacttgtgatttgcattcccaggttgtttgtcgaggaacattgccttagtgtgttcgtccaacccagtgaagagactcctaactcctatctcatgccaggagtaatgttaatgtctacctcacaccaacgactggggctcttacatttgatcagacatctcttcaggaggagctaccaaaaggatgatgaatcttcagggagggggcaacaagccaagttaaggggaaaacttctccagagagtttactgtgtttgtggccagagcatcctagcatatccgtttcagacagtcaactgggctatctggtggtcaggaccagagccagagacaaatctacataatagagccattgatcactgtcatcaggtgcagccagctgtggcctgggggagaatgtttttttttttttttttcagagatgttctcacaaggagatgagtccttcataggaggcttttaagaatgtagcacaggtcggtcagtgtgagaaggttctttactgctcaagttttgtttttgcaatgaatgaactttaaaatcgttcttcttgggttcttggaacttggggttgatgcttgctcctgcatgatggttgcccatgctgaaactggaaagctttgtttcctttcaatcctctgaatcatagttttctactgtgattaggatgcaattttccctgtatattgcaatagcccgatgttggcaaaattcagcctttgcatgctgcaactattgtaatggtgtgcctttcatattttgtccctaaagagttctgctacaggggctgaggggatggcttggctaggaaagtgcctgctgtgcgtgaggctagcaagatgactcagctacagagagggtgtgctgccaagtctgatgacccagtgtcaatccccagaatccatatggctaaaggagagaaccaactcctaaaaaatgtgttctgactacacatgtgctgtataacatatgtgtatgcacatatacaaccattgctacctcaacaataaatatgaatgtttaaaaaataaagataaagttaggcacaagagtgtggtctgttatctagccctggggaggacaggcagaaacaggcagatacctgaagctcattggctattcgtcctagctagcccacaagtttcagtttcagtgagataccttgtttcaaacagtaaaggatagagttattgaagaaggtagccagcctcaacatctgtcctctgagacaggctgactccatgataggctacaagttggcagttcaggaaactgggcctaagtttctgtttctaagaactgggcaagtccaggcaagtcagttactgaaaaaaaaacaaaaacaaaaacaaaacaaaaaaaaaacaaaaaaaaaaaaacccaggccttaggctgccagtcagaaatttccctgtcatcagaagctaccctgccacctggcttgaggcaagggcaatgggtcagcaacagtttccagacttccccagcaacagtttccagaccccagcaatggttctagaatgtccctagagacagagccaacagattaagataaattcatctacccctcaagggaattcccctaatgtgctttaaattgggcctttgaactcacttgggggtctccatctttgtaacaggataccccaaatgttgggcttctgcagaataaagcactctttgctttttcatactatttgagttgtggagtcaaccacagatccttacacctctatacacatgcacttgtgtatatgtacacacacacacacacacacacacacacacagagagagagagagagagagagagagagagagagagagagagagagagagagagagaaagaaagagagaagtttgtgatctttgtatccccacaggattctttatttattgctgtttcctgtctcattctggatccttatatgttgaaagcaattttattaataatggtcttggcagctatgttttttttgtttctgactctaaaggacattccttgtttattcaccacaaaagagaaatagcttattacctgaattttcagcatagcatataccattcacatccttttggtttaagcaactgttaactcatgactctatctaagtacttagttaccacatgtcttagttcatttgtgttaccgtaacatcaaaaataaaaactccataggctaagtaattatagagaacagatttcatttctaatgttctaagaaggtaggaagtccacagtgatagcagcaacctggtaagtgtaggctggaggtcaagttctttcttccaaggaggagcctggaacattgtgacttcaaatggcagacatcaaaaggctggtagatctgaactagtttcctccatccattttctaaggcaccaatccacctatgtgggtgaagcacttaggacataatcacttcctccaaagatgccaccatttactacccaacagagttaggcttcagtgtgagccttgaaaggacttcagactaaagcataatctgcctccccaagagactggagcctccgtgtgggttcttcatttcatcacccagcacacagcaagtactcagtaaaagactgttcaaataatacatggtttcccccctccaagtgtgaaagccttagttttcattcttaggtcctagagatactgcttttcttaagaaatttatatttgacattgccaaatatggatatatttgtcctctgagatgacacttgtgctgcagataataggaattctgggctagagagatggcttcataaataggagtactggttgctctcccagaagatcccagttcaattcccagcacccacagggtagctcacaactcaagtcccagggaatttaatgttcccttttggcccccagtggcactggacagactcggtacacagatacacaggcaaaatgctcacacatgtaacattaagatataagatgaattctgtggtggaattttaattgtaaggatgttcaacttcttgagatagattctcctttgtagtagatgtacatgatcttattcctttaggattactatgcttgtctgtacttaagtttggacataactgcttttgtttttctttttgtgaatctgcttcagcctctcctgttactgagttcatgtgggagacctccagctatgaggtcaattctttccacccagaaaagagacttacagtcatatcagcaatgtacaaaattgtccatctagcaaaactctgttatcattttaatttttgagatttatttttattctatgtgtatattttacctgcatatatgccagtaaacatgaagtgctggcagaagccagaagagggtgccaggtcctctgaaactggagttacagatggttatgaatttatacgtaggcactaagaatgaacttgggtccctgggagaaaagccaatgatcttaaccactaagccatctcttcaaacccctctattaccatgttaatttcctctcactagtagaaaagcataccaggatatttaactgaaacttgctcttatttgatttctagtgaggttgaccctcacttcacccattggtgatccttgtgggcttctccttcacttctcagttcttcctgttggcagaaccatcctttttagtgattcatgagaactttttctgttttaaggacattgactttctctaccatgcatatttatagattttctattttgctcttttatttttaatacgatttggctgtaggtttcaaaaaataaaacatgatccaaactcaatcgctctgtatttcaagacgtattttttttcattgacttgaatgagcaaaagtataaaataaagatcaaacaaacagcatacttcatctgctaattactttatgatttcatattgcattgggctacttgactgaatgttcctcttgtttatagaccaagtgtccttttctttgaccacagagtagtgtaagcccttcctctatgaagtttcggaaaggagaaatgtcaccgaggggatgtccatggggcagccatgctgccaagaaactgtaggaattccctggggtagatggtggtaataattccctccataggctactgttgccttctccatattcaggaggctagggtaagagacttgcagagtgcaaaacttaaaagttggtaacttgtaaaaatatttctgtttgtttcctgggttgccccctgccccaagtcttatacagggaggaaacagctctccaaaaggcctttggactctctctcttaaggggagctgatttccttcctggaaatttccatttagaatcactctgtcctcagctctgaattttccttgggtcttgcataattcttgctgtaaggtggtcttgttggtatctgtgactgtccctggagtgagccttactatggtgcttctgtgtggagtatatgaatggtatgatagacatagttatgaatgagtgctagacttataataggccatgtatgtagaagacatctccttactccctagtgtgttgccccactccaccccaaagctttcttttctccctatgtgtggttataaaattattttcgttcaccatgtatggctatcctaagagtcaaggcaagtctctactttgcaaatgacaaggctatacatatgtgcctgtactttctattatcataactgaaaattaattttggcatcaataattttatttaaagttggaggttgctactctggccagtgtttatactacagctgtggaagtattgaccctgttgacatgtcatttggggatctgataacctagtaggattgacatccagcccccccacccccactctgagtctgtcagtggtagagtcctgttggtttgcaagcaaaagtctaaatatttagaaaccctaagctcctctgtgaaaacaaggacaaaaatgaatatttatgatccaataattctgtaactgtcttggacatcatccctttgctgacacctacaagcctgtcacagtttggacagaagccagagctctgcctggcaatgcatcactagctctgtgaccttgatcaagtcactcaccctctctgactctgtcccctccatcgtaaaattgtaaggaaaatgctaatctcacagtatttgctcttcatgttaaataattcaacatattctggggagtatagactagtaccaagtacacaatagatgctcaataaagttattgtcttgcatgttacttgactgagatgtctgtcattctgtccccccaactgtagcagaatctcaatgttttaggggcaggggtgatgttgccttagggcatatgagcttcaacagcttaccataaattaggcaacttatgaacaacagaaatttatttttcacaaccaagataaagatataagcagactcagtatttggcaaggtccgacttcttcagaagtataattttcttgtaatgtccccacatgcagaaagagataactttctggtgcctctatgaaacaggcaatataaaaagcaataatgcttctcacccaacaatctcctaagaccttacttgctaagatcacactgtgaaaccttaaagcatgctcctggtgacacacctcctccctcaaagccacacctcctagttcctcccaaacagcaactaagacaggaagcaaaaggctgttggagtctcctagaatatggtggcagatatcacctcccactcttcaagctacctcagtctgcttatatcaagctaccaggagagaggggttcttgagaaatatcattatggtggtagttggttaacttctatgctgactcaggccagatgatctcctacaaattccctgtttgaagaccctagtcttgtgatgggttcatttaaacagccatatgagagtggccacaaccctgctatactatatgggacctgcagactacagggtagattgttggatttctttcccaacagctgtggaaaaatcattggagaacttcaatgttttagcagcagtatatgtaggttctatttattaaatcctagctgtgtctggatgctattctaagggatttgcacgtagtatttcagttattactgaggttaggacatactgcttccctcttaatagactgagggaggccgagaagttaagcatctttcctaaagtctcaacattggtaaatagcaaagtcaacaatctcagacacaataggagactgtgtcctgcagtttgagaaagggcatgtactagtcatgatcagagagaaggaacacagtctgtttcctgaacagaatgcttgcttcaccctctgacttgaacaggtgtacctgagtgttcctggggctaaggagaagacttgacatatggtaaaggtgtgggtccctatccctgacccttatctggagctgatgcctgagaggtctgacaaggcagagaagcccttatcaggacacacagctgcttcctgggctgtttcccccagggaatggcaggacactaaagacatcagcattcaacaccattgcccacacatacgaattaatgtggttcagagcctaaactttagatacatccatggctcctagcaagcaggctaaattacttgggatgaagaagaatggattgtggacatgggatggttggctggactaaacataaaggtagtcacagagctagaggaacctatattatttgtctgttttttgagggaagaagaaaattattaaagatttaagtgaggcagttgtttaggtaagatgtttctgtcaaggaaatatacttttgaagaaatataaaatttccctaaatatatgtatcagactggttttccagaaaattctgagcaatacatgaaaatgattgggtatcgtggatatgcaactagaaaatccatccagatcttgagtcagagtcagtctctctctctctctctctctctctctctctctctctctctctctctcattttatgggcttcatcttcatcatgcttcctttggcctgtctgatccttgctttgttgtaatactggctttattcctcatcgctgagctgtgggttctctggcacgtgtttctaaggctttgtgtcttcagcctgcagaagaataattctggccatcaccactactggctcttcacattctaacagtttacattgtgttctcattgcctctagacaccattgtgcatgtgtatggccattggctccagtcaccaaactgacaaagaaattccaggaagtggggaggtagttttcaatgcaggagacttggatgaatggggcagtgaacctctccagcatatcccgatttagagtcctagctgttgatttcttgattctttcctctttgagacaaatctgttagcaagaaagcttgctattagataaaagagatagtgttggaaagatacagcccctccctcctcactaagccacacttggattagatagcctgggagtattatgagccccggagggtacttagttctctgaggccaacagtgaactcagcaaaacagtgataaagcaagaaaccagtgtgagcagggtctactctatgctcatattcagagaaatcagaagccaatttctactgctactattttatcaaatgtctttcatgaaatttttgatatttttcttttttttaggtatatatttcatttacatttccaatgttatcccaaaagtcccccacacccctttcccagccactcccccacccacccactcccacttcttggccctggtgttcccaatatttttcaatgaaagggccttcatctgaattgatggaattattccaccacccacacaaaacaccctgtgcctttgacctgcaaacctttggtatgcgggtaatgagtcttgggtggttttcttataagcttaataggaggtccagatgtagaccatataaagaggtcctgttactttggatgctatcctggccatatatcttgtctgtgatgatgctctactgaatctcagccctgatacctgaccctggaaggccaaactttaaagtgacacagaacatctctgagaatgttccctgtagagaacactgctcataacaaccttctccttgcagtattcagaactgcacacttgtaggatttagctttgggtagccatattgagtgatggttattatttttgcaaagctcaatgttctgaatttgtgtgatcattttttttctgcccatgaccatgttcttctccttctaccttactagacggctgataaaccaagcagctggactagtaggctgaaccagaggctgggctctatagcatcccccaggcccagagggttttaagggagtttcattgcaccaatctctttttcccaggtatccagggcgagattattgtggtagagtcccaggattctgcatctttggtgtgaattggagcagtcacatttaggatcaatggctacctttaaaaaacaaacagtaaactcttgacagctgtttctcaccatgcatactgtctcagtaattgtcagtgactacaggttagacaccggaggccagaagttgatgtctgatgtcttcttctatcatcttgtacattttagtatgatttacaaggttggagatacagatatagaccacataaagaggtcctgttactttgagcgctattcaggctcataacactgctcataacaacatttgtaacttaacaactaaacagttagtataatgtttagtaaaacaaccataacaacatacacatatgcagacacacacttgggagcatacccagacacccagacagacagacagacacacacacacacacacacacacacacacacacacacacacacacacacagcagaggcaaaatcccaaggtgattttcccttccagttgaggttttgtttctccctacagtggctgcctagtgaggcatggctctagaaggccaggcaatcacactgcccactatgtgggcttcacgagacaatctccagcttaggaccctgagtttttttcaatcagttaggtctatgtgggctgtatagttagtgaaatggctggaggtattgagagtggaaaccattcttgtctgacatgggcacatacattccgacagcactggccaaaggcagaattacaggctaacaatgcaagagttgtgtctcttttgtctctgaaggaatttggatggtttgtagatgaacccctggcattgcctaagggatcatgtctcacgcaggacagaaggaagaactggacagaggtgacagttataacaacacattaggggtgcttgggagcccccagtgcagaattagacccaattggtcaataagaaggtaaaataagaagagaagcaactgccagaatctttcaagagctgaagcatcagacttacatacatgcctgtttgcagagagcattgactttcaatagacagagagatccacattgctcatagtcagcaacctgctccttctaggggagcctggggcagtgagaagtttagaacatggggtagagagaggcagagacagagacagagacagagacagagacagagacagagacagagacagagagttttacatgcatgtgctgcacacatgcatgtagagctaacaagcttagccatctgagttctgccagtagatactcaggaaaagaaagggaggcttggtctgggtgtccccggacctgggcttccccatagaggtacctttattcctttgtcataaattaggattctagaaaaatgtgggtggcagggaagatattgtctacaaggtcttgctctgggctgagtcatagctacactgaaggtatagtgactagttttctctatgggcactgtgggaaactcctctggaacagaatagagcacacagacaaatagcatgtgcccctggcaattgcctgcttgagagagcattccaaggcagtgtttatggggatgtgctgggagcagtagtactctgacattagagcaagtggtatgctcagcaccagaaggtgctctcccctcccatgagagctgtatcacttaattcacatcctaattctcaatgtatagattccaggaggaggctctgacattactgactactctagatcatttgttacagggtaccctccttatcccaagaggtgaaaatgggttgtggttatagtgatcgcaagtgattaaaagtgtcttcctcctcccattttacacctaacacacacaccagggatgtccaatcaaaagcccagtggccatatgtggccaaagattgtgtgtatgtgtgtctatgtgtgtgtgtgtatgtctgtgtgtgtgtgtgtgtgtgtgtgtgtgtgtatgtctgtgtctctatgtgtatgtgtctgtgtgtgtatctgtgtgcatgaatacatatgtatttgtgcatgtggggactttgagatcaaccttgcatgtcaccctcaggagccatccaccttgcttttgagacagagcttctcactcacctatggcttgccaattcacccaggctggctggtcagtgagccctagagacctatgtacccagagctggggtcacaagtgagtgtcatgatgtccagcttttacttttcacaaggtgcttggggaaaaactcaggtccccatgcttgcggaacaagcattttaccaaccgaaccacaagtaaaccacactagattttagtagggaaacagaatagctggtcctttaataattctgtgttgattatatatctagggaaacagaatagctggtcctttaataattttgtgttgattatatatctagggaaacagaaaagctggtcctttaataattttgtgttgattatgtatcaaaagaataactttgactacattggttacataaagtatatgacccagattaatttcaccagcctcttccttctttttctccttgaggttcttagaaaacaccaagatcacaaatgtgccccactctctgcttgtaaccggcattattgctctacagggccatctgtataagggatacaccggagtctttggtctcgcgctgtgcagtgccttgccatgcattgtctggctacagctccagaagaacccactcattctgtggccgtagccaagtctcttagcctccctgagtctcaacttcctctccctacatccaactctcctctgagcacattgcaaatggaaaggtcccctcaggctgtgaatctggggccacatagtacaagagacaggttcctcaaaactagctttacaggaggagatgtcatgtgctgtgtgtctgtctgctcctaaggtgatagcaagggaccaagttaaaaagagaccttgtgacaggaaagcacaaggttggggagaatgttagataaaaagtcgtgttaaccaaggaaggagaaaacaaacactcatgtttgtttctggggaggagcagacctatccctccaaataggctctttgcaaagctttccatgataaacggaaactaataaaactgctctcatgaacgctgccctgctgggtggaattggtggctcgatctgtgatcaggccgcccttttattccctttttaatgcctaatgccatgggggagagaaatcaattctattttaatttcatgagaaaaatgctgaatggaagaaaaatgcaatagagcgaaacttcccaattcagtcctccactgtgttcccccaacacggaattctgtgatcaatggatttctccctagaaaggtctcaaaagcctgcccctgccttttcctcagacaaggaggcaggaagcgccatgctggtaagagaaactccttagagaggtaaggaaatttaattcaaccttggtgccttaacttacccgactgtctaaaatcatttctgcctaactccccttaattttagcttctgtgtgtccactgtcctaactaggagctctgctgattatccctactcagtaaaccccactaaaacctcccagtcaaagattcctccacaaacaagagttcaggagcaaacaagttttccaggcctggagagccagatggtgccaactcttcaagagcactacagagcacagagtcaggccagtggattctgggttcttgccagctttgaaatcataaacttacaaaattataatgattttccccaagccttagttgcctctctgtagaacgggaaccggagtggcaggagtctctggtctaatttggtgtttccatgagtagtgtttggaaggtgctcttcaggatgccggagaaaagatgatgcaagtaaatgttcttgtgtgtcaatgttgtgatttacggtaaatgtttacaatgatacacaagggtatcctggcttagccattctaacttggactctcagtagagtacccgggggaggtcacctacatgacacattcaatgcttcatgataaagtgaacttcttattccatgattctcttcgactgtaggcttagtgttctaagaacaccggaaaggctagccaggagtggtggcttattcctagaatgccttgggaggctgaggcatggggaaccacacagttgaagccagcctaggctatatggtgagctataaatagcctgaaatacataggggaaccctgactgaagtcggcatcatcggcggcggcggcggcatcatcatcatcatcatcatcgtcatcatctatgctatttaggagaggcacattaaatgtacttttcaacttgattatattcggccatgactctatcataagttgaggtacttttgtgattagagttgaggatatagcctttgcctgtggcccagggatgtcatgattcatgggacaaatgtacctttattttttctttctattaagtcatctctcatatgttacatcctgacaagtttcctctttctcccctcccccagtgtctcctccaccccatccctttcctccccatatccatcccctccccattttacctcccctcagaaaagagcaagccttccagggacatcaaccaatgcagcatgacaagctacaataagaccaggcacatatcctcacaccaaggttggatgaggcaattcagtagaaaaacaaagggtcccaaaggcaggctaaaaagtcagagacatcccagctcccactgttaggagtcccacaagaacaccaaactacacagccatatgtagaggatctagatcagacccgaacaggctccctgatctctgtgaacccacttgagtcagttgattcagtgggctgtgttcttgtggggtccttgattctgctggctcttccaatctttcttccccttcctccacaggaattcccaaattccacccaatatttggttgtgggacactgcatctgatgccatcagttgctacatgaagtctctctgatgatgaatatgctaggctccagtcccagcacatcgggcaggcagcacatcaagcaggcaggacaaagtataggtgaggggttttgtgggtgggttggtgttttggatcccataacttggtggctttaaggccacctttttattcacttcctaaatcctacaagatggggagaaaaatcaatgagatgaccccacatttgtgtctcatatctttaaaaaaatgtgtttaagaattacttaatactagcagtattaaggcccatccctaattttagtccacactctcaaattcctgtagagttagttgggctttacagtatctcctgccagtagtataaaagtgactaacacactgggcaagtccctcttgtggtaggacaaccataggtccacacagctgatcctctcacccctagaaaccggccacccaggctggtgtcaggctaggtagtagaattaaaaattgaggacacctgcagaaaaatgtccctacttcaaccctcctgtgctatatcaggctttgctggctgtatcttctgaagccttatttattcaggaaattctgtcgactgctgccctataacaacatggttgtttgcccagtcaccaaaagtaaaagaaccttcaatggagggtgcggccagccagcctctgctaaggttgttggtgtggcttcaaggttcccaagagcagtgtcatggagtaacaaacttctcccatatgcctgcttgaagccaactggggaggaattcaccctggacctcagcagtttaaccagattcaagttagcaaaacggaaattgactgggtgtgaagttgggagggcaagcggcttacattcagaaactgagtcgtattgctttgctggctcaaagccactgggaatagcactagacagactcattaggcaagaagggttctgtgaaagtgacaaaatcattgcaccccagataccccagcatgagattaaacactgaagggaggtttaagcttcatattaggaagtggcattatgacagtttaggcaaaaggagctttacagctgtctgagatgatggtggccctgcaatgggatcatctctgtgaaactgtaagaactcccttcctgtgcagggtggaggatgggagtgaggagcaggaactaggccagaagtagggcctggagagcgactggtagaggaggcagctgttgacaggaacccatgcacttggaccctgcatgaaagctgaaggatgacaatggtttgggaagagaaggcattgagtggaaaggacatttatatcagtttctgtctcttcccttactgaccagccttgtgacattggctgtaaatacaagtcaccctgagtcagcaccagtaaagtcttactacatagccaggctggtctctctctacctcctgcctctgcctcctaagtgatgggatggattacaggtgtgcgccatcggacctggtctcagcattttattttgaaataattttacattctcacagagaatttgcgaaaacaaaatgatacaaatgtacacacacacacacacacacacacacatctaatagagttctctacactgtacccaagtatcctacaaattaacctctttcagaagcatgatatacttacccaaagtaaagaatgacaattcccctctgtatttgatagagaagagctcagactttgaggatcacacttctacctgtggcctctttttctttgccaggttcccacatggcagtgagttgacatgtctccttgttctccaccatggcaactcttccctgtagcccatctctatttctctcctttctcccatctctccctctccttccatcatctctccttgttctttccagccaaaccaatcactctggggcctgcctatcccaaggccttgcctctattttttcccccagagtctatagctatgtcagcttcacctatctctctccataccaccagattccaatacatagcccaaccggaagttagttttcagaagctgtcagctccagtggtagcccaactggcctctgactgtgcatagaagttctggtgcccaggcactttccctggctctccattcttccaaactcaggaatatataatgatagcaccagtagtaatcgcccttctgctgttatatataggggaaagggccactgtgaccaggaagtgtccagcaagttcactgaaaacatccgtcttccactcctcttccagaaagggacattcctattgatatttaacgtatcttggtaccaaaaatcaacactgttctttctaataagaggaattgtcttgagctggcccccttctgagatgtgtgccctgcagccccctgggtcgctgtggtcaagtgtaggatcatattcgcagtgcttctgaagagggagaaaaggacctgctgttctgagcttaaggaagagctcttaacccctttatttactgaacagactccttctgcttcccaggatcctgctaaaactctggtctacagagccttgaccacatcactctcctcagctgaggaatgaggacaaccacaaagagtctaagccatttctttttaggattatattatttgtatgtgaaaatgtttcccctccaaaggacttagagtaaaatgtatatttcaaagaaatactatttttttattatgctgtgcttgagagccccggtcaggtgactcttacctactttatctcctctttagccctatgttccctcttcttggcctcagaatcatttttctgtctgttctctcagaacaagactgactgctgagcctcacccctgacctggccagcatcaggagcagactttcctggtggggccttttgaagggctgctatatttctcatcccctccattcaactctggtggaagaacagcctattcctcacaggatgtccctgtgtccactgaagctagggtcttggtgcagaagttaaggttgcctacatcgtagctggagcctcatccctgcacatgggggttgccttcttagagtaaagaaactagatgtcggtcactctgcaacagaaacggaaattagaacctgtgttttagctttaaagaaccagaggctcagagaggttgagcaaactgcccagtcacacagctaatatgtttgcttgttttcacaaacaagttgaggaaatgttgaacaatgagaaaaactcttctactggctggggagatgactgagtcagcatctccttgcaaccacaaggatgtgagttcaatccccagaaccccaccacacaaaaatgatggtatgtgcttgtatttttagcagaaccccctaaagcttgctagcttgcttcaggataataaatacctgtcccaaaagtaaagtggatggtgctcttgaggaaagccactcaagtgtgtcatctgaatgctacacacatgtgcacacacatgttcatgcatccacacacatatgtacccacacacttgtgggcctgcgtatacacatgaacactcatgatgaacaggcacacacacagagatgtgcttctagcatagtgtatgggtcgggaacctttctgtataaaaggtcagagggcatgcttcgtatgaagcaggtgattgctggatttgacttgtggtctctgttctgtccatctctaggttaccaaaagtcaaacaaaaacagggagattgggagagacttattgatgaaatcattgcacgattaatataaagttattgaatcaaagcagaaatgatgtgtctacgtgtctttgagaatatagggaagggctaactgagagccacagaaggttttcatgcaaagtatcgccttaagtgagaaatacaaagatgaggagtcacaacaaaaggagagagcatgggaagaaagaggtgttctaggtaacaccttaacttgttcaaatgccccatggttaaatggactgtaagtctttgcaagtagtgaaatctggctttcaggtcaatggggaggccagaaatcagctcagatcttaagctggctaactctaagggccacagaggcagtctcaccctgaaaaaccaagggaaaacacacttctcatgatgagatacgtgagatttctagctagtaatcccactgtgaccagacagagaaaagaacagcctccagcattttgctatagccagatctagtctccagacccctggactggggcttagctggacgagccccccccctcatggttgcaatcctagtaattgtcccctttcccacactgctgaagagaaactcccatcaccttctttattggtggccatggctccagtccctttcttctttctctccccaacctgattcccccactaactttgtaaaacttgccagttaaatttttcaaagactgtttctgacaaagcagtgggaattagatttggcaaagcccttcataaaaaattgaagacatgctatattaacatacattgatttattcatagtgtttcattacaagtaagtgaggatcctgtaataccaggaaaggttaggagagcaggggagcgtggtatattatattgacagctccgtagaaacccagtcgcttttggattgaatttggatcataggaagatgctggctagtaaataaggcatgagctttcgctccctgtgtctgtatcagtggagttgctaccaggccaggcaggtcaatagaacagatttttaagaaaatacagagacagatcctctccactggttcactgggatccctggccccaggcacaccctgagcatctccctcttctgttgctaggaaacaggagtctggccatacactttccccaacttgccctctcctctgtcatcaccttggacttctctctatgtgagcctttcccaacctcaggcccttgccctgtctattgtctctgcctggagcctagaggacttttctatccactctgactccactccatgcttcaggtttgcatcttttctctcccaagttccttcccctaagcatcaaatcttggttcagcgttgctcagatgcagcctctaagcaaatgatctgatgctgagcaaatgattgagaaacttaagaaacaccagtttaagaaaaaaggaagaaataggctgagaaacagaaagtaaggtagccagtaaatatgactaatatatatatgtgtatatatatatatatatacacatatatacacacatacataaaaatatattatatagtaaatatatattatatagtaaataaacattttaaattaaataataaattagtcaatttataataagtaaaatttttattttactatattattttattattttgtttaatttatgtctgtgtgtgtgtgtgtgtgcattcatacacatgcttggatgtgtgctgtgacatgaatgtgaaggtcagaaacgatgtaaatacagctaaatccccaggttattaaaggatctagtgaattaatgaggtcacttggtgtatgccaaccaggaaaacatggagcggtgggggcctacagtgtttgcctctgagcttgggttggagagatagtcctatcagaacactgtgacgttgctagtctcctctggatgggtgtgcttgtttagactcagcttataaagtccaagctgtgagcacatggaatgtgtcttctagcatcactctgatcctagccaagtcaggcctctctcattaagtatatagcaccattgctgtatcacaactgccttacacaggagagggaaatcaccctgtctccaatgtgtctgccacctatgccagggatcagaaaatgttcaccttcttgataagaatatggacgtcctctttggcctgggttggctgttctagaagcacggaatctatgtatgtatgtatgtatgtatgtatgtatgtatgtatgcatgcatgcatgtatgtatgtatttatttattatctaaatgctgtgtgtgtgtgtgtgtgtgtgtgtgtacaggtgccatgctgcacatatagaggtcagaagacaaccattaggaattagttctcttttctgacctaactaaagaagggtctcttgtatctgctgccacactgcatactcctcgctaattggttggtgagattgctgtttctgcttctgagcttgtcatgagaacactggaatatagatgcacaccaccacatccaattttaatggggttacaggcatcacacttggtttgcatggctagtaacttgcacaagatcgagccagagaaactttgatatggtggggtggggatcactgatggcttttggagagggaaacacagttttctttaaagatatggcctctgaaaagttagctgttcttcagtggatggccccataccaatgagtatatgctcaacacaaacttgattcagtaagctttggaaaagaaaaaaaaatggagctggagagatggctcagtggtggttaagagcacttgctgccctcatagaggacctgggttcaattcctagcacccacaccaagcatctcacagtcttctgtaactccagttctaggggatccaaagctctcttctggactctgtgggtaccaggcatatatatggagcccacacttacatgcaggcaagtgctaataatataaaataaaaacaaagcaataaatcttcacagagttggaggaggtggggtaggaggtggggggagttagggggaagagtaaggattgcatgtgatcataatactctgaaattaataaaaatattatgttaaaagaatcctgtgcaggctactgtaaaagcaatgcaatccaggctcctgacactcacactgtcatccatggaagacagcttatcgtatagttaccattagttacgttgacagtagggcaaatgaagaaattgagggaggggacctcaagacttaaataccctggcatttccatgacatctaccttgtgaccagcagacacagacattgcagaatatgaaagggtcagattgttgtcaactcagtatcatggagtatggtcttcacattaacatctgtctgcagtacacctggattggaagacacaacactgagaccccatcacagatggttcggaaagtttaatgcaagttattaccagccaggcagctcactattctgattcttccaactagatgtgacaaaacattactggtgtgtaggatagaatacatggtctatattctttggcatgtctgtgccatatatgtatatgcatgttatcctgggtatggggggtgtatgtgcatatggaagtcggaggttggtcctgggaattctttctgatgattctcccaccctgttcattaaggtaggttctttgcatcagagcttaacatacaggaagtatcacaagggaaccactatgcctgtgtggcatttatatggattctgggggtctgaactccaaaccttttgctttccacctgtcatttacatggattcaactgaacccttgttgccttgtgagcaatccctgtcctataggggattctgtattttaaacacaccctatcctgtattttaaacacaggagatactatactttggaaagggctagtccaattgattaatgttcaataccagatacataccagatctctaagatttaaaatgagttttagaatgtgaactacctcattaatgttttggtgttgatagcagactaaaatgatagtattgtttggatgtatcaagtacatcaagatatattaataagatacatttgctttgttgttactacagtatatttccactagtaggttttcttctttgacaatttgatacatgcatgtaatattttctgagtaccctcttatgctctcatcttccttccaatatttctagcctctacttccctactgatttctttccagatttcatatcttttgtcttgtgtccccctgcatctaagttaggccatcttacgtgtgatcctggatttggaccactcacctgagcctggtaggtttgccagtggcttcaccactagatactatgcctccccctcacatagtctgttagctgccaataattcagcagtaagtggcaaggctccatgagcctctccctagtccatagctgactgttggctggggcattcttttgcaggttcagtgttaataacaacaacagatataaattcatgatttccatgacattgtcatgcttaaaagaatatatttagcagcctttcagtctatctttgggcttgtaaattctttccacatcaccttcgtaatgatctttgtaatcatctccttaggacatggtatgaatgtcttgtttggggctaagcctttaactatcatttattctcagcatcctgtccagccagaagttctaaatgcactgctccttactgcaaagataggcttctctaattagggctaagcgtatcctttgtaggtataaacacagatgcatggaaggcagcttgaggttatatcagcttatgttattagctaagctacagtgtacttttcccccactggggcacatgctcagttacaaatgtttcactaggcatacaataccagggatgcgttctctcatggagtgggcctcaagtccaagagcagtcggttgctcatatagtattcctgccattattgtaccagtgagcccgtcttctctgacaggttgatagtgtagttcatagagatcacagctgagtaaaccattaatatctttccttcctgcagcagtctgtagcactgttggacataatagtgagaagtctccagcagagaggaagcttctagctcaattccagtttgattcctttatactttgcattcaagatctgtggtgccttcaggaacagtctccctaaccaacagccacagcggtatcccacacccggcactggacattttgtttagtggcccactgctcctaggactgacattatcaagtcatggaaggcatctgccatcaaatttctttttgttttgtaaactggatcatgagataacaaagatagcaagtttctatccttaggtggcatttcatatcctctttctttttgttaacccctacctattctcccatcttcccctcttccctccctcatcctgattaaagcttcccacctccagctccagcatcctccctacccacccataattttacctttgtgctactgtctcctctcccttggtgtaactcctctacagctgccctctctgtaaactctagcttaaggtatcatgttctgattgggttagacatggttgttccatgggcttgttggtagaaaactcagggctgtggttgtgtgtactatggatggtacaaagcagctctgtcacatagtggcttagcttacctctcttctccatcctgcccctgctgcccctctctagtgagttctcttggttagtgagtaggacatttatgtgcttgtatatcattttgtcacacagattaactacaaggctgtgggctcactggatccaagtgctgacctctccagccagaggggaaaggtgttcaaactccggaatgaaacccaccacctctttgtgggtctgtaccctgggactacctactctttcaccatcaaggccagcacagccaagggctttggacccccagtcactactcggattgccaccaagatttcaggtatctctttagagagagaaaagtgggggatatgcactatacactccttctcttgtaggcttggtaattttctggaataaaaagagacagaaccaactatcattgatggcaatggaacgatttagacaatgatttaaggtcattgggttgctcaaagtccaattcctgaggttcattaagaggggggcaagaatgagcgaatgagggagagagagagagagagagagggagagagagagggagggagggagagagagagaacgagagaagttatagttgttttgtagacttattttccaaatagaatactttgtagtataagatacccccagtactggctctcatgaaatatcagatgaagggataaagggatgaaggaatgaatggccaagctgcaatagcctaagattgcaaactgttctaccagcagggtgcaccaccctgcctgacagcaagaagcagaaccactgcagaatgcttatttacagcttccctattttggactatctatgcaatctagtctgcatgcatatgtattttgcagaagccatgattttccgtagcttaatgtttccacttatccttctcccctaagtatttcccacactgctttcattataatgttctgtcaactggatggacgtaatttaattaaacagtcccttgtggttgaatatatttggtgtttctacgtttttataaaatagcgctccaataaacatgttacaaaataaactttaaatcgttgattgggattataactttaggattaaattcagaaattgaaaaaaagaattaaaagagatgtgggttttaatagctcataatacaaatggctaaattaccctttcaaaggattagatttagtcacactcctgtggggggaaagggtcttgtgaaaaaaaaaaatggagctagttcatcttccctttaatttgcatctaaatgcacataacaaggctgactctcgtcatgtctttataaagtacttacatgtcccatgtattcctttttttttctgggtaggaggggcacatttttatgataggcatgcctgatgcctcctcagactatagcactgggagagaagtagatgggaagccaaggcctcccctattgatggcctctgacatcatggtgtccttactaccactcactacctctgttctgctgggatgggatcaaggggataggatgagataggataggaagtgtcgaggggtgtatgggacatgtgcttgatcacttccaatttctctctctttcccagctccatcaatgcctgaatatgacgcagataccccactcaatgaaacagatacaaccatcacggtgatgctcaaacccgcccagtccaggggagccccagtcaggtgaggaactatggtctgcacttctcccttctatacctcacacatctccatgtgaagcacatgactggcaatgttcctggcttcaataagccagaagctagatttgctacaaggaagatggtcagcaactctaagcccaatttggaaggagacactgagccaggatcttcctcacagtgaacatcagtttaaagagaacatcctgataggggcctaaaatggccagggagagaaatttctagaacataattaaggaaaatgtagtttgtgggtggaaaacctatacccagtgcttttgcaatattgcctgattcactgctctaatagacagacaaatagacagacacgcagtcgggcagacaggcagactctgaattctccaaagaatctgatcacagattccaaataggatgagccctagcagagactcctttccattcagaactatgaggtgctagagtcccatggggccatccatgcctgcaatatcccgctgcttattttagtgagagtttgttggggctcaaatgggcacacaggcaccaagaacagaatcttatcagctaggttgaccagggcaagttcatagctgtcaggatggattgtcattcattcattgtacaaggtaacagtgttgactgctgggtttgctcaaaactccaagcctcgagccctcagtccatcaaaataggtagaatgttaggtagaacttccaaatgggctcaattcaacccagcaagcatggaccaggtctctttatataatgaatgggatgtgggagctgttgttcagactagagtaacagagacagacgtatgacatagttacaatgctatgacgcctcatggaaatcttcacaggacttataagcacttagaaagaactcccagagaaggtgacactgagctgaataaagtttgacttgttacaagagtccagtatgatccaggagaatggtggcttgttaaaatcaaaacacccatgcctagtttagtttgtcttaaactaaagagcaagctggggatggggagatggataagaaacagggtgcgtgtgggaggctcaggctaatttgagagccatgggatctacgagagattggctttttagaggcctcaccttgcatgcctctgggggctgggagacaagcccagaggaagcttttgagatagctagtcctgatcttcattttcacccttcattcaactctacccagaaagtatgtgatgggggcaacagaatgaagccacagaaatgcagaagttttggcctagtctgaagactgggggatgaccctctttactaggcccagggaaactgaccagccatgtgttggggtgctgcttatgggcctcttactacagcgtgtcaaaactgtctttcctctaataatctaaagcagatgctggcatttcataccaaggtacccattccctgctttccctctagctgctctgacacaatgttctcatttagttttccatatagacagcgagatggtatcttcattttcagaccaggaagctcaggtgtagaaatgagggtatcgaaggagccacatcatactgctgtgtacccatcatctgtacagcattccattcatcagacatctgtaaagctcccagatttaagatttggaaattgagacaaacagaagctgatgagtttatgtataccatgaaacaattagaccaggcaagacagaagccccgttctgacccttaccccacgttcatttgactgaaccaaaccaccttactaggaggatggtacacatggcatagtttgctgacatttccatctcgagaaatggaatgaaatgtcaccgctcaaaggggaaatggttggtgtctagacatctctggctgctttcctcctcaaggctctggttcactgagagtgggtgtacgctctgtctctggaattattttcagaccagtgcctgggcatttgccaagaaggggaggagactgagaaacgacatagagaaggcctttcaggacaactgttctgagagcagaaacactactatatatctcagttacccttttctattaatcctgggcataggatatgcatcttggaggcagggggccacaacaggtatttattgagcacttgctatcagcttactctgccttcttgaggcttactcttgcgcaactctgccattgaataggtcagggaggtgagacaataagcaagcacctatgccaacaaacaaaacaatgaagcaaatcaagggatgtagtgagccgactgtacagactggaaggacctgtgggcttgatggagaaatgagctacacacaggaaaacaggaactgtgctactctgtaagctggaaactaggagctggtaagaaaagcagctggctgctctacaacctgggaccatccccacctcccagcttgcttcaggcatttggccaaagatgccttgaatcatgttttaaagttgttgagacaagcatccaaatgcctgctagcatagtacagtagatgtagtaggcaataatttataacatatttcacataactagaaaaatgtcaaagttcccaacgtgtggaaatgacatgtttcagaagcccaattatccaagctcaatcatgatatacggtgtgttccactattgaattatcatttgtaccctgtaaataagcacaaattttatgtcagtatgaaaagagccatggttaagagaaaaattttgtctggcaagatagctctgcagataaaggtgctttccactgaacccaatgatatgagttcaattcctgggaatccacatggtagatgaaaagacctgatgcctagcacattcaaattcatttacccctatttcccccaacaaatcaaaaatatagatgtaatagaagcatacaaaaagacttcacaattgataatattttttatttctgttgaatggcctgactctaagttttctggtaggtaaattagttgggaaataccatccctatttgacacagagggggagagaaattaaagtctgagatattaaattattggttcaaggtccagtgttatattaatttctccccgtggtaacaaaactcctgacaaaaaaacaatttaaggaaggaagaattgttttgggtagaacagtttaagggtagaacagtcatgatgactggcgaccctggcagctagtcacattgtatccagttaggaagcagagaatgatgatctctgtaccgacttccttttctcctcttccatcaactcaagaccacagcctgtggaacagtgctccccacatttaggataggactttacacctcagttaacacagtctagaaactcccttacggagacttgccatccggtcatctatatcctaactcgtgtaactatcagatagggagttgaacatagatcagagtctgaggtcattgcttccccaatagttctggcttgtagtctcactgggtcaagggaaactggaaagaattttagggggtgctgtatagtgacgaatttttgccagttgggtataatattggggataaggggtgtgtcctatgagtctggactgcatgccccagcctataatcttccctctatgtattttcctattttaatcctcatagattcatccctaaaccttggcctccaggcccctaggccgtcttttcttcctccaacccacactgcttaactgctgatagggccaaattccagcttcccactccttggaagcctcccaggtttgactcctttgagtagggctgagaattcagagcaagaaggggggtggtgtgtgcaccaaggagctgactgcatgaggttcctgcaccctccagccaaaccaactcggcagcttggcctatttttctaatactctacaatggagatttattgcttttgtattgctctcctcgggccttcaaagatttattggtttttaagtgacagaatcccagaattgcttaaaagatcaatcaaatggtgactggaatctaatattcagctctgacttgaacacactgaaccttcttcccccacgccccacctgtcacactgatgtatctgtggtaaccttcataagaaagtaacttggccatgaattaatcacccataatgcagtccctgcagtgagacgggggatgggggagtggggtgggtgtgcgaaaaaatctgtgggagacacttccccagccacagcagacattcttttgaggatcctttcctggtctcctctctcatccactcattctcctgcattgtcccctggtttgcagatcagccctggttggaaatactgctttaccagccccattctcctggccggctaggtgccctgcctcatgtgtctgtcaaaagcatctctgtctcaggtctgtcccccaaccaaactgctggagtggtccttgggatgcacaaattggatcaagttagcttccctgcttaaaattcttaaatgggtcactggttttctattgcattaagttcaagcttcttagcatgaaattcaaggcctgtcagcatctgcccttaaccttatttctcgtttcatttaaattcactctgcccctttacagggttttacacaacagtgacccatgtgattccttcctggttcatccctgagcttttcaatgtgtcatgaatacattatacatctgtaagctttctttgttttgagtttgtttgtttgtttgtttgttgttttattgttttagattcccttgtcttgaccctaagacacttgaagtcttggtgccaccaggccttcttaacttggaataacatctagccaatagtagatgccaaaaaacaaataaaaatacaagcatgaagcaagcaagcaaacaaacaaacaaacaaacaaacaaaatagcccaacacatagttaataaagcgtgtgattatttaattcagcatatttgtcatgccttccttgtggattccagatgctaaggccatgcattttgttagcttccttctgttcctaaacagaatagttatcagatagatcttcctctgacattaaagatgcccttctttgtgagctgtctggtcggatcgccgccgaccacacgtgactgtcaagcacttgatgcatccctgccataacagaggaaccagcttgttttatggtgctcacttttgatcagtgtgatatttcaacactggcacagcacacattgatcaaagccaacctctctctgtctaccctaggcatgcaacctctagctaccaccattctgcatggcttggggtctctataagagagaatatctggtctatgcctttttgtgtctggcttcctttgtttggcacacatttctccagtcccattcattctccttcaaatgacaggatttcatctttctttatggctgagtagctctccattgggtagatatactgcattttctttatccactcatcggctggtgggcatccaggctgattctgtatcatttctattggcaatgtgtgctggggtgggagagcacggtcatacagtggagctgtctgcgttttcttatgagtttcttttacttcatatccatgccacattatttttcattcgaatttgataacagccattctaaatagagtgagatgatacctccctatcatttgcatttacattccccttagtggctaatgatagcaagcattctaaaggcatttattggctatccattaggcttctttgggggatactgcagttagataagagcaaacaaggatggaaaagacaaaaagaggctatgagggtgggtgtgtagctaaggattctcatgagaggtatccagcacgagcctcctgggcatggaggctggagggcttcctggagggaatcctgcctaattgaggtgtatagaatgaaaggtatttaatgggagagagaggattgggagagagagcaatgcaggcaagagtccatacagagaaggcacatgggatgttctaagagccctaagtagtcagtgagcagggcaagaggtgaggcagaaagaggaggacagacagggactacagcaaggtctccctctgccctgggtttggactttgtcgtgagatgtaggagggatatttagtagatgcccacattttgtcctctgtgtgactggcttctgttaatgtcactatgcaggtatgccattaccttcccaacatccaaggtcagctgccacatcccagactgtcttgcccccatcctcagtacagaatgcaccatctctccagtgctgcctgccctctgccttcacccacttcctatcagggtgtggagtctgtgtcagtgactgtagctctttggggacaggagctaggtcagaacacaacctgagaccaatatgttctccccatcacatctgcctcccagttggacacaataggacagggaaggcttgtacaataagactcagctttactgctgggcgtggtggcacacacgcctttaatcccagggaggcagaggcaggcagatttctgagtgtgaggccagcctggtctacaaagtgagctccaggacagccagggctacacagagaaaccctgacttgaaaaaccaaaaggaaaaaaaaaaaaaaaaggactcagctttatccagcagtttcactgggtagctttgcgccaggtacctaattctgtgatccttgagttgtctgatagtaagtagaaacatatgtgtatatgatatcacacgtatcgcatacacatatacatacatacacatatgtatgtatgtatatgtgtatgactgttgaaggaggaaatgccccatcctactcccacctataggtggtcacaggcaagtttatcttctgcacctgcttcaagctgatgtccctaaactgcatgtgttctgaccctcaggtgaggttgataacaatgtaggtactctggcaacccagtaggctcaagaatctggtaggtgttacagcggcattctgggtacttctcatgggccatctacgagaaaagttagaacttgtaacctgttcttatggcgtctgtaggggtggagcagctccgtcctgtaggatcatccaacggtatacaagactgacactagaagtcagtgcatcttgccaatggcttccaaaggtcacagcaagttctatttactccctgatgagaatctctgggtctcacgcagttgacaggcacgtctagttagggccacacattctgaaacgcagggtgattagttgcagtgaaaattggagacccagccaacttttaaagaatgaagaaactttactgggggaaaaaaaacagaaaactattgccaaatttcctccaggattcctttaataacagcaaagcccggagtgagagcacacggaacaatcacagaagggttttgctggtccgtggagctacagcgagcaaaattggaatcattaccatctgattctcagacaccagcatatgattgtgtccaattaggaagaagaaatgaaaatttggaggatttattagcatggggcagcctgaggagtttgtaagtcccagttcacatggaggtagatgagagacagcaattacaatcattctctaagccgtgtttgttttgttcaggtccccccggttctcctggccacctttgctagggactaaatatgaggagttctgtgtgccctgatttgcagggagcatttggtagagatgagaggtatttcatataacctgtaagaagatttaactctgtaagtaactaacactgcttgtatctgtgcccaaaagcatgctgggaatgtatcacactggattagggaacatgagaagccagataaaagaagcagcagtggaaataagaaataagaggatgcatgctgttgtattttcttcccacagtctaactatggcactaaaggaatataccattttaattagagatatgtggaaccaccaaaggagatgggtcagtcctgtgtcgaaccaaagaacaacaggcagacagataattcagtcttattacaaaagcaaaaaagcagaaaggcaaagtatgtgaaactatggatatgttgatttcgctttgctatggtaatttctgtgcatctctccttatcttactatctatcgcccatctatagcagcgtacataacttggatatatgtactaaagtttatctctttaaggaaagaacaattttacaggaaaacaccaggggaaaaaaggcaacacttgaataatatagatggggtgcattcacttggtctcagcctagctacactgctgagttcccattataaacctgccctgccagcctctaccctcactctgctgcccagcaatccagcttaccaagaactggctctggtgttgggattttggattgtattactcagtctcaaaccaaggagggggaaaaaacaggtgtttggaggagagtattttaaatggagcagtcgatggaacacgaagagtgagcgtgttctattttgaactgtctgccatctggagagatggagactggggctgttgctgccaggatggagagaagagagtggttgccatgttcacctcctaccacaggggctatttaagctctaaacgtctgtggtgccggagaggcgtctgagcagaggtttgcacttggaaacttcagcatcactgtggtgtctgcaaatccagcaaagaggaggaccacattcaaggacagtgcagaggtgagtagcaggagagagttctgtgatgctgtaccaagggacagatcaaagaagggagaaggctaggcttgtgaagaagtagaaagaaacccgtgttagtatgattatagtataaccttatgaaacaggaaagttaaggaaactgattacaagaaaaaaaatggccaacatttttactttaacctctaatagaaaataagaaagaggactggagggatggctccgtggtaaagtaccaactgttcatgcaaagaactacattcagattaccagcatccatagcagacaggacacaactgagtgtaactccaaatccagagggatcagccacctctgtcatccacaggcatctgcactcacatgtacacacacacacacacagatgtacacatacaccatccatgggcacctgcactcacatgtacacacacccacacagatgtacacataccccatccatgggcacctgcactcacatgtacacacacacacacagatgtacacataccccatccatgggcacctgcactcacatgtacacacacacacacagatgtacacatacaccatccatgggcacctgcactcacatgtacacacacccacacagatgtacacataccccatctatgggcacctgcactcacatgtacacacccacacacagatgtacacatacaccatccgtgggcacctgcactcacatgtacacacccacacacagatgtacacatacaccatccgtgggcacctgcactcacatgtacacacacacacacacacacacacacacacacacacacacacagatgtacacatacatcatctatgggcacctgcactcaagtgcacacacccacacacagccatacacatacatataatgctttacaaatgaaaagaaaatttaagagctacataagttgatcaggaacaatagaaagttaactgaagtgctgtaacgggaaacatctgggcgaggcttgcttaaaactaatctgaaggtaagggcagaatgtgagctgctggtgcaactcttgcagagaaccagggttcccttcacagcacccacatttggcagctcacaattgcgtgtaccttcagctcctgcagattctataccctcttctggccacccacaagcacccacatgaaactgtacaaccacacacagaacccatgtgcatacacaccacaaaatataagtaaggatttcttaaaaatagaaaggcagatatgcatgtagaagagatgctgaggcctggcagatctcactgttgtcagagaatctttatacaaggcagagacctgataaaaggaaaaaaaaaaaaaagcagcagggaatgatggtctagggataagatgctggaaggtaggccataataacaaaacttcccatgggataactgcacaaagatgtgagatgtgaaagatgcgagatgtgtggtaatggattcaaggtgaagctcttacagtcagatatactgaggaacaatagactatggaaaggtgggagggctgtataagtggatatagttttatggtgtttccccacacagagtgggggtggactcatgaagccgctgtcagagtagcaaggactccaagatcccttctccacgttcccatctctccccaacttttattttctactagcttctatgtcttttactgctctcggccctaggacagtttgcacccctactgtctctcagattttgagcaactgataactggtgactcacagtatctctctgcagctgcccaaagtcagacattgaagtctgcctcacctagtatatttccatatcctcatctattggtgtttttttctgagctagcacatgtatttgtgcaaccatagtatccaaggaggcttgttcttctgaaaaacacacatgcacatgctctctctctctctctctctctctctctctctctctctctctccccccccccccccaatcagttccagctgcctggagctggtcagagagatcatattggagactctggatttttggtagggaaagaatagcagaaagcttacagtctgtgtggctcggaagaagaactggatgctccccttttccccttccccttcctctttcccctcccccnnnnnnnnnnnnnnnnnnnnnnnnnnnnnnnnnnnnnnnnnnnnnnnnnnnnnnnnnnnnnnnnnnnnnnnnnnnnnnnncctttcccctttcccctttcccctttcccttcccctttccccttccccttcccctttccttttctttctttcttttctttctctcttttttttttcttattttgagacagggtttctctgtgtagccttggctgtcctggaactcactctgtagaccaggctggactcgaactcataaatctgcctgcctctgcctcccaagtgctggggttaaaggcgtgcaccaccactgcatggccccctttccttttctaacctggctacagctgcttagggattgctgtttggctactgtgtttccacgagggtgtcaacttgggactacattttttttttaaagcttgcaaacctataaaaaaaagtacccattttgagactaggaagtaacagcccaaataagagaagaagaagggtttgagatcatggatttagacctgaattgtacaatgcagtagccacagtaggtggatatttaagttaaatatatgaacgaaaacattagtccattagtttcatcagccacatttacaggatctataggtagtgctggatattatattgaacattatttctatcatagtaaaaaaaaaaaatctcaccttgtgctgtgctggataaaaagaggccatggtttcaaattgtattgatgatacagatctttgaggatacagataaagtccagagagcctttcgtgagagatgaacaggataatgggtagagtgtattgctaggcataagacgtgaagttcctgaagaataatgagccctgcttttgggttacttgctgctgagaccctgacctactaagctggaccttccccctgcatagccccttcctagggataacgtataggttctaaacctgttctcaaatggttcttaacattaagcagtcctcaaaccatagattgtgactcctttgcgggggcatcccaataactctttcccaggggtcacatattagataggcctgcatatcaggtatttacaattcataacagtagcaaaattacacttatgaagtagcaacaaagtaattttatagttgggtcacagcattaggaaggttgagaaccactggtttagggcatggttaatttccatatggttcaaatttttgtaaaacagttattaggagagctagtccacttgcagattcttgactgtgtccagggatgaaaagatggggcccaagaaactgcctttagaatatgttcccaggtgatgctgatcctgatggtccacccttgcgaactagtgctttagccaataggtgacctaggtggagaaaggagcctatacagataatcaggtaggctctctatggtgctgatatttgcttgtggctatgctgcgagaagcagctgttttatattcttctgggataccaccctggctggttttgcagatttcagaaccccgtgtctcgatggcagtgtatttcagcattcagataacagtgttagctcctaagagctgatctagaatctgccagtgtgttcctctattcctgtctacatgggggcttaaaaacacacccctgttttctgatgatgatgacaatggctggtgtctgaaataattcatgttgtgttggcacatgctgatggtgaatcttaatatattgcgtctatgcagatgttggggcgtaggtagaagatggatgtgcggtgaagctgaacatcagaccccaaacaaatctgtattcttttgtagaaggctggagcagcctgagagagacaaatccatttctaactttcactctgtaaaaaaaaaaaaaaaagttctatattttctaagatcagacaaaatatatcgaatgccaacatgctgcggcggtatgggcgcgtcactcagctgggctggaatcggtatgcattgtccccctgggccagttttgattatgttcctttacctttcattgcagtcagcaaatctgaatttgctattgtgaggagagtaggaagacggaggggaaaaaaaaaccgaaggttttaaccttcagaaagttcagaggttcagtctgaataagcacaaaaactttcagcgcgcctctgaattccttgaattggcaaaactgttcagactcccaagagaactactgtgcaggcaggatttgggccttgctttgtggccagaagggagagatgaaattatgaggcacagagtcgggaaaagtgggaagaggaagagatgttggaaaggggtggggtaccagtccagagtcagtgttactctactgttctgttttttcatttctaagccatctgcttcacaccgctcacaggaaacgactcctctggcaggacaccctgttcctgcttaattgaatagatttcccaaggataattgtttaaaactatttccagtggttgtaaagtcatggaaggagtggaaaagattgggatacagatgtatacacatgggccaggttcaaagacaatgcatggtctgtgacaagcacatatgccccccccccaaccagtgagctctctttggcctccacagcatacaagtggctctgttaaaattggcactgtctccccatcagggacctgtggagctgtgagtgtgagaggaaacaatcacttccattcaggtttggagcaatgtgtttcccaggcttaattataccacaggtatataaattacagaaacatgttaatgctcccatgattaaaattatagagtgcctaattgaaaaagcataaactgaattgaagaattcctaattatagtttgctttgaggtgttaatttcctccataacgaatgcataatttcttggaacctaaaagggcggcctctgcgttggcacctaggcttcagaaagatgaggaagggctgtctgtcattgttcatagtgggaagttcacttgggaagctgggttgaggtccagactccagggcatccttgttaagcagcttgagagggatagtatgggagcaggaccttaatctaaggctctgtctggtaagatcaaagcagatgaggagccttaggttgagaaatgtttctctatccccaaagtctttatcttgttccctgttggttttggttaagtctgtgcctatatgtcttgatctagatttctcagcattacatggggattcattaaaaatcaaatgtttgagggttcagggagatgcttcaattggtaaagtgcttgttgcacaagcatgaggacttgagttcacatcccagcacccacataaaaagacagatgtgatgacacactctggaaaccccagtgctgtgtaggctgagatgggagaaaccctggatttgctgacaattcaatccaatctagaagctccaagtttcattagagtatgactgaaagacagacagaagactgacagacaagaaagaaacaaagacagacaggaagaaaggaaggaaggaaggaaggaagggagagagggagggaggaaaagagagggagagggagagggagagggagagggagagggagagggagagagaggaaggaaggaaggaaggaaggaaggaaggaaggaagacaaatatggcaaagggagacatctggtgttgactgttgactcttcaggcatgtgcacacatgtacacattcacctgtacacatgcacatatacccatgtgcatacacacacacacacacacacacacacacacacacacacacactgaagtgtttaagcccctctcaaaacctattgaatcagaaatcctgaagttgaatctggaatttagcaagacttccaaaaattctataatgtacaccaaaatttgagatccagaatttaggagtgagtcacagacacacagacacacctagctgcatctttttgtatacttgctctgggcaggagcgatggttggcaatgccctggacatccttccattttaccattataatcatgctgcaaagtagaaaaagaagccacctaccttatctctttaggcaatgcccattagacacttgaggggcttttatgggaccacacaggtttcaatgtgctgtcttgagagtttctcaatgctgtcacacaatttacatcagtatctttactgattagttgaggaatgtgccataactgagaagaaaaaaattgcaaacgctgaatctgactatgcgtagggaagactcctaaatgcctgttcccttggctatcagcagcttcaggtgtgctgatgcgttctgtctgaacagaagcatgaaggtgaagtacaagtgtcacagctcaaaaagaagcttcacgtttggggttaaaaacaaaatctttgtattctgcgagccaaacagcagtaaaacatccctaaagactctggagtgcagggaacttagcttagagagcacaacgtagacatgctaactctccttgctctatcaggattctgtttctctctctctctctctctctctctctctctctctctctctctctctctctctctctctctgtgtgtgtgtgtgtgtgtgtgtgtatgtgagaaagagagagagagagactttcaccaatgtgtaggcatttgaaataataaatttatatagctgctttataagattctttcaggtgtttgcataatttttagccattctcatagagttgaaattttgggtcatttccagttatttgttattataaagaactcaactataatggatttattcatgtttttcttttgttattgtacctttaaatagaaaaaatagtctccaggagtggaattactaagatgaataaaatgaaagagtatggtacaatatgtctattctcatacgcaggtactgacagtcagttagatccattaaccttttcattctttaatttaaaatctcaaactaataaatatacatagttagaaaatcaaatagcgaaaccctttcctgccccatgatttacaacccctcccttttctgccccaggggtgactgtatttcaggttttagctatttcttccaggaattggtgtatttctacacaatgctctattttaaggttattgattaaagatattatctgtttacttcctgttttgatagatgaaaattcacctgtcctaaaccatgtaatacgtctctctcttctatccacccagtagaattatcccctacatatttttaaaatataaccacatatataatagctaattttacaattccatcaaagcaggtttcttcagagccaagtggtatactatttttaatatagcatcatgtaatttacttaaagcttactaagtgccaggaggtaagtcatttacatatgttaacttacttagttaattcttatcataactctgtcaaataagacctgggaggaggttggagaagtggttcagctggaaaaaaagaaaaaacaaacaaacaaaaccttgccttgcaagtcaggggaaggaacttctaatacctggtatcatgtatgagctctgtgggctggatgaccagcctatagtggagcaaacaggaaggggagagggcgagttccccagatcagtctcaaactgtgagctctgggctcagtgagagatacccttttaatctaaagatggagattgatcaccaagactcagtgtcaaccttgggcctttatatgctcatacacacttgtgcatacatgcacacacacacacacacacacacacacacacacacagatggggggcggtgggggaaagatgtgtacatatacaggaagaactggaacacctcccctttattttacagttgttgcggtggagtctgaactatagaaaggttaattaatgtatcctagactgcacagctgctgaaaaacttaataacctgtctctacacttgacagccttcacttcaccactgcgttacactgccccttaccgcccttccagtcttgtgtagagggaatttttgtttctctaactcaacatgagctgtacgattatctgttatctttggtagtatctaactaaactagtcagacattatttttctgcccacagagactccccatttcagtgtgttcaatactagccaataagaatgtagccccagaagcgatagatgaatgcctgtctttaaaaaggccatttagttatatattctaggaaaataaggaccatgaaatttcaatctgtgtataatttcactcaaatttcatttaaagaggcgtttgttgtgtcctgatactttcgctcattcttgtttataccacgcagcctctggggatagtgttttgatttgggagaggcacgaatccagtaagctgagtagctgatactgaaggaaaggcggggaaagttgacaggcagcaagcagtctggtttggaagtgcaggcatccaacttctcaaattgtggagtctcctcctgtgtcctgcctaaagggacagacactgggctccccacaccacagcgtggggacctcactttcaatattgactccttactcctcccgttcttttccttgtggatttatgttttccattggtcactctcattttaatgggaggtaagcagaatatgctaaaccttccactttgaaatagaagctccctttcgttatctaactcactgctcccagtagtaactgatggggacattgctgtcatcagtttttacaaatgacaccactaagaaggccacacagtaaccaaggttcagagtcaaagttcaaattcaatgcacgtgccaaagtgtacatgctctttttactcctaggtaataaaaccacttatgaaacttgaaagccattgacagatttcttttctcccaatttgatgaattatggaacaaagatacaatcacagatctatggaaaggttgttgtaatttacatattaattttgttaatttaatgcgttcacatgggaacatactgttttgcatttcttggctcattggtaacatgtatattttcttatatatttatattattgacattttcttgacttttcatggcaatggttatactccactgttcctttaataatttctgacaataggatgagactttttattttgactggaggttcaggtataatctagtcaattaatgaggaattaattaataacttatatagagagcaaggctcccaaacacaagactatcctgcccaaaatggcaaagtgccaatgatgaaaagtttttaattatgggtgttttgatagtgttttaaaattaaaatatattattctgtcagatacacttgttcctttcgagttgaaaattctttaaacttttaaaaatcagtaaaagattcccaaaaacattctgctcatctgaagatgggttttctttgtcaatatttactttaagaatggatgcattttaatttatagaaaagtaaatctaaacgaagccaaatgtgacaatatatcctgtaggacacagcactccgtagcaactttgaaccaataagacagaaagtaatggtcaacccattacatattagtatcaatgaaatgtttttagtttcaaagcattaaggctagggggtggacagtttcatatttttcaaatcttttaaatgtctgacttgatggagcataactggattcttctatgtacttctgcatttaattaacctttaattgtttgggttgaaacaaatcaagaaaatgcaacatcagtgttgaagttaggccctggttcatcattccagccccacactctcggaaataagactcgaacttaaaatatatttacaaataccttggctatacagctaggttcttctctgatcagatataacctaaaatatcctgtttattctagcttagattctgccatgtgactggttaccggcatctgtctccttcctgattctgcccagaatcccttctctcccctagatgtcccacttctatttcctgcttaagccataggccataggctatgcatccatataatacacaagatgttctccctataattcccccttttagtccaacaaaaggctccttttctttcaaatataaattgaatacaaagatagcatttatgaaacaactatgaaaactctaaggtatgatatttagcaacttagacaaagtattctattgtctaaagtattctattggtgagttcagagttctgtatctaaattattttccatcctaacttgtattattaacctaaaaacatctccttagacctgggacatcatcttaaaacctaagcttatataagactatgactatctagtcttcaattcaatcagagacctgagtatacaggaagtgcaaggatgcatcttccaaaatttatagaaatgacagagacagctgattgtctggacagtccccaatattatctctataacattggaacatctatcatagccttcaggtccagaatatctgacagaccttttgtgaatcaggaagtatgaaggagttgcttaccctgtttggcagagcttggcagtcaacttccctgcatctgtttgtcctttctggacaacattttgtctgcagatgaagttagagcattttctttgcccactggctagattgccacaattgaaacaactccatatggaggttattcatattcaccatcttctttgaagtggaatgggggtactgccaagggcatccatgtctcacgtcagacacacacataattcgaaacaaaagaagtgttttaatagccactaggataattggctttttgcttttgttgtttgtggtggtggtggtgtgtgtgtgtgtgggggggggaagtagttggtattacattcaactctggtagtttcctaacatttagttgcaaagcaactaattttttttgttttggtgctatattttcaaatgtatctcactcagttatacttaaatatgcctacctgtcatacactttgaatgagcctttagtcctcaaatgattatctaacattatacagtagtcagagttataaaaatctcccaaatgctgtgatatgcctcatcatagcatatcaaattgcatatttgctatcgccaccaatctcatgtagggaccagggactttcaagttcacagtgacagatacaagttttccaaattctaattttcacttgaaagctcaattatgtcttgataaccaatgctgtccattttccttaaagtgacaggtagacttcatttattttggagaaaatgttgatcatgtattccagcgtgaatggttgtaacttgtcaatcactcttccaaggaaataaatggaacctgagtgagttcattgagtctaggagtttgagtccagccagagctgtatgttgaaatcacatctcaaaataagtaaaataactaattagtaattaattttaaaataccccaagaaaaaatatggctattttgatatgcatggcaaccacagaactatttctcgtaacagaccataaggtcagaaggcagaaggtgtaatttatgcacatactacccattgtctcatgggaatattagttaatacacactcaaggatttgtacttaacaatatgaatacttctgctaccccatccaagacttgtagaatacaggataggaagggttaggtgccagtgtcttggcacatgcttaagccacaattactattactctctgtgtgttaacacaaagaaagacttgtactattagtgttgttcttatgtttgccaagcaaaacccacagttgggtctctactaaaagagaatttgtttggaaataaagaaaactagcatttctacctggaacatgcatgtgaggcctctgtgactagcaagtgatgccactcactagattaactgatcttaaaggattaagtaaaagtagtcttaaagtacttagtgctgttttattgcattgggtctaagaggcctttccctggagaaaggtctatggcaaattttgttgtattttttcctttcaaatctcttttagtggaatgttaagatgactctactttgcacaacaattccagtgttacaaaatcgctaagggggttctcagaggtcctcagggtcagggtatattatggaagtccatctgaggaactgctaaggtaaattcacaaaagacatttctggaatttggtgtatatgtaaataacttggtgaggttcttactgcctatgttcctccaccacactctcagagagccacagtgatattccagaacccacaaactttgctgcacttggctgtcggcctgacacctaccactctctaagtgaatggaatctccatagcactgcattcctgtggacacctcccgcactgcagttcctttaggaaacctgttttaattggtggtataattcttctctagcatttatttgccccatctggctctactaaaccagctactgtgattaatttaatgcttaattagtaattgttacttttaccccatagagctttgcagaaccctttttttttttttttttttgataattgattttagaaggtcttttttaaaagacatacttagaggagtctcacctcacaattttccttttccaaagtgtctgagttgcaagaagagacatcccagacattctattgataattcttaaaaactatccctgtagatggcttccaaagagcatcaccatggcttttgatcacaatatctggagccagaatccctatcgtattggaacttaccttgttcaccattttgttttttctttgctcttcttactacacaaggtgactgtagaaaacaaagatgtttctggagcaagcatggcaggaggttgaagcggtcacttcccatgatatctgaataaaaaagcaatgctgggagacctggcgagtagtaagcagcaacacaaaactaaatgtttattaaagagaactgaaattcagaaaggaacctttgcccctccaggaagagttttgtttcacttgcatcttttcagagtttaatgtacaaatgaattgatctgagattgactacaatagttcggtgttcagtaaaactggcatagggtctgacgtgttgaatctcggcatatccctaggcaaggaggatgctgcaggaccacggacaccaaccgacaatgccctcggcattctgcctcatctagctgttggcagttaacactgcattgaacaaactttattaagtctgcataaactttccttaagtttgagactaacgcacacccaacattagggaataggaccatgaggtcaggtagggacctgataacattggtacatactaaatagtatcgccaactaaggtgcaaataagtatacagtcatacactctaccactaaaatatagaaatgttccattcattaaaaaatgtggcactgtatgttttaatggtgtttccatgtttctaactaccttaacttctcatctaatactgaaatagttcgtggaatgttatcattttacttctaatgaaagttgttcatttgatataccacaatttaaaatattggttttactctatctacttacctaatatatctatatatacctacctacctaatatatctatctgtttttctatctatgtttttattgaaatagaattatatcatcttactctttcgctttcctctttccagctcctcccagtcacctactcacaagaccctctcattgatagctttttttcttgattattattgttatatatatttaatatgtatgtgcattgtgcacaaagatataaaaataaaacctgctaagtctgctttcattgtgtatttgtgtgtgtgtgtgtttgtgtgtgtgtgtgtgtgtgtaatttcaaggctaacatctctgcattagataaacaataagggacccatccctggggagattaattctttcttccagtagtcattagttgcctgtggttgtttgtctagaggagagacactgcaaaaatatccaaatatccctcttctacattaacatgtccattgatgttaccaaaaatattaaactctttataagtgtggcccttctattatagtgttggatatcaccataaccgttcttttaaatgtattttgggttacccaaatagcatattatcttcatatcatttattacacatctcttccagacctgctgacatgtaataatgcaatattgactctgtgtatgtgtgtatgagcttgtgtgtgtgtgtgtgtgtgtgtgtgttatatgtgtatctctgcatgaatgtgtgattgtatgtctggtaagtgctgatctgtgtatgggtgtatgcttatgtatatatttatatatggttatttatgtgagtatgtatatatatgtgggcatacatttatacccaatggtatttatttcctgtactattctattgaatttgatccttagcatgcactcatcttaattatagctttactaaacattttaacatcttgccttcctaatgattcgtattcagaagatattagtagctattttaacccatttaactttccatgtgaattttaaaaatcacttaatcacattctgtacacaatcctcaagtgaattggcttaacttgtagtaaacctgtttcttaatcagaaattattatatgagcatttccatactgaaagagggcatgcatattccagtctttattctttctcaagaaaactcagatcctatcacacattcccattcccatgcacagctattttgttaaaattgttactagcatcaggttcatccttttctcatggccatttcccccattaaatttgctaactacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccccccccccccacgaggggggggggggggggaggcccgagggagccccctccctcccccctccctccctctctcttctgctttgtgtaattgtgtatagagctgggatttatcggttcctgaaagactgaaaggactcattggaggagccatctggctctagtgctgtttactctcgtttcttttttatagaatgcttaattaatttttgtcattgtgttttgtttagtaacacaggcttttcagatgccaaaatcaggcttagtccctaccccacaaacactgaacacccattgttctatttctaaactgcataaagttacggtttaaaattcctatttgatatgagaattactttgggaagttcttttcccccagttggaagtttttattggcttatcattttaccttaataatttctcattctatcccattatataaagagaatacagccagcatctttacttactgagatgatatttgtgtgtgtgtgtgtgtgtgtgtgtgtgtgtgtgtgtgtgtgtgttcttactttcttcccttctgtaatcttgcaagtattaacgtatttcccctctgctgtatgttgaggcatagcttctcatagtttgattgactttgggtgcttcaagtgtgcatgtccataagcatgctgtatgggttgttatattgctgtgcttagaaggactttcacagccaggtttggcagcgtagacctgtaatttcagcacttagggaacggatgcacgtgcacccagagtggctgtacttgggagatggttactttgtagacagtgtttgacccacaagtatgaggacctgaattgagtccccatcactgacatagaaaagcagtgtatgcacagctttgccttcacattcaacactggggaggtagaattagtatggtccctggagtatgcttattgccaaactagccaaagccctgagctccaggctcagtgagtgaccctgtcccacaaactaaagtagagagtgattgaggaagataccagattggacctctgatctctgccctatccccaaataaacacaggtgaagtatacgcacacacatacacactcacaaatgcacacgtgcacgcacagatgcaacctcaaaactgcctccacccaagaccatcgtttcctttgatttcaaccctgtaaggatggtcgtgtctacatccatatccacaggtttaccactgaagaacactttactctgtttacttgctttcttgcctcaagtggatgttgaaatgtttgagggcgagctgaagcaatcatgacacttgaaagccttcagtgtgtgtaccttgaagggaaaggccagtctcttatatgtgccatacggtcatcagactcaggaaattttaacatgacatcacctggcatcgtctatagtacatatccagacttcctcagttaatgtcctctaaattttaaaaattttaatttgggacccaatcaagcactacacgtcatattttgttggcatggatattgtggcatttttttaaataagcaaattataaacaattagaatataatgttgtttcacatatgtggtaaggtctgaagtttggcggagttttggaatcataattatggaaatttcaccaatttgtttcttgatgcatttttgttgtttcttgctaattggtggtgtttatatttccatacataacactcctttctctctctctgtctctgtctctctttatcctcctctccccccaccacgtgtgagtgtgcatgtgtgtgtcacatatacacttttcaattttacttgaacccatattccaacacccatggtttaattgttgtggcaccatcttacattttaataagtagttttccatcatcatccaacaccaccccctttaataaagaaaaaaaagttttgaactatatgtgttatttttaagaaacagcaaatttattggaattgccaaattaggatcatctatatcattagggctcaggctctctggcccatgttttatctgtttgttggtttgttttgccaagggaagtgatggtgtcaatttgggtgtcaatcaccagctccatggcatgtgatgcctcaccacacactttcgtatttctgcctatttcttcatctttgcttcatcaccattatttaacacccactctgcctagccccaggctagtggttgaagttattattttatatcatcttgtagaaagcacttttcactaaagttagccttatgtatttcttgtcttatttgcagctgggtttagtggaccttctgctgtaaaagttttcccatccctttctctctaccattttctatggtgtgtagttcatttaccttcaccttaaattaaactattttttgggttctttttactaactttagaagtctttgagctgatgtactttaatagattagattattgttatattatctatagatgacagtggactgacttctttcctaagatgttgacctcctgtcttgtgtcttgttgtacttgtcaaaattatcccattttacaggcaagtgaagtgagttactcagtatatcagacacagtaaggggcagagcggaaagtaaaaattccatcttgttttagttcagtttctctttggaataggtagcttaactaccaacccaaatgcaccactccatccacttgcatcttccccaaaagaaaattgacatttgctatgcttaccacacatttctaaaaagaaaaaatatatatttgtacaatttgtacagttctattttattaaaaataaaatgtgtacaatatattttgatcaatgtttccattcccatcccaacttattgcaaatcctcttcacttccccaactccaagccttttctttagaaaagaagcagacaaacaagcaaacaaataaaaatcagaagacaaagaaagaaaaagcacaacacacacacacacacacacaccaacaccatgaaaacacaaaaagaaaccataatatatgagcaaaggaccagtaagacaaaaattgcccagagccatatgaaggaaaaggtctctaaaaattactatggagtgtttattttctgtgggccaactactactgcaaatggagcctacctttaagtgtgattaatatagccaatgagaatccattggagaaaaccttttttatcctttgcaagctgatggggcctccactgaaacttgactcttctcctaccctatatccatttcctgaggagtcttctgaaccttggtgcagacccagttttcctccttcatgtgggcctctctgtcctcccttctagcttattctcattcctctgtatcagtccctaacacctagaaacaccttctacccaggactctctgtggccacaccaggctagacctcaagaagataagtcacactatcctccctctcctcccttatatcgatccactctcaccttcagccctgtaagaacttgcttgcagctgcccagccattcactgaagactctaaattgtggtacagacctagagccccccatagcccttttatccctgtctctccagattattatttattttatgtcatgtgttttgcatgcacgtgtatatgtgcaccatgagtgtatctagtactgtggaactagaagagggcatcattggtccatcttaacctgggcttatagatggttgtgcattgctgccaagtgggtgctgggaacccaactgagacatctgggagaacagcaaatgttcctaactactgagccatctctgtagactgttagaatactttcttatgccaccttaacctcccagatgtgctagatcattatgggaatgatagacaaaaatgttaagcagggaattctaatacgtttttgtttgggattactgggtgatgtgctaatcaagtaaagctttgccagcaggaaggaatgagtaaggtttcatatttctaaaggaagaaagggagcaaaggctttgacataggagcatgcctatgggatcctagaaatagctcagactagtgcatttagagacccaaaaagaaaaagggggaggaggttaacagtgagccttgtagatactctagaaacactgcctttcactctaaggtgtcaggtagagaggagtttcagtgggagggaagaatgtgcagtcatgaggttggcatgtttctgatgagtctggatagacactgtcttgagaataaattctcaggggcacagatggaagtagagagaagagaaattgctataactggatccaaagataccaggggttagtttggagatgtggctgtagagatgggggaagatggtggggctgggtatatactgatagaaaacaacagggttgcttatggagtggatacggttgcaaaggacagagtaactgtacttgaaggaggatcatgagagctgtgactgtaccttctacatctgagctatgctgttcagtaagaattatcatatattgtctacatatcagagatggatgaagagtctcaggtctcattcaaaaagcaggacaatgtacctgaactctcagttgaatagttactgtttctctaaaattttatggtaattttttcttcctctatattaatataaaaattcactttcgttaagttcatcaatgtaacccaatcacaggtgaagggttctctctgttgtctagttcagttgcaggctaatcacaagctcaccagtggtaagtagctccagccctccatagggattctctagaaaacattttctagacctgttatcctgtgtagtctttgcagagcacagaagacttcctcttctcagaatccttccctggcaggtttccccttcctaccctcactcatcctgttgaaaacagttttagtgtttgtttatgccatcttgattctgagtccccagtaccaggagccaggttgctctcaaatttctagctgatatactatgactaattaataagtatgtgataaatatgtatataaaagacagacagatgggacagtttctcacaggcctagtcaggaaccaatagaagatgccactcccaaccccccattgagatagacactctccccaattccccaatgtctcctcagtactgtttcgactaggcaaatagagactaaaacccagaatttacagagtcttgaaataaaggttggctaactaagacatattgtaaatttcagctctgtagttccaagtgacctttaatgtggggaatgaaattgcaagggtagattctgttggggattaaagaactcaacttgtttcttagcccatcttgttcagtagcacaaatcatttatcacagcattttttagctttaaaccttgtgcattagttgcaggcaaagcatggaccttagaaggaagaaagaccactagaaattattcattccattttttttctcccttaacagccttatggtggtctactttataatccataaaatttacccatttaaagtgtacaatctcaatgatttccagtgaatggataatgttgggtagccatcaccccaaaatatcttcaaatatatccatctgatcataagaccccttgtgcccatatgcagttgattcttgtccccattctcagtccaaaacaatcacccatctgatttcagtccctataaatattgtcttttcttcacgtttcctatgactagaatcagacatacacatcttgtgggtcaggcttctcttattcaatatagtgcttctgagcttgttctgtgtagactatatcacagtgattatgttgttgctattgctataaataacattccattcaatggctatatgtacctcacatactgtttgtccacttgctagccaatgggcttgtagattgttttgtattgtcacatcatttcaaacagttacattgttttttggttttgtgtgtgtgtgtgtgtgtgtgtgtgtgtgtgtgtgtgtgtgtgtgtgtgtgttcttacacgtcttcatttcccatggatggatttccagggttggagtgtctagataactggtagtttaatgttgacatttaaaggacttccagacttttgttccccaaatggtgtaccatgtaataaggtcccatcttttcaatccttgctagcaattgtctgtcctttgaccaatgacattctagtgagcgaatgaagtagcttatcctcattatcttgatttataaacctccttatgtgattaatgatgttgatcacctcttcattcacttattagtcattaatatttcaagtatatgcatttttcagtgtgctgttcatcttcttatagaatagtaatggatcattacatgtattggacatatgtctttatgcatatgagttagaaatattttctctaaaaccatgacttgtgctttaacttgtacaatagtattttaatcccattttttaaaaagtaatcgaatcataatagtttatcttctttccgcaataacaggccattgctttggtaatacatttatatattattcccccagtctgaggtcaggaagattttctctctaatcctgtaagtttcattgtattagttcatccatttagttttataatccattttcggttagttcttgtgggcagtgtaaatttagatttttgcaagtggatattcaattggcctagcctcatttgctgaaaaggctgtcttattactgttgaattgtctttgtcaggaatcaatggatcctaaatgtggaatttatttcagaactttcaattctcttttattgatctatatgtctatccttctgccagcatctaatggtattgattttcataatttacaaattcagaaactgtaagctctgcagtattgttctgagttttttctaattgttttgcctattgaggccattacattcatgtatatatgtgtgtgtgtgtgtgtgtgtgtgtgtgtgtgtgtgtatgcatatatatcacatactaggtttgcaaagtctctgatgattctcgtattactcggttttctatttctgtgacaaaatactggagataaacaattcaaaggaggaagatttattgtggctcacagttttaagtatatcattccctcatcatgtggcactgttgcttctgtgcctctggaagcagaaggcagatggcaagggacatgtcctgagctaaagacacagaaggcagaaagagcagggaagggctgaggacaagacatttccttccaggccacaacctgagcattgtacatcttccgctaggcctcaagttcctaccacccctaataacccagtcaggttacttatctcacagtataccagtctgctaataatggcagaattctcctgatccactatccttcccaaagtctcacccctgaacttcactgggacatgggcctttaataaatgagcctctggggaaatcccagatatgaagggtgaaattatgctagtggttacattgaatattcagatatatttggaaagaattgtaattttaacaatatggactatttaatacatgaacatggaatctatttgcctatatattctttaattttttcacttttaaatatctaaatatttcacatattttgttaatacttagtattgtgatattatgagtagtaatgtttggttaattttattttcagaatgcttttcttcagtgatgaaattatcatctatttttattttattttatactgcagctgaatattttaattttgttgaagtcatttagtagttttaggtggtatatgtatgtgtataaaacccttttaattctctgcatataaaatcctaacatcttcaaacaaagcatattccttcttgctttctatccttggtgctacaaattaattaagataattactagttaaatttgccccattctgaaaactaaattctccattctactgttgaccagacttctttagaagaaaagcgttcaatcttttgcccttgagtgtgatactaactttacatgtttcagaggtgacatttatcaagttgaaaaatctctttctatccccttttcctttctgtggtatttttatcataaatatgtattatattttatcatttttctgcaactgttgagatgattatgggatttctgacctttattctgttaatgtgctatactgcattcattaaagctccaatattaaaccaactggcactgctgagataaatttcattaagctacaagataaaatcctttttatatagtagtgggttctgtttaccaatatttggttatatattcatcagcagtaatactgctgccattgtctcttattgtaatatttctctgggcttgtattagggcccagtcacaggagttgtgtttctatggtaggttactttggactgtgattttggttggattcagaagtagctgtaagattaaggaagcatgcctcagagtgcaccaaatggggatgtgtccagggaggattcattgaggaggccttcctagaatgtgaaggcattatgctataggctgctacaggaattctctctctttgcttcctggtctccatgatgtgagcttctctgttccacccatgccctcccagccacggtagtctgacacttcccaaatcatggctgaaagaattaagcatatgttcctaaactgcttctctcaagatttgtcacaatagcaaaagtcagagtaatgaaaattcatccactcttctatcttttttacatagggcttgtgcaaatttgaactactgttctttacatattcctggatatagttgccctatggcctgctggtctcctactcttgccaacatgtcttctgtacctgcttcactttaacacacccagctttcaagggctggttacttatcaagcaaaaactcgagatgcttgaacacatgcactgtggcagttgatctgatgactgaagcggctattggatgcctagtggcagttggctaccatacatagagtggatacattcgataaagagaacgtgcatgtcagaggcaaaatggatagggatggtgtagtttaagtatgctacctaggatgctgtacagttaaaatgtatggattctttatttctagaagtttccatttttagatgaaagttgatcatgggtaactgagatctttaacagcaaaaccatgaataagagaagctagcatatgtgaaatccaatgacgctggctgcaagatgaatgtctataacgacctcccactgttgattttcagtactaagtttgttcatgcaggacacaaaaaaagaagctaaaagattcaccagcatttccctaaataattgtgtttcagtaattggctaggagaaatccattctctctttcacttttcaagacttatatgacagtattgcatttttctgaactaaaataattgttttaaaatccaaagtgtttggcatgattaggcaaacatttttattgtgagtgaaagccacgactaaaactgaggcttctggaatcagactgcattctcatcttagctcaaaaactcaaacggcaccatctgtgtgagacattgaacatttcatgctttagttttctgattttatcaaatggaaatgatgatatctacctgacaaaatttctatgaaggtcaaatgagataataaccagaatttacacatgcacgaattagtaagtgctcaataaatattttctgtagatgaagcgatcttttcagcatgaggtgctgagagcttggaaaagaatgttgatccagccaagaaaagagaaactcactctcattcaccagttaaaggaagttccccagaaagagtgacgtttagtctgggctttcttgattggatgagtaattttcagcatgcagaaggggcagggggaacctgtgggaagatgggaataacatattgaaacttgtgtgagaagcaaaatgagatggcattcaccagtaatctcagatctcagggagctgctcctgagggaccatgagttgtgggccactctggggtatatagtgtaattctctaaaagaaagaaaggagggaacagcaggtgaaggaagagaggcagagcaaaaacaagaattgtttttaaaatcactttccaattttaaatttcatcatgtaaatgtatttatttttatttgttttctcagaacaggtcttatgcatcctaggctggcctcgaacctgctaggtagccaagggttgacttgatttgacccacctgtctcagcctctcaagtacctggattgcaggtgtgagtctccaaacctaaacatttatttcttttacaaatacttggctaccaagttttacgttatcagggtattaaaagggatgaagaagaggcctcaaacatcagaggctcacagtctccatagttgcaggagccaaggctttaagcaaattatagacaagggcttcaattgtgataaaaagctgtagagaaaataaaacaagacaatgaaccgagatgtgatgtgcaaagactggtagttgtgaattgtatgttagtgaacttggaatgtaccaccttggtagtttgtgattgtgattgctagaaggatgtcctcctgctgggttaataaatggtaaatgctggaatcacctgggtcttatatagtatatggtcacttcatggctatatactgaaagctaagatgatattgatgctgagatcctgttcttacagattctggttcagtttgcctggggtggggccaaggaataaccttttcaggcccgtaggttgattatgttgtgacaccatactacaggtcttatgcaactgatatactactgagctgaaaggcccttttgaagtctaagatgacttttccttgctatttcttgaagcttcaatggtggagaaaacaaactgacttttgatggctaccatgtgattccatgatatggtactggaaacaaaagctgttgaataatactgtggtggtttgattatgcttggcccagggagtggcacttagaaggtgtggctttgagaatctcctcctagctgcctgaggatcctgcaatttctcctgtttacctttggagcaaaatgtagaactcttagctcctccagcgccatgcctgccggcctgcttggacaccaccatacttcccaccatgacgataatggacttaaccttagaacgtgtaagccagccccaaataaatgttgccctttttaagagttgctctgatcatggtgtctcttcaaagcattggaaaccctaagacaaataccttgccagactagtactctgatttcatccatgtcccagtgtcacaaatctccaggtgtatagattttccttattttttaaatatatatatattaaaaacaagatgcataaaactagaactggataaagtagatttatttcggaatgaactgatcagcgtgagaagtaaactagtcatatcattctcatttttagaaaagatataagatatacctgcaaaaccgtttgccagtccttgcctagagaaagatgatggctcggtggcaggtcatctccactgtctccattctctgtttcacagatgactttgtattcaagtccagattcaaggcagatttcagaggctagttggccaacctttatataggactttgtcttggcaaaatcaagtggagaaatattgacaaagacatttgatgtcaaattctgacctctacatacatgcaaatatatgtacatgtgcaatgtacatgaataatatatatgcaagccacacacagacacacacacacacacacacattgggaaatggcctcttgctatgtatacaaatgctaaattctgaaccctaacatctggttgccctccagatggctgcatcctcccatacattttgttgtgtaaaccttgctccccaatttaaaactattggttaataaaaggctaaagcttgtgactgggcaatagagagagaaaggcatgacctgacaatcaagaggggagtctccagagagaccatgggagagaaggagaaaaagaagagagagaagagaaaggacgcaggtaggggggaggacaccatgaaagaagatagaccaggagcatgtgtatggagaagtgccctctgaggatagactcatggagcagaaataacctgagcaagactgaaacagcaaataacaagggacatatggctgggatgtaagttagaatagctcatgacctgctcagtctatgactacagcttgtaagtaaaataccaggcttttatacagggtagctagaataaagatttaattaacacattcattcatacatacagacagacagacagacacacacacacacacacacacacacacacacacacacacacacacgatagacagagagaggaatgaaaggaggaatacaagtttctctctttaaatcttactgatgcatacctgtaagtccagcacttgagtggtagatgtaagaggatcaggaggttaaagtaatccttagctacgtacttagcttaagaccagctcaaactacagaaaaccctgcctcaaaaaaagactgtggaaggaaggatggaaagaggtaaataagggaagggaagggaagggaagggaagggaagggaagggaagggaagggaagggaagggaagggaagggaagggaagggaagggaagggaagggaagggaagggagaagggaagaagagtaaattataacaccaccattgtccaggctccaggctgtttttctcagtattgaatcactgtttcatttacaccatgtggatgctgtttaaaagtaccctgtagggcacactgctgttccctgtagatctgtcatgcccccgttcctatgttgtgccagtcttccaggtgctgtgtgcattgatgtaatgattctcaggtgtgacctgctttgaagggctgttattaggcacctagggactcattgtctgacccacataaatagttggaaaagcctgagaatgcccagatctgaaaacagaatgcatctgaaggttcaaagactttggcttgagattttgagatattgggctgggaccagtatttcaggatttcacctgttaacatgcccccaattggctcacccacttttctctcctgtttctctcctttaccattttatcttggaaccatttctgtaacacgccatttgacttggaatatgtccctggagtatgaatatgagctaacacgtgtctttttctgggagaacgcagaccaaattatgcacctgcctaaagttgggcaacgttcacctgggaactgaagcctactttccatctgttagctgaatcaacatctcggatgagtattacatctgcctgtaggcatctgccccatgtacagaaaagaggcactaggatttttaataatagaaagttgactacgtctcatcagaggaatcgggtgagagaagtgaggcactattcaaactctttgctttggcgtcagagacagcaggatgatcaagaggctgtatttcccaagcttctgggggaatgctgtaggttctgcatggaaggaaggttttggaacctggcacagagtggaatgcccttgcctccaatgggaggaggtgctaaagcagaaaatgcacactctcactgatgtcatagcagctactttataattaagatggagttgggacacagcatagtcttcggagccctcatggggagaactcccaggcaagctatacaaagacaacaccataaatgcccaccttctcattgggagagacagaagccagcatagttaggaaactgcatgactaaatgcaccttgaactactttaaattcttcttctcttaagacaccagaattttcatattaaaatgtgcctactccaacagccctgcatagttcatcacaaccacttcttctccaaggttgaagatagaactttgaggtagatcattctcatttacgtatacgtttatcattaccagagaagttaaagcactgtgctattgacagatgtatttttaggagaacagtgagaaccgttactataggaaagggaagccctcgccatgctcccattcctctcccccaccacttcccttctctatgcagtcaccgtgatgccctttctgcaccttttgttgagaggatgctggatgcacgggcagacagattcatctgacggaaaggcttctgggtttctggtgacacttgcagtttatgtctgaatagataagctgcagatgtggtgggcctgtgggaactgctgaatttgctccaacgcagtaatcccattcatatgtgtaccatatgttgactacatagcttaacttccaaaatgccctcattccctccctctttgtgatttcacatgagctgggatacaaactaagcagtttaggccaccaatgttaaaaaaaaataatgctcaggtgtccctttgtgctttaccttggtttatgggaaaagaacatttcttttaaaaaggaactgaactgtgaagggggtgtgagctgcttttgctgaattgccactcacagatcagtgaacctctcaggtttatcctcatcccttcaacctgattatcacagatctgctttgtcaactcaaccaaacctaacagccagatgagggatgatgaggctaagcctgtgtagttggctgtactttcttccaacagccttgatcaactgaatatccaaaactcagcaatgacctgttttcttagttcatcacagctacactcttggggcaattatgggcagtccatgacgccagccctggactaatcttgatccaaaccatcgcaggatggtaaaggataatagaaagtggttctaagaggaaggtctatctcctgaagatctccaaaggtttgggggtctcaagtgaataaccaaggatgatgaagggattcaatttaggataaaaagattgactaagaaaccaagacaaaggtattatcttgtggacattgtttaaaaagagagagagagaagaatgaccaagacaatggttttatcttatggacatgattagaaacagagaagatgaagaacagactggatcttagagaacagggacccacagctcttttcaagtcctataggagtgagttagttggatacagatcaggataggaagattgactagaaggcatgttacctaaatccagtatacagtattgttagattctattgctaggctcagaagggaacctgggagactgtaaacttcctgttcttcttcccttaatgatcagagccccttgactaaaggaccctccattaatcaagctgtcactagcactcttaacagatgcaaagctttgcttaaagctgttgttacaggaagagcaatgtgagtcttggtgattttttgcattcacccctctactgttcacattttctaggttcaggtcttaggtttttgtgctgtttgaaagtgactaagtttacctgataaacatgagggatttttcattcaagaaagactctagagataaggagtttgagtcatcattcatgctttcagctgtctttatgaacataaaggctctcatacacacagtcatgtggcactcttgtcccactatgcatgctcagatgttactcacccacagttgtttttgtgttactttatttttattaattatccattaatatgggtatgcatgctatgtgatggggtttcagaggacagctcgatggaatcaattttctccttccatattcacataagttccagagttcaagtcagcaggcatcgtagcaaatgtccttatcccctgagtcatcttatcagctctgggcatcacttgcatcgtgaaacattcaggggctccaggctctcatttggatatcgtgatgctcagctgcagcacatgcttcctataacactggccatatctacccctgtaccactcatgtacactctggattctccttcaaaggtgtacataagacaacacataagacatgcacatgtccaccaaagcttcttgtccatccaaggatagcacacacccatatgcattccccttttattcactcaaatgatcattcctgtgtcctgagaaaatcaaggaatatttgcctcatcaacgatgctacatgttcttgggaggaagcttttgggaggagttccttcaaagcctctgttcaccttagtgctatcatcctggcctctggatcttatcatgctttgtaatccagtgtccttggatggataagctaaccagagggctgaggcctatgctactcggctttcatcaagtttatggcatgttatgatttaaaaatggacctaacatcacaattgccttactaattaacatactttttacactctttgggcacttggacttctgtcttcgatcatgcatctcagagtggaattgaatccttccagatgatgttcaagagaaggacagatcatttcaagggatacggactttttatccaattcacaaacttttgagtaactttcacaaaggaaatcatacacttggcatatggttgatattcaataaaggctgtcatctctgtgcacacgctggcacttcttcatatgcttagttgaaggggatgatatgagattacttggcaggcactcctgggaatcactgtttaccctgattaaagattctgaacccatccagatttggcttcatgcttgctttcaactttaattcaatccacttttattcatttcaacaaatatgcattgatcacttgcttagagtcaggcatgctcctgggcactgtatgtttgtgatgggggaggggtaaagtgattcagagataactacaccacaatctcacttctgttaaggatacaatcgagccaggcatgtgtcccatcttacacttttgcaaaatcaactaggcagtgatgaatgtgttgggaataatttattctggacagatctatacaggcttcatggattaaatataagaaagacataggtattataggcagaggtggttagcattggtgggtgtttcaagtagaagaagcgcaagctgatgagagtcagccataaggacatttatataatagctaggtgtctggagctgttgaaattagtgatcattatgacacgatcaccgaaaagcaagctggaatccaagcacagaaggtttcagcagcctatatcatgtaatttggacaaaagaaaaactataaaagtgcctgaagagagatcgtgttatatgattggaagcaaaatagatagacagaatgattagatgaactaggagcaaagaaaccagatgagtctagatgggaaagggcctgacatgagcattagcaatggcaagaaggaaattgtggtaggtttaacactgctgagtccgggaccacagagcttgttggttgtggcagagtgagatctaagtaggtgaaacctgagaatgagccagattcaggatctaggcaccagtcagatggtggtcctattcttcataatagttataagggacatcccacctgtaaggagcatcaggtttatatagatttggggctgagtttgggtgtcttgtgtgaactggcattgggattttccctgtctagagttctaatacctatcagtgcctggatgcaggaggaagacattttagttcaccttatgaattgttccccttatcacagccctgaaaataggtttgtagaaaaataggtttctacaaagtaatgaatgggtttaaaagtctgaaaagagaataaggatttttttttcagacacaagtgataccagtgtctccttccagcggaattatatgcatacaatgaatgataatgagcatatatgtacacagagtgactcatctgcctctctgcttttttgtccagtgtttaccagctggttgtcaaggaggagcgactccagaagtctcggagagcagctgacatcattgagtgtttctcagtacctgtgagctaccggaacgcctccaacctcgattcgctacactactttgctgctgagctgaagccctccaacctgcctgtcacccagccatttacagtgggagacaacaagacctacaatggctactggaaccctcctctctccccattgaagagctacagcatctacttccaggccctcagcaaagcaaatggagtaagtaggtcattgcttggacttttcccttctcaagtgcaaatcttttacagcagagttttataaactgaggtccatgagccaaatccagtcctcaggggttttgaggtttggaaataaggtttgtttgtgtttgctttctttttattattttgttcagtttttagctttcatttggttttattttactgccactattcctcttggtttgtatattactgctggctgctttgatgtttaagaataaagttggggagttataatatagaagctatatgtcatgaggcctaaaagctcttatttctatgacttctatggagaatttttgtaaatttgtattagagtatgggaaaggtactacacttgagaaaaatcacatggcctgcattgtgattcctgtgtctgtagttctgatgcctatcagtgcccggatacaaggaagatattttagttcactgtatgaattgttccccttatcacagcccagaatcacattcaaaaacttatttttttaatcttagaaaaaaaacaaagaaactgtttatgtcaaatactccgctatttccttggtttagtagttgtatccatcaacatcacacattgacaaggctggaaaaattcacaaaggccatccatcaccttcccattcatgctcacccaccctaatacaacattctttggttactattaccacattaagtcaaagtttttcagtgtttatttttgaatgcctttaatgacagagaacttactttgctgatgcaaggggtagcaatatggggattgatgctctaaggacactttgcaatgtaattatttaatatatctttggtggtagcttcttcccagtggtcttcaattattctttttaggggtttgtcttagggttttactgccatgaacagacaccatgaccaaggcaagtcttataaaaaacaacatttaattggggctggctttcaggttcagaggttcagtccattatcatcaaggtgggagcatggcagcatccaggcaggcatggcgcaggaggagctgagagttctatgtcttcatccaaaggctgcgagtggaagactgacttccaggcaactagggtgaggatcttatacccacacccacagtgacacacccattccaaccagaccacaccttcagctggtgccactccctggtccaaggatatacaaaccaccacggggtttatagaaccaacacaataccctttaaggtattagtttctattgcatgcaatctttaccaccatccacttacactctcttaagtgacacccattggatcatcttatctgataatacttcatataagttactattttccttttcagggggccttcatttaacatattccagcttccataatttattcatcaagcatataatgaccactatcgtgtccacattcctgtggtttatattgtgtttagtaggagcccttcaagagagtgtagatctgtgaggaagcctgaagcatgctgcatcatgcagcgtccctacagaagtttcatgctcaaagcaaacaagctctgagaccaaagcaagatcggtggcatgtgtatagaatagttcagtctgtcagtgccaatcaatgcctgggaaaaaaccctggaccgtggaactaattaacatttagagtgtctacatgcccatttaagttcctctttgatatttcagttctgcatttattacttgttcaagcaacactcctcactgagagtataaagctacaaagagaggctgccagactgccttccacctgtccatctggtctccactctgtgcaaagcactctgatgtgttgagcatgaagacataaacatggaccaaagcatctgggggcccttcttgctttcagatctctgaatcccatgctggcctgtgcagggctttagcacagctctctgataagatgtggttctctctactctcagcacatagggatggatatggttatatttccagtctgctaatgaggatgagagcctatgccccagtcttaagtttccacatcctcacacagatacttctcagggagctagctacacatcaagacttctggagactaattatcccaggtgtttttctaacccaagaattataggatttgaaaggaatgtcaggtgatatggaacatccaatccaatggatgattttcttcccaaagattatagcagagccctttctctggaagatgcagggttttgacacataggaaaagcaagtcaagtgttcacgctgcatttgcctttgaggcagtttgaagaggaacaaagccatgaactacctgtaccttccaccccacatcatctgttctaccattgtggaattataatttccagcaaagataaacagcatgaagagtattgggcacatgcttatgcaaggttgtctgagggtgcaattgttctcacaaaaacagaaaaaggaaaagcagttagatgtgggcactcagaatgaggttttctggcaaagagaagggtacacatcacttaaaattactgtctttagtattaagttgtactggaaaaaaaatgagcacaaaggtcataggatcagagcagctattcctactctaatctcgtctggcacctaccctattctatgtatcatgggggtcaggagggctctggagaatgatcagccacatgctccaacctaccatattcactgttcttgaggagatacatcaggaaggatgctccttgctacacagcaccatctccatgccctgcttcccataaatcattcaaagaacaattgaatgagcaatgaatcaaaacaaagagaccaagactagagaagaatagaataaaagacccacaatgagcaggaaactaattagacattgcattaatgctaagtaatcattccaaaaccactttacaaaacagaaagttaatgtaaaaaaaacaattacttaaagaggaggcacacaatgtaaaaattaacaattgtgacctgggcccaaaattcactctcatatcagcaagaaactaggaatggactggagactgaagtttgtgaaccaaaattcctaattttctcctgcaagacaagagcaaataagtaaccatcattttactcgagacactgggaatctttgaagtatacttcctaaacacatgcgtagccatctaataacagaaaataaaatattaacaatatacaaagaatcacaaggaagacaaaggatatgacagagaaacataaaaatcagcaacttgaatggaagaagaaaacattaggcttggtgtgcaaagataaaatagtgttattcagtcataaaatgagacaatggctttggtaaaatggaaaatagaatccagtgaaatgcatcattgcaaagtttaatgccaaagatgcttcacagcccattgagaccaaagcaaattgggagagaagggtggatagtcatgtgtaagaaaatgggtatggaccagattgaaaactaccagtcaatatcattccctgcccccaatcctaaagggtggatagtcatgtgtaagaaaatgggtatggaccagattgaaaactaccagtcaatatcattccctgcccccaatcctatcagcaagctttattcaggacaagctgagagaatttagaatccaggaatcttcatttattttttattttgtgaatattagatcggcttatccacttagcgggtaaattcagtctttaaaatcagactgcctgcatacaaaataccggtggctgtgtgactttaattaatccattaaaaacattagatacagttgatcaattaaaagaacagctatcaaacacacactatctgtcacaaaggcaaaaaaaaaatctggaaaactacagtgagcagacagaactttttgtctgcataatacttgcattctggtggggaagaaaccacagtaaatagggaaatgatgaagtattgtagtcgtgtgtacttattaagtgctgactctatagcatgaaggtaaagacagtttgaaagttttatagtgattatgagtagtgtgttttcccaaccccatgaatgccatagaaaatttgaactttgcattcacaacaagatttttagagtctcttcaggtgtttgtatgtagtttgagttatctactggtacttaagttgaaattttcgcctaattagtgatcttgtgtttgccctttggtgttctttgcagacagcaaagcagcccagtaggtgaagcgctgcccttggtgctggagaggagtcagtgcctacagttagaagtcagtccatattgtaaccgtatgtttggaatagagctctataatggcattttagagttggatagaatttcaagtgtcatataatctagaccaaaagaagaagagaggaaagaaatatctaatgaaacattctcagtagggtatccccaagattactgcaattctatggagtgaaagttagtggattccttatggggcaggtaaaatgattagaacttttttcttacataacagccagttatttcctcctacttctcagctcctagtcactttgattgccttgagaaagaccaatctttttctatcaaactttcagaggaggtaatgtgtagtacccactacccacttggccagctacccactttccttggtgtgtcacatacagctcctctgatccctaggtctcttttatcatgcattttggttttgtaatgctagactttctttcaacaacttcttaaaaagaggctttcccaaccagtgcagtctcaattacattttaactatttctatcttgaatgtttcctaagaacctatcaaatatttcaagatggttttgccctttaaagtcttgacacaatactctatctctcttttactgactgttgaactaaatagttctagattttaggcttttttttttcaatgtcctgtcttctaggaattgttctgaatgcacctagaagcccatactaatagtacctggttagcatcttattttcttttataataccagatatttaaaaattacatatatttttgtatactgcatgcttttttccattttacttaaagcactcagagtgaggaaccctgtctcagattttgtggctattactgctgctgtttctctttgattcatttgttctcatgttttgggatgttgtttgaaatttttgtgctgtatttcccagactatgtttaatcttaaacctagagtagacactcaaagtcatttaattaacggattaattgatatagtatgaattactcctttatgtatgtgagtctccgtttccgcatttatgagttgaattattaattcatccttaattcttatttcattggatacataaaaatatcttgatgataaaagccatgtaacgttatgtcactagagtctgaatttccatttgctctaaagtgaaagttgtggttctaagccatttagtcatggacagatgaaccctaaaggaatttgctcccactctggtagttagactttctacccagatgtctcctttcccaagctccacaaacctggacagccttgatttccttcagccccttactaagaacacccagtgtagctatctcagtgataaacagcaggtggggaccattttacattgttttcccccactgttctcagaatgagtgctgctgaatctatgattctctgcatccccaccaccattatccatgattgtgaagttgaaaggaccataattaagggttggatgcaaaacaaatgtgacaaattcatgcaaatatctattagaagccatgttgggttgggtgatgctggtatgcttgttgtttacttaaagagaaaactctttccttgccttttcctttccaccatggggggtggggtacatttaacctgaatgacatctctacagaatgctgctgagctaaataagaaaagcaggaggcaggagagtggatgttctctctctctcttttctctcttccagctcttgaactcaattgcctcttgagaacagtgggaaggcaggtgctatgttgaatggatcaccgtgtttgtggtataagcactttataatagtagggatcactgatgtagggctgggttagagggaaaatgtatgcctccaaatgaattgagagactgcacatagttctacccaagcaatgtgaaaagaatgtttgcatgtccttgtgttttctgagccttggtggggtagaaggcactgagttttgaacattaggcagacttggctttgaattatggctctttttaactatctaaagatatgttgtatggttgatgatctacatttcgaaactttggtggagagaaaatggtacaaggtacatttaagtcatcatgtagcatcacgggtgtcatgtttattcttttcccttttgctgtttcttctttcctgaggcaggagcacaggtgggtagaacatcttcctctatctagtgtatcccagtctgtctggtagcctccacctagaagcatcccttcttaactctaaataacccctggactcttgtttacatccagctgtttctctggactaacacatggcctgttccaggcttcagtcttattttatcttctcatttttattcatagtttccagcctgatatcaaactcagtaatttattacagtttattttattgtctgttagttttatgcctcatattctgatccttagttgttaattatcaaaatgtcatataggaaatcagagatggaccgtggtatgagcaagacccaagttcaagtaggttagagttgagaccacacagatgccgacatggcagtcagttgaatgctctgttagggtgtttatatatcaattcctatgttagttaaggtaaactaatttttctagaatatggaacaacaaaatctcaggggattatcagaaaatataggtcacatttctccttcttatccaaaatgaaccagcaggaggacagagaaatggctcaggagccaggagcactagctccccaggactcagtgtcaaccctaacattcacatgattagttacagacatgtgtaactccagttacagggcaccagataccctcgtcttacttccatgggcattattcacatgtgttagccatatactcatgcaagcaaacatttgtatgcaaaaaaataaaaacaaatacaatttctaaaatggattagcagaaaggatctgaatctcaccggcactcatggtctcaggctggtaagtggtctattctaatatagtcttcaagctagagaaagagaaatgtgatggacaggcatcacctctagaagtttctacacaaaatgacacactgcactttagaaaatcagttggctaatcacatgatcacagttaacttcaaaaagaatgatccagtgtctattggcatgtgccttgaaggagaactggaatgtgtgatattatccgtggtgactcctatatatccctataatgactaagctatgcccacaaatcctcatatagccaggcccaggatctatgtactcttgtagtgcatctgttcagtttctctgataaatactcagtgagagctttccatcatcaagcacctaccatgcctcagacatgaaataagttgatcgtacctctgtgtgtcctcactggatctcacaaagtggctctatgttgatgtatggaaggaaagaaggaagggagggagggagggagggagggagggaaggaagagaggaggaaaggaagaaagggagggaggaaaggaaggaaggaaggaaggaaggaaggaagaaaggaaggaaggactgccacaatgttcccctggaatcctacctttaatgactgcatcctataaagaaatcttggtttcagttttccccccactcttcttggagatggggctagggatgcctattcttacagtgcactgttcaactctgaaaaggagtcttccactgttgtcatctaatcccactgggaaccttcaggaaacctttgatggtctgccccacccatcagtggctgagaagccaagaaatagaaagaagcctgggcctgctgagcctctagtaatacttttgcgggcatgttaccatattccaatatcaggaacatatttctgttttttatcaactctgtggcagccctttggaagttaaacaggcaccaaccatttggaacataggttgatagcagaacactgaaaatcatcagtctgatacagggccctctctggcacacgtctgtttccagagtctgtgcttcccagtttgcctgccaaagctttcttctagatctgaatagattctgtttactggggctccccctaccttctcaggcatttctacctccaaggctcctttctgtcctttgagctttatcacatgctcttaagaactctcaacttctgttactgcccttctgggagctccaacatctctcctcaggtaagaagaaaattccctgagtgtcaccttgtacaaataccaagatgagttctcccaggttgctaatttattttcacattcacttacagttcctacagattttattatcatgaggcctgagggagtatgagctttttctttcccatgcaaatatactttaaattcatttggaggaggagatgaaggttacccaaatgttgacagctgataatcttgtcagctgtgcctctgggcttcagtgctcagacccatcatccaatctgtcttaaggaaattgcagtcaaagcttccatgaggtaaggtctatacttccattgggttctacaaaggaggagaattgggaaacctggtctagctgtccctttaattaatgcaatagtagaaaaaagctttgggcttggaaaaaaaatgaattcctgcctttaagaacttggttgtatcatttgttatatacataagtgagaatttaaatggcaaagctgggtcttctcatctgtcaactggaataagatgcactccttgactcattggggtttatgaaggaagtaatcaatagtaataattctttgcgaatgctcaaggatctttaaaatcaagatacagatacaatttgaaactataaatattcagtatatgtgtggttgtgtggattcagcatatatccatataaaattaacattttaaggctagcaaaatagttcagtggctaatggtgcctgccaccaagtctgataaactgagtacaattcccaagatacacaaaattttaaaaaattgagaataaataattagatattttacttaattgttcaaagcaacagataagtggtattattcatgtttgtgtttattctttgagaattgtgtacagtaaatttttatcattttttcctcttcccaactcctcccaagtcttgcccctcctggtatatatgcatacacacatatataaatgggcatatatatattcacaatcttagaaactttaagttatattaagaatcttataacagaagaaagaaaatcattgagccctaagtctagtgtaaggagtaatgaatcgtctttaccacttaagttcatgggaagccagggcaatgagccttctgtggtgggctcacacagttctttttatatgatagaagcaagcatgcatgcttttcataaaatatattaaggaggatttttccatatatacctacataaagacctggaggaagagacactggatggcatcataagactttttttttttttttttttttttgcttgcttgctttttccttcctttttttttctcaaacactcaattagtttttttctatatcaattctatgaagtctgaggttacagtattagaatttaatggagccatttgcactcaaagattctgtttcttgctctataaaatggcattcattctactaattaatgctattaaataagattaatggatttctaggtttgtctcttttcagaatttttgatgaatattctgagcatgggcttgcatagatggcctgcaactggctatgtgaccttaggaaatgacatatacactccggttgtcttgtgtagaaactattgccgttcctggtatcagctcaaagagaatgtttgtagatcttaaacagcatccatgaagaatactgttggtgccctggcatgcatggcttactgccagatgtcatcatttggctgccatagatgtcatgtgagagacagaagggagaggtgctctaacacaaaaccatacaaaaatctgtgggacatttcagttttaaaactcaccaatcaaatttgaatagactgtgggcatgatgagagtattcaggaaaaataaacaaaaccaagcagggcccaggatgtgcaaagatatcctggggacatcagactcaagaataggaaaaaagatgggcgattacaaatgaaagatggtttactgtgtttagagaataatggggcctggggacaaatcttttgcaggcccttctagagactgaacattttataacatggctttcacctttgcaaactcaaaatttaatttattaggtcacaaagtaaaaagattgaaacgaagcaaacctgtaagaagttaacaacagataagcggggccttttgtgtttgtttattcttggagaattgtatataataaatttttattcgatcttcgggctctagacaaccgggccaccttcctggtgagagcacaggggtccgcccgacccgagaggtttctgcctcaggccccggcggcgggagcctccttggctccgggactctgctgagggcaggctgcacgggtgagggtgtggaatacagaggccagccgtatctgggacagacgagagccacagagcttctgaggcggcgccatctttggctccagacaaccgggccaccttcctggccaaagcaacacagttcctgggaaagatcctgttttgggccttcatcttcagccaggaggaggtccaaacaccagataactctgcaccttccctgaaagaagagagcttgcctgcagagactgctctgaccactgaaactcagaggagagagctagtctcccacatctgctgatagagggtaacaaaaataaaaagaggaacaatctctaaacaaagacaactataacaactaactccagagattgccagatggcgaaaggtaaacgtaagaatcctactaacagaaaccaggaccactcaccatcatcagaacccagaacgcccactttgcccaggccagggcatcctaacacacctgaaaaggtagacctggatttaaaagcatatctcgtgatgatggtagaggacataaagaaggaatttaataactcacttaaagaaatacaggagaacactgctaaagagttacaagtccttaaagaaaaacaggaaaacacaaccaaacaggtagaagtccttatagaaaaacaggaaaactcatccaaacagatgatgggaataaacaaaaccatactagacctaaaaggggaagtagacacaatgaagaaaacccaaagtgaggcaacgctggagatagaaaccctaggaaagaaatctggaaccatagatgccagcatcagcaacagaatacaaaagatggaagagagaatctcaggtgcagaagattccatagagaacatcggcacaacaatcaaagaaaatggaaaatgcaaaaagatcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtagtagtagtagtagtagtagtaaagaaagcaagctataatccatggagtccattttgtggccacttactcctgagcatgggctctgccccagaatatgatcactcctttgaagaaaatggattttcccctcccagcaggtatagcttattggctaggggtaggactttgttttcatttaatgtcctctgtgctgtgagtttgtctggcaagaacttgtgaagatcttatgcatgctgtcacagtctctgcaagtccatatgtgcatctgctctgctgtgcctagaaaacactattttgttaaagttgcccaccgcctcttgttctttcacacttcttccatataaatccttgactctagaggagaggagtatgataaatacacctgtcttgtcctgagcactcctaaatcttttgatttctgtatgttgtccagttgtggaacctgtgtttactatacactactgcaaggtgaagtttctctgatgacgcttgaattgaatgatgtactgacctctgtgtatagcagcatgccattaggagtcagtttactgctctgttcccttaatatatatatatattatatacatatacatacacatatatacacacacatatatatatatacacacacatatatatatacatacatatgtgcatacatgtgatgtatatatatatatacatgtgtatacatgtgatgtaatatataaatgtgtgtatgtgtgtgtatacatgtgatgtgtatgtgtgtgtatgtgataaatgtggtctgctgttctatcatcataaaattttaccctcacttttcctttgctcagtgaagtccaggctgcccaaggcatttcagaccccattccttgtctaatcattaccaatgtgctttgctttaaattctgtaatccacattttctcagctcccgaccaccattaaatatccttatgtctcaactggaaaactttaacaaatttctactttttaaagttcccaccatcatgatttcttacctcaaaaccatcctcaaaccacagccagtacaacacgatgctgtatcttttatttttagtattattttattagatattttctttatatacatttcaagtgctatcccaaaagttccctataccctccccccaccctgctcccctacccacccactcttgcttcttggtcctggcattcccctgtactggggcatataaagtttgcaagaccaaggggcctctcttcccagtgatggccaactaggccatcttctgctatatatgcagctagaaatatgagttctgggggtactggttagttcatattgttgttccacctatagggttgcagaccccttcagctccttgggtgctttctctagcttctccattgggggccctgtgttccatcttaaagataactgtgagcatccacttctgtatttgccaggcactggcatagcctcattatgagacaggtataacagggtcccttcagcaaaatctttctggcatatgcaatagtgtctgggtttggtggctgattatgggatggatccccgggtggggtagtctctggatagtccatccttttgtcttagctccaaactttgtctctgtatcattatttcccgtgagcaagatcgaagtctgagtagccacatattccaaaatcaaaaggctgagatcttaattcgacaaggccccttacaaagcttcaggatgtcccaccccatacataggtttgctctgaaaattgtgtctccctttgtcttataaaagacccagctgttaaggggagtttgatgatgatgacgatgatgacggtgatgatgatgagccaacattgctctcttcactctgcgactaggttctttaaagtggctttgtagagaaacattactggagtgaagtcacaagtcatcccataaagttgccccacatcccccacgtcccccacgtcccccacgccccccacatcatacttcttttttctctttctccttgaagacatggccaggcttgctcccctgtgctgtcttaaaacacctgctggccttgcagttaacatccaaaactaatgagaagctgtgctaataacaattatcataataaattggcctttgattacatctgtcacctgagaattccaaagactttacaaacatcaattagtgattccagctccccggattgcctccagagagaggggctcagtaaggtcaagtgtatggtatgtgggggagcatgaagggcagctccagcttacgctgattcagattgaggggatcgctggctcttgatggaaaacttaagcctctctccacgatgcccaacagaaacacacttctgacatcacaattaggggagaaaatttatagccgatacatagcccggagttcttattgttgaggaatgggaagcatgaactatagcctcaaaagacagcttatagatttcccagttcccttcttgtgggagaaaaatacaaacagtgacttcaatccagcctcccctactcccaccccatacataggtttgctctgaaaattgtgtctccctttgtcttataaaagacccagctgttaaggggagtttgatgatgatgacgatgatgacggatgatgagccaacaattgtttactatgggctttctctgtcagtgggtgatgaaggagatacagccctgtcctcagggagctcatagtccagtagagaagacagaagtgaaaacaaatgtgtgcaataaactgtttcaggaatcacttcagaaggcccggtataggccttgaaggtggacaggatctgttgcaatgtttgaatttaccatgaagtccatgaatttaccacttcccaggcaggaaatggggtaaagggaggtgtatcataagcatacaacatatggaccaaaggccatagatggaaggactccttgctacacttgtgagatttagtgaggttgtctgtgggacttggggagacggcaagggacagttggagactacataatgggagccttgcctaccatgctaaaatccatggttttctttctgatgaaaataggaaaaaagtatactgggataatctcagcattaacatgttacaatcatacaggtacgtgtgtacccctcttccaggcacatgtatatacaaactctgtttatcatggtgagatgtgcagagggcaagttctcattccacagatgctaccgttatcatgaagaacgtttaagaaatgtatcaaggtctctcacccaatgaggcaaaaatagaattcgaatgccagtttttcattattggtggcatggttagtatgtttaggcatgataccactaatgacagggatagaaatgtctcccattttcacagcctttacattctagtggggaccttggaaggtgacatccattcagtagacaaatagatgattttatgtggtgatgtctaagaaatacaaaggaaatactaagtgatgtactaactgaatcttccaaaatggaattggtaaatctaacaaggtggagtctttgctattgtaagtttgcagaatgagcactgggtcctttgggtccataaggactgttgtctactctaatgtcaaactaatatgaacatgacagctgaggactctttcctttaacactctctatctctatctctatctctatctctatctctatctctatctctatctctatctccatgtttgtgttgtgtgttgttcctacacagtgacagaaggcaaactagagcatatgtctaagtctaaagttgatgtccagtgtcttcctcgatcacatccatcatatttgctgaggcaatgggagctcagagcttgctgattcaggagagtctagctaactaatttaacctaagaacctctgtctcttcccaggtgctggcttacaagcagtctgccacactagcctggcttttacactggccctggaaatctgaacttcagccatcacgcatgaagaataaacactttatccattgagccacctctctggccttcattgccattttccttatcatcctataaggcttttgctggcagctttgacagaagttcacaaggcataatttttatatataccaaattttatgtaaaagatgtttctcaatatagccttaccttctttttactacaagttaaattgatgtaacctatatctgaggcatgtttaaagactttttgagttgcttgtttatattgtgtgcccagtttcagagagttttccaccttttttcaatcactttccaggttatttatatttcacagatctgaactcttcctccgggtgatgctgcaagtttctctgtttgttactcatcttttgactcgacttaaagtgttttcgtcacaacagatacaatataatccaacgcatcatttttatttattttctagcatttcaatactgagctgtagttagaatgccttttacatcagacacaaatgggtccacctggggttgcttctaagcagttgcttatgtggatttttgctgatgtttagatttttgatgaatggtagctaatttcaggtactatgtaaagtattttattagctacttctctcattgtgaccaaacatctgacaagaaacaaattaagggagaaactatttattgaggtttatgggttaaagggatatactggatgatgggaaagagtagtcgcttgggtagaagcagctgtcctcattgtccactaataagatgcagagtgtgtgtgtgtgtgtgtgtgtgtgtgtgtgtgtgtgtgttctgtaatgggtccttaccagttgctaaaagaagtttccttgatgggacaggggtaggggggactagacccatctgggggtataagggtaaatatttagaaaacaacagccaatcaaaatgcatagctgtggaacccagtctcagtggacacaattacaaaatactctgctcctaaggctcagagaacaatgttaagaacaggcagaaagatttttaagagccagaggataagggactttgctgtgagagggtatctcctagtaatatcagacactacacacataaagcctttttactgaacaaggatccatcagtagatgtgccaaagtggactgggaaaagaccacaaggccttatcactatagaaagaactttggacaactaaggtgtatggattaggatcggtgtaacattaggataatgttttaaagtattttgctaatgtatttttattgtggtttcagagttttgtgtccaacattttagtctttgatcagttgaattggtgtttatatggggcatcagctaacagtcatggttcagcctttacacaggagcatacaattttctcaacattattcattgaaatagcagtcatttccatgatgcataggttcagagagattgtcaaggtttggttggttgcagatgtgtttgtttctaggatcttaattctgttcattgacctgtgcatgcatttttgtgccagtatcatattgttttatttgtgatatgtttattgcatgacttcagtttaggtgttgtgaggtttacaactttctcagttttccttaggttattttggttgtttgattccttctcgctgctacatgaacttgagttttctttcctagccatatgaagaatggcattgattcttttaaaaagaataagaattgcattgaatcgtcaaagtgctttgaataataagagcattttaacaatattaatgcttataactcataaatataggaagtcttttcatttttgtttgtctcttcagtttcacctgtgttttgttacagtgtagatgtcctttgcttccttggctaaatgatttctggtttgggagtgctttcaaaggagattgcctttttagatttgtgagtttctttctcagcaagccagctgagaaaaatgttccaaatgtgtgtgtgttggttttgtgtcctccctttttcttaatttctgtctcatttctagcagacctttgcacacgggtggtttggcacttcccttttctatttgtatgtcttgtgttgcattcatctgatttctctgctaacacttctggggtgatattggagaggaaagatgaaggcaaggccaggaggcaaataatcctaaggacttgggcggctaagattggaggattacaagttcaagactcgaattagctacagtgtgagtttaagatcaacttgatcaacttagaaaaattctgtctcagattttgaaaggtgaaaaaagaaatagcgtcaaggcaaagtatttgcctagcatagcagaagtccaggttcagctcccagtacctggaaagaataaaatatggtgagcataactactcattaattattcaatactttagagaaaatactttctcctttgctgtcacccagtaagagattggctattagtttgttatatttaggttgttttttttaaattgaagagccagcgtctgtacctatggtgttttattgtttatttttgcatcttttgagatgagcataggatgttttgtcctacatggtagtgtttgtgtgcatttcatttgtatagttgagacacccttgcattcctaggataatcaccattcagccattgatgctgtcgttgtcaatgtgccattggactcaatttgctactattttgctaaaatatttttaccctaggttcattcaagatgttgtaggatgatttttctttctgtcctgttgttgttgttgttgttgttgttgttgttgttgttgttgttgtatccttgtttttaggataatccaaatcaaaatcaagagaaaaacatcagcattaaactaaatgacagagtaaaggagcctttatagctcatcttagccaataatggcgcaatacacattatttttattaacacgaaggaaaatatttgatattttcctctactcattaaatgattttttttacttaacagttttaatgttctttgtcctccatttaatatttcttagctaacttctccagagctcaatgcattctttcaatatatagattcggcctaactcccagtaatctactgaattattattatctatctagttctttctggctaataggggttccatatatacacatgccatatgttcttgattatacttttgggccacgttttataaactcttgatttttcttgttatttaattttcatagtaactttttcttcaaatgtttattaagcttctctctcagggtccttgtcattaatcatcctttgggaggtaattttgtgtcatttttccttcgtttcctttatgagttaaactagttctctttgcattttctccctctgatttctgtgacatttctgcttttaacttgtctatttctaaaccagagggtttttttcccaagaatattcagttcattttaaagtgttgggttacttttgttttctcttctgcctgtttgtttcctggtaggaacacttccatcatctgcatatggctgctttattatttatccaggattttattttgtagacttaaagtggcttactaaatttattatttaaacactcggcgatgacatgacagggacatataagattccaaagataatgtatttattctgtgtgtataatggatatggttgttcataaatgtggaggtcacaggacaattttcaggaatctgttttcttcttccaccatgtagatttgtaaaatcaagtcatgccatcaagcttggtggcaagtacctttacccaccaagaaatctagccagtccctgcagtatagatttactgagtgtttactttgtaccattggtgttgaatgtgtatagtcatttgtttacttttgagatctcttgccctctctgatggcttgtgttgacaatcatagacacatttcgttcatatttatctcttaccatgttgcaaacagggacaatgcagtactaataatgtctgtttgttaattttggtgagattgtagatactgactgtctttattttcctgtattatttctgaaaaatgatgcaggaatatttgatgttacattgttaatgacttttcaactattcatagccaatagaaatttacacttatttggttataggaagtgatgtaaccaggaaagacaatgctaaaatcaattttttaacttaataatggagtagcaagttgatgtgaagaactttaattaagactgttggtagattatgtttggaataggtttgatagagtgattgagttagaattttttttcaaggtctgcatattcaattgtcaatatttcaagtatactgctatgtgagcctacatatcaagagtaacagtgctagaaacaacaatgacagtcccaaagactgaatgttcaaagatcgttggtctagcaaaggataaatatctatccaaaaggcaagagtagggggaggaatgagggaaaaaacgacaggtaagagcaaacctgaaatacagagtaacccaaaagtcaagagtataaaagaggtcagggaaagagtgatcagctgcagctaatgatgacaggtcaaggaagacagggttggaatagcagcaattaaagatgaacttgagctgctcttccctgacctgatgggagcctctgactgaaggaagatgcacagagaaggtgagccaaaatgatggaatcccctgaggaaaaacattcaagtgaagatttgagagtttaagcttggctgtatgttttctgaataggctaacctgagacttagcagtttcctccctgagagctagactctgggttctacctattgcaagaaaaaaagcatagcctgatgctatccatgaacacctcacaaggtgacatggataatgtccaccacgcacagtgtgtcagtacaaccatctgtctgtagctcaagatcttgctgagttccaccccagtgactaagggatcacaggcactagcacacatgcccagtagtaaacccaatctagtatcactctggctctcttaccaactaaaaggcatctgtgaaggtttgtattttctccgcccagggagtagcactattagaaggtgtggcttgttggaataagtgtggcttattggagtagacatgtcaatgtgggtgtgggctttaagatcctcatcctagcttcctggaagtcagtattctagtagcagccttcagatgatgatatagatctttcagcttcaaccatgcctgcttggattctgccatgctcccaccttgatgatagtggactgaaccactgaacctgtaagaaaagttgctttggtcattgtgtctgtccataacagtaaaactctaagactgtgtcccttctgtctttccctcaaaggagtctcccttactaccacctaattatgctgggtctccctaagtttctggaggccatgtgcttccctttgtcctctctgactttctgacttctctgaggttcctatgtcaaatcaaagcagatttcttttcattgaaaaccacttagcctgtttgttctcggccatctttgtgtgatgactcagaaaagcagatgaatggcaaaaagttggttgcatacagatgcaaagaaaaaaggccacttgcttaaaggttattttgtatttcagtctggtttgccatctgcgtaaccttgaaaaatgtcatttaatcttgtcttctgagagaaaacaaagggggcagggatcgtagtgttcaaatgtagttgaagaatggaaatatataaaatatatagagttttgtttgaagggtggagccattttttaaaatgtccttagcatttatttcatggagttgattccaacaaagatgagcaccagcttaaggaccagggccctagagttgggggaagcctgggctgagggtgcagtcatcattgaacccagaaaccctatactacataagtatggagtggcctagggtggtggttgcaagggatggagctctgcatccagacagagtcatgctgtacattgtattcctagggtaaggggaggctggatcaggactctgcctgatccaacccattgccactctttcatcttttggttggtatctacaaccaccttccatcctccgtctcattttattattactttagtctgttcccttatccaatgcttttgacatgttcaaaatctaaactttgccttcttcctgtttatataactctcttgcttttaaagtataggccaaagtgctatttatagctcctgctcacaccatggcccaagtaattccttgtgattatggcctctccagacttcttcatgtctgcactgagctcttcattttcctactccaattctcagcatatctgttcttgggtctggacaaccctccttgacacttcatatatctgactcccacttctcttccaagtgtccgactgaatactctttcaaagccttatagcatctcccttcctgcccacaatctacattgctttctttacacctaacagcttctgctcctattgcttatggctacttgcacttcaatattttacttgtggagacagctgtttaatgcttatccttaccccaagagtgctcagcctgcaaagacacagaccatgtctattttgtttgttgttgtagctgtggtacccagaacaaagccagacacatagtgatcattcagtaggtgtctgttgaagagctgactaagtaataaagataaagggattgggtaggttgctggttcttgggtcttagaagaaatggaggacataagccaaagtcactggaaaaactaaggcaagacttcaggctgaaggtcaagacctagcttactaactgaggaagttagagaagacaaagattcaagacagggagctggggaaaacatttgaaaagcatgaggtcaaagttaaaccctcgttatactgcatcaggaatctaatgggataatacagtaagaactgcatgtattatccaatttcccaaggcttctcggtggggtgaggggtaggggtgatgtatcttaaacttctggacaataaacagaaggaatgggcatacttggatgctatggatatttgtactgttatcttacattagggggggcatcagacaattgcaataagctgctaaagtatggagtagcatattatattattgagtaagttaggtttggcttactaaaaagggcaattatagaaagaatgtaggcagtgatgtaaaactgacttgcctaagacaaggtactagagagtgggatcaagaatcaaggagatagaatactagaaagcagtaatagtacagggagctaagactagatccagcgtttgagaatgtcctcaggatggtccagcttctccacaaatggagtcttttcctctgtcatttgattctgggaaagagccacagagagagatggtggcttactagaacttacccagctctggcagagctaggagtagaaggggaaatctcaacacaggtactgaggtgagattgttataaattcaaccccaaggtgacatacacccgtatgacaattgtcaagtctatggcaggaaggaaagcatgagtgttgtttgaaaggtgaggaaaacgatgtgtgctgccttgacaccgattccctacccagagcatgttttagtggagatagaacaaaaggtactataccctccaggtacttacacagtctaagcagagagaaagaatttacttcctgcttattaatctgatcgggactctgaacatatgcacactggcaagaccattcatgtaatagaatttacagtgtccagcatgtctcctattttctcattgacagtccaatcaaccagaaggtcaagggaatgattcagggctttgtaattctttacctaattctaaccaacaaagacaaattgcttatggaactaaagctgtcaggagcttagcagaaagtgaacatgtcagcttcgtgtttgtgaaagtcagaaagacagcatatgtagacatgcactctagtgtatagcaagcagatttttgccaagagttgaaggggttatgttaggaaatggctttgttttcgggcttgaaactgtggaggggaagatgattctagataaagttagaaagtctcaaagggagccggaagaaagaactagggagcaagaataggtgatggaacaaacccttgtatctatccatgcttctcccccacacgttaatatatacctcaagagattaccatagaagatggattaatctttcctttttcaaaaaggaagagctgagacagcacctggaagagacatctgggatgttggtgacatctgagatgttggtgacattgagtccttagacatggatgctggtcataagtgtgcgtgaacttgttgaaaaatctgtcagattgtatttaagatatgtgtttaagatgtatctttgtgtgtcatatctaaatagcactgcaacaattaaattcccttcaggacttctcttcaggcttagaatgacccattcattataataacaatagtgctttgcttattcatttaatattttcttgttaaaaagtttgtgtataggaatgttttgcttgcacatgtgtatgtgtgccacatatatgtctggtgtgctctggagtcagaagagagatctggatcctgtggaggtggcattaagaacattgtgaatttctatatgggtgctgggaacttaacctgggtcatctgcggggccagcaagtactttgaaccactaagccatcactccagcccctcccttcttaatattttctgatgcctatgattctatgtagttttgttctagcattattcagttgtaactgcttcctcatgtcctgtgttgacatgccaccacttcctctctcatgctttcgtagttagattaacacatttctcttagttttcactttggatccaacatgtttaaacattaggctgttttctacattcaatgttattttctgagagtactctcttaggtagaaagattgtgtctgggtcagatctctttaaagttaagatatgtagactgagcctcctgcctgtgttcacagatgtagaatcgtagatatggatgacattcttaaggaacatgaacatctgtgggtttggtttccatggaggttcaggacaatatctagcttagatagcaaaggatgactatattttcaaattcctccagcagtcttggcttcatgcacccttcgcccaccgttacatgtaactaccatgcatgaaaatggcaagttttcttatataacattttcaaaatctttttcctttgcacaaatttgaagttgatgaggctctgactcacatcttacacctctcccactcttcagtttcccagcagtggtcagtgtgatcctatcctttagaaggcttcagatccctgtgggtcacactttctctaactgtctcaggctctttaaactaatcacagaactgaaaaatgacaggaacttaaggaccatcctctttcttcaaatttcagtagcaaaatattagtttgttagctttaccgtcatgtacacatcttttggatatcagttctttttcaatacatgcctttttggtcatatttatttctgtcttcttgatatattccttaatatatatatattattatatatatatatattattatatatatgtatatatatatatatatatatatatatgtgtatatgtatatttcaattttcatatgtaatcctaaaaggaatacttcagatatctgaaccataatttgttgaactgttcaacccatggttttccatcctattaaatttagttatttttttacaggggcattttcataatgagaaaagaaaccctcattccaaagaacaggtcatgccagcccaaccttcttgctttaagaagcacctcagatgaataggttgggtgaagcagtagatagaggatccatatctacaatgaacttaaccatcatctcacgcctctaccatgtggaagctacaaagcatgaacacttgagctatttacaatatccgaatggtgaagcagtcaggcgaaccaatagctagttagttcaaagactctgatgtacacatgaatgtcggtcaggaggagagctcagcatgcatactctacttctggcattctcctggttactactgactaattattggcataaaatgtcagaaaattgctctctaataatgtgtaagtgatagaaatgagatagggtattatattcagagattaaaataggaatagtattagaatcagagcaaataaggcagaacccatagtgataaatacgactttttacttgggatgggaggctggctgtgctactagatgctcaatccaaataataacaatacaatagtcccataatgatgtgtggacaaggcttaataaagactgtgtgcaagctgggcgtggtggcacacgcctttaatcccagcactcgggaggcagaagcaggcggatttctgagttcgaggccagcctggtctacaaagtgagttccagggcagccagggctatacagagaaaccctgtctcgaaaaacaaaaacaaaacaaaacaaaacaacaacaacaaaaaaaaccaagactgtgagtttctgttcttgctattgctcgctgagaggcataaaagggaaggtatcccaagatgagtatcaaagatggcccagaagacttgaactctaatcttacaggggcttgttgatgaagaacgcttatgatctgacgattatctttcagtattttaacccttttcctctacaagcaagggcaaactttctgtgcagccaggagctagagtcaggacagaaggacttcgttatagggaactctatttgagctaagaagagacaagttgttgtatttcaagggttgtgcatagatggaagagattctgccagcaaccatttcttcttagcttctgggtataagatatagaagactccatttcccttcctcaatgaaagtgggtgtggccatattactagttctagctgatgagaccggagtagaattgagagtgtcacttctgattcaaggcatttggttgctagactttcccttctcagcatgtttttccttgggaataaacatggataaagcagctgccttgatctctcagagtaaatatgtcatttccatgccatgtctctctatcccatccctcagacccaactacacacctatatggaactggtagtctgagtagagaataacactttgctgttcctatgaatggaagtctgaggggtttattgctgcgatgcaatctttgcaaccagatggacccaaataccttcaaggcagagtagatcctatatgaagccccgggtccctgacatatatttggtttggtatctcatactttgccttctttgcgtttcctttctttgctacattgccttcaaactgtaatgtagtcagctaggatttctgctggctccaggacctctgggaaatgagttccaggagagaaggctgagaaaattctactcatgagcacattttgctgtaactccacagcatgccagcaaggtcacagatttgtggaactggttcacttggaaacaactaaaagttcacttggtaaagattttatatacagactaacagacacacagatacacagacacaccttcacatgacaagcacatatatagaggagacagagagacagagaaaaagacagagaaaaagacagaggctgacacatgcatgtatgtgcacacacacacacacgaggggggggagaggagagaggagagagagaaagagacatagaaacagagacagagtgagttagttttaaaagactataaaacccatcaaagatctcagggccaaaacaaccatttggaacatgaactcattgtgtggaacatggaatcatggtgtgattcacaacacacatcacatagacttgactctggtcacatgttccttcattctatacatgtaaattagtggctacttacaacaaaatttcctaaggaaggcttggtttcatctgctacctcacacttgagaacaaagaatgctgtaaactctcaaataaccactgagaactgcttaactttctgggtgctagaatatttataaagtacttctgcctgatgaaaaggttgaggaggtagcaggtaccatgaaacaaacagaacaacatatgttctgagcctgagaggaaatagagagctgaaattaaaaggtgatcccaatagtggggggaaaatggaaaggacaaattttaaattataattaaatacatatgtatatacacaattccctaagtatttttatataataatccttatgtaatcaacaattaattaagtgctgtctcattcttttttctccctaggagacaaaaatcaactgtgtgcgtctggctacaaaaggtatgttgacatgtccttgtctgactatagctgttcttcaacaatacaaccattgctccttgtgtccacacaagggaaatttaggcaatctttaaaacaaaaggaaatatttgtatttcttggggtcatttgcatctatagcatgtatctcctaagaatatgctgatagcatagagcttaaagcatagtaagaatgccaaaatatatattgggtggatggatagatggatcaatggatggatggtacattaatcaatcaagtaatgaaagtgaaaataaagtacttttaaaatattaatctgatgtgtgtgtgtgtgtgtgtgtgtgtgtgtgtgtgtgtgtgtgtagttccagtgtatttgtgtctatgtttgtgttggtgttttcctttaagcttctctattagagctgtagctgtggttttgtactttattcggttatttcatggttatcaaatatgaggtgattagtattggcacctttaaaacaagagagcagatgacactacattgttatgtcctctgcattccaacacttatcccccaaacatgaaggcaacattgttcagcctcatcacttttgttctcctaattataattgaattgcctggctctttcaattggtacatgtttctgtttattaccttttttaaaaaaaaaaaaacaaaatcaatgaatggtttgttatcatttaacctattacaaggttgaatggttagaaatcaggtttatctttttcttacagaattgatattttcaaaaagaacttcccccaccaatacacatgaaacaaaattggcttctgttctctgcatttattcacagcatacacaatttcacagtttacttccaagggtgtaaaatttataaatataagcatacatattatcgtagctataatagacaaagggaatgactggagtttgtatatgtatgtgtttgcatgtgaatgtgtatacatgtgtataagcaaaagagtcacaaacatttgggtagaaggggagatacagtgagtgagtgagtgagtgagtgagtgagtgagtgagtgggtgggtgggtgagtgagtgagtgggtgggtgagtgagtgagtgagtgagcaagtggatataaagacagacatggagaaagaaacagacaggaatgggctagaaaacataactagcaaagcatgctctttgaacgtgacctcttagaatgtttctaaattctaaagaattcaactgcacatataggcaccaaagggatggtacaggaaacaatggagcattgggactgttggtggtaagaggtcaccaaggctgttatgtccctaacttgttccctctgaggaactcaaatggctgtggaaagagataaaatagtcttcttgaggcttggggattgatgatctgcagatagaagtgacacaaatcacagaccttacaggctttgtcactgaagaaaacagataatgtagaaggaaggacatcatcaattgggtagcactggggctctagacagcaatcaggaagctggtatctgcagcatccctcttaaataggcagccagagaagaaagagaaaacacagagaaaatgccttctccagagtaataatgtcccatggcttccagatacctttcactttagacagggaagaggccaaggggattgctgttcttgctgtggcttctaaggacacgctgagacacagatctctccaaagagtcgtttactaggtccatttcgcctgagaactgggaacatgagacttgagaagcaacaggtatatgtaagggtaatgggatgatgtataaggctgtgctttcctgccagcctcaggaccatagttctcaggagtatagagtgctactgtactggcttctccgaagacatgttgctagtcagatggagagtggtaaggatattataagaactagaacaagtatccagtgtatttctccataatgtaactgtgtcttctcctgtgtgaccttaggttagaggcttcctttagttgagtatttgcacaggtaaagtgagagtgtgtgaaatagtagttgtgcaaggatgagtgtgtgaactcccagctgactaagcccagacagtattcttaaaggcatttcagcatcagcatcctgcttctgtactagactgagactcaacacttcctccccaaacatagactccattatcacctgggaaaactacctatcactgagaaacaatccatcattgttcaaggagccatcccttatcaacacagcctcagagaaggagtcttgagaaatacagcactaaggttgaaggaaggagattcatggttgattagtgtccactccatatccgtcactgcacttgaaatatcccagagtcaaccaaaagcaaatgctgactgaatccatgtatttcccataaggctttgaaatgaagggtagatacatgagttattccttttttactacctagatcaaatttcttctaggtaggattttttttctgttaatatttttttagcaggaaaaaatttgatcttaggcatcttacagccatcaacattataaagtccccaaaatatgtcatcactctctaagtatctccatccttctgctatcccggtatcttccttgggggcctgctgacagatgcactatggctggagagagagcacatgaccagcgctctggtgataaagtaacctgctgctgtcttgttcctgaccttgggttctctagctgttgtccatgatcagctgtgtgaagcccacagaggcagacaattatcatgtgtttcagccataagtactcatttggagtcattctgaattgaccttaaaaccattaccttttttgttatatactcactggctctaatgtgtgtctctttgtgatctctggaagcaaagcctgaggcaaggatttagagacattttctagtgatctgttcagggaggtctctcaaaagaaatctgtaactggaaaaaaaaaacagtaatgggataggataagcaagaatcttttttcaggaagtgtcaaagtaaggctggatctacggtgaatacacatttctctgcagttgtcttggttcatagtaagaagacctcctagtcttcattagactctggctcctccctaccagtctctctggtagttacagaaatgacactggttgacttagactagatgccagagaatattctggttgtaaactcttggtcacatcaggttttcattttcaggtttgctgcacaaacctgaaatgaggaactggatgccaagccaagatcctcttcctactatctctaccaccctcaggtttcgggatagcagaatgctactagagttgtcccaagtgtgatagattccagaacatttccaattcctttgtagaccacagtccagccctgacaatagacctgcttcaaactgtggagagaaaaacaggaataatgtgtaaataagcattggttttgttttgggggaaaaaaaagattttaaaaaggaaggtaataaaccaggaagcaaagatgatcaatttaaattcaggttcttgagaagggctgtcacatgctatctgggcaagagacagtcattgcaatcaggaaaccacaggatgccttcactgggtctataccagaacaaggccatcaataatcggacatgggtggaggaggatggtggggcagctaacattcactgcagaactatttgttgctattgagaagttaagagggaggggatccattgccttcaattgtgtagcctctggtgacccactaggctccaatggacatttctaatccagtgaacatacaggtgaccctggcaaaactaaatgggtcacaagatcaactgaaatttcattagtcttggaaagaaactgttccaaaagggggcttgagatgggagggagacaagggaggaaagaataagttattagctagaatgcatttcacgtgtgtgaaatagccaatgggataacttaattttttacattgtcggctttctgagagtatgtgggaacttggaatacattatgtagtactcagaagggctgaaattcaaataagagagaaaacgaccattgtcacagaagaagcagcagcctttattgtaaaccacagtcctacctgtagctgctgaagatgtccgagtactgaaggcacaccctttgggttaggacagaggaggccacgtacaaaagaatctctgagtatggtgctcagttgcagaagtgtaaaaggcaattcctctttcagaatctgatgttgatagaacctagtggggaaacccccactcaattccagattcggcgtgcacccaaaaaaccacgaaggaccatcttgatgtaaatacatgaggtcgtttaatgacgaagctccggactgacatgcatcccacacaggagataacggatgttggccacaaggctcggaagctaggggtttttatggagtaaggggcttagggtgtggaattcagcatagcaacacactattggcttattcaaacatcagcagaaaaattacatgtgtgtgcagggtgtcagagttctgtgagttattgactccgttcagatagccctgttatgtcttcacattcccctttaacttatggtcaagctgttcccaggaatgttttaactacggggcataccaaggtttgtttttctttattctcagccccaggtagcctctagatcacaaacaacagcaatttctgagtactttacatgacttacaggtcttgaaatttcatctttctttcaatgtttagccatccaaaggccctaacccagtgactctcctgggccttctttgtatcctctgagcctcgctactttctctttgccaccatcttttctttccagcattatatgagccctgactccccttaagcctccttcaggcttttcctctcttaaccactgcacccccaaaatgtagtctttgttcaattaatttttagaatcatgtttgtttgtttgtttgttttgctgtatgtaggttagaactaacatgtcacagagcatgtatcaagatcagaaggctacttgcaggagtttattctcttcatctaccctatggctctagggatcaaactcaaatttttggacttaaaaacaaatagtcaaaggacaaagcaaaatccctttgcctactgagtcttcctagcctttttttcttaaacttcattcattcattcattcattcattcattcatttctatgggggtgcacacatatattcacacatgtgtggggaatatatatatatgcatggtatatatatacatatatatatacatgtataagagtcaaagaacaacttaattctcaagtacttttcaccttttgtttgaggcaagagctctcattggcctgaaactttttcatagaggccagtaattgtctcttacacttctgtctcacaagaatctagggatctacctgtctccctcttctacatcaccaagactgggattacaatgcacaccaatggacagagcttttcatcatagattgtagggatcccaactcatggcttcatgcttgcaaggaagagatagtgcttgagtacctctttttaaactcttgaactatatgaatttcctccaaccacagagcctttctttcataatgaaccaccatatgtatctggccatcataagtatcagctcaatatacagacattttaagttgcaatatgaatcttacttgctaaagaagaccatccttaccacaaaataacatacatacacaaagtttccactttggttgtggtactcatctcagctgataagcctgtatgtgattaatatttgccatcctgctggatgtcaactgacataagtgtctattttgattatcactgtgtttccagatcttagcacacactaatactcagtaaaaattgttgaaaaaatatgcagatggatggatggatggatggatggacggacggacagatagacggatggtgctttgttgggtcagtagacagatggatagataggtactttgatggatgaatgggtcgttagatagatgagtagacagagtactcctaagttattattcttctaagcccactttttaaaaaagtatggactgtgctctcagaggatacagtaaggtaaaatagggggacaaatctgttatctatgatccccacaagcaaaaacaaacaaacaaaacacaggttggtctttacttttgcttcatgtggacaagaatttcactactccttcaggaagttccttccacttttggacacaccatttgcctggagttcctctcacttttggacacttttgacttcttataatgcctgctaaccagtcctcaaagccacatagtcctgtctagctttcctccttttagaaatagaatttacttcctcagacctgttctcccaatttcttgctcaaatagggtcaacaggtccacacttgcccatcttccagtcttacagcagtgggttgtaaccactccagatgccagcaggcagcaacactcctgccattggcaccagcttttgggagcatgcagctgcctctgcagactcctgctgggtgtgcaggaatggcagttagaaaaatcagctttgatttgatttgcaaactgagctgagtcattgagacaaaataaatccggaaacccatagagccatttgcagagttgctttgcagaagacagccaccgttttaatctagtaaacattctaacgatcccattaaagtgccccccttggagtaggtgctgaaagggaagcttcagaataatgaagcatgagatatgggactagtgtcaccaacagctctgtcttgcccattaggaatggtctaaaactattgtccaacaacaacaggcaagaggcatgggcaatggccttttgtaaacctgctatctttttgcaagtctaagtctgaagtgagttatgtcattccacatttctttcttctctcttcataatggatccacactgctacaggaactgacagctacgataaatggctcttgtttagagagacacctccattttgcagatgctaagtgtgggacccagtgatatgttcatagcttctttatacacagaagaacaagtcacatgtagtacaagaagccaagataaatgtaaaagataatattttgggggtaggaagttgccagccacactggtccaattctacttgaaaggttctcttaggtgctgcatcctggagacgttttcttgaaatcatgagaatcagagacacctggtttcaaaagtttgcttgaaatcatgagaatcagatatatctgatatcccgtctccaagccgttacttgacataggacaagtaatttatcttagtagctacaacatcatttttaaagcaggttccattaagtctttccattgttctttcatccaagcatatgatgaattataaacaaggaacttccatccttcctttgactacacaggtctttactagagcttcggtcctatatagatcttgggtctctgtagaaggtcacagaccagactctagtcatttctcatgtagttctacatatctaccctgtgttacatggactcagattaaaagcatagtggagaaactgaaagggtgcaggcatgatactgcccttggcctttagcacttgatatcgaaagatcatgtgcttagataaagatcttacacagaaatttgtgagagagaggaagagagagagagagagagagagagagagagatcttcattcttcatgtctagaattttcctcatctatttattagcatttgacatgggactgttcctctcttcaaacttgcccagtagtatcggaggagaccccagaacacagcactcccaaacttagctatggtagctgaacagagatataatggagtatcagttgtaagagggaaatctgaagttatatagcacagtaagaaagtcttgactgttgttcagtctttaaactctttcaaactgcataggaaggagctgaaggtgtgagtttgggggttggaggcacagcactgctgttcttccctagctgaaactcagggtgaatatttctgggcttgggcttgtataataaaacaaagtctccttgacctttactactctttaccctgtttccagctagatcctaaaatgccagatggaataatacagcttttcctgaggggtgtacaagaagatgaaagattacatcacaaagaacaccataaaataacctgaaggtcttgaaaaaccccaaccctttccttaatatttgtcttgatgaaacagctggcatatttctctgatctttccttttcctctccagactagctcaaatagcatccttccatacacaccttctttatatcccactcaagaaggcaaaggctggtgcaacagaaacccaggtaaacaaaagctagcactgactcttgtcctctgagcacaaaccagtggagttttaaccaattccgctcaactagaaggaagaattatctggtgcagacctgagataccatggttgactttagctcaaaaacatgcttccaaaggacttgtgtctctcttaaaggcagaaggaggcaatttagacttaaggttggggacattttttgagtaggctagagatacaggttagaaataaagagaatttaagccttatcagtgggctttcaaatgggggaaagaaggtcttcaaaaaccaagccaacacctgttcacctcatagaaccagtggcagatcaaagaaaccattcgacacaaaatttagcttagtgagcctgtgagtttattacaataaccaactcaagtatgggtgactcaaaagcagctgcatcactaagaatctttcctctagcatgggtgataactcatgagagctctgcccctggagctgactctatggtgctggtcagaatcccctcccccagcaagtgttacatctcttgtaaccttggagaggggccctatgaatctcatttccggagcttcctggggtctataatttttgttttcttgttgagtgataactagtctccctgtaggaggacaagactcaatcagaggaattagctccacaacagccagttgtaggactgtttgtgtagatgtgtggtgatgtcaggctccaatatgatgatagaactaaagtatgtcactcagcaggtgatgaataaatattggccactgccattgtctctactcaagaacttgtgtaggctcagaagtataacaagcataaagtctccaggagcactactcagagctgactccacatcactattgaattttgttcctatcacgcactaagataatacatggaccactggtaggatttcttgtcttctatttgctaacctttccccatacctgttttctactaaagattgataagtcattctgttagtttgttagtttgttccctggttgtaacaggctttgtatctcttccagggtatgtaagttaagacctgaaatctggagcagaaaatatggtggctccaggaactctcagctctcttcacttcatactaaagctaagaaattagcttatcttcaagcttgtctgctccagggccttcggtagcctggcagtatctctctacacttgacattcattgcttttcaagaaaagaaaaagttagaggcattccacattctggcctcctatttctttacttgctcacaagtaaagaaatgtcatccatggttgtttatacacataaatgcaccaagcagatcctttgcaaagagatacgagtctcaaaccctccagttataaaccaccacatggggaaattaggtgatggagaagaaaggaagatgtttccacctcttcttcaaatgggttagtcaggataagataagctttgttgcaataacaaattataaccaaagatcagtagcttaataccataaatgcttgggtcttttgtttctttgtttgttttgctatgtcatctagagcatggttgatcactgcaggggaatagaaactccatagggagtaaccttgatcttaaatatctcacttagacatgactgactaatgttttcactccatgcccttgataagaactactacctgatacagcctaacttcaaggtgacttagtgtcttctatacatctcagaagtaagcaggactggtgagcagtattatttctggttctgtgtacatctcctatttccatttccttactgagatccataagccacacctctcttctccttctccactcacaggaaaagtacctttttgtccctgtgctcttatccttgctagcagacctttcctgcagagctgtatccctggagggcaaagtgaggggtctcctctgggccctgtcagctaaactaagtaatgttctgttttccttaaaaaaggttttgtgagatacccattgttacttccactatttgggtaaagaggctgacttagaagtagatgtaattttccaagtgacacggctggtaaatggaaaatacggagccagggttttatgtacacagttagcttgtattatttgtgtattaagtaaaatttcatattgttatgtggccctgtattctctagaggttactaagttcttctttgggtttgtatagcattagattctaggcaggaaaagagacttaactgatctgaatctcaattccagtatgcatagactgataataccaatgccctgacctaatataagaacataacccagtagtgcacaccaaatgctctgtgtagctcccagcatgtaataaacactcagcaaatagtgtgcaccagaagagctaacaaacacacaccaatatactgaaagacaactaagatgaagatgatcccaccatgctcttggaataagaagggaaattcaaaataaacaaacaagcaaacaaagaaacaaacaaaaacatagaacaagctttctcaaagtgtattataaccaaaaatcagtagcttaataccataaatgcttgagtcttttgtttctttgtttgttttgccatgtcatctagagcatggttgatcactgcaggggaatagaaaccccatagggagtaaccttgatcttaaatatctcacttagacatgactaatgggcacaaaaccaagcttggaaacaggagagaaaatcatcacagtgaatggtcttgggttggcaaggtttcaagtcaaagaagtagataggcagatcatcagaggaatggtgctcatgtaccgtgttagggatggttaggaacagtcctggggtggagaaaaagcactagggagtgacagctgcctcagcattaaacaagccttcttgctctctgagtcccagcacccatatcaggtggcccacaaccaccttcagtgacagagccaaggggatgtgaggcctctggcctccacgggcacctgcacttgtgcacacagacctctcatataaacaagtaatttaaaatagcaaaaataatttaaaataagaaaaagaaagaaacaggagtatcatgcaaagccactttaaataaagccttgtggtggttcgttctctctctctccctctctctctctctctctctccctccctccctccctccctccctgccccctccccctccctctttccgccatctcttaagacagtaagagtgccggctgggagtgcttaagcagaccccttttatagtagagtaccctagatgcagcctagacagtggatggagaagatggactgaggcaggagccaagcttcagaaagaaccattaggagtttgctgaaggaggccatgtagagtatgggtcatgtctctccccagccttttgtttcctttactgaatgtgaggtcatcagagcctcgtcttacctgcctcttgggtctgggaagcaaacagactcatagaaagcagtcacttagaacagaggttagcaaactttcctataaaaggtgaagtagtgagtattttcaattttgtaggcctcaaggtatttctcatacttactagctttgtcaccaaaacacacacacacacacacacaaagcaatcgtagagatacttacaagtatatttatattaaaataaaactctggggaggaaagatttgagtgtatataatgatatagtgttcatagatgttatggttttatctctttcctgggataaaaacactctggcccaaagcaagtaggggcagagatttgtctcaacttatagattacagttcatcatggtggaaagctaaagcaggaacttgaagcagaaatcatggaagaaatgctgcttgctagcaggctcacaggttcatgcttagccaccattctgatatatcccaagaccacttgcctaaaggcggcactgcccacagtgggctgggcctcctacatctaaacaatcaagacactccaccccccaacacacagagagacatgcttgtagcctgttctaatctgaacaatccctcagtcgagactcctttctcagctaccacgccaaagttgacagttaaagctaactagaacaccatagcaccaaatactagtcatgttttcttaaccattggaaaaaggtctaagaatcattcttattttatacctacacaagaaatagcatagataccagacttggctcacaaactaaccactgacttagcaagtgttttgaaaaggacaaaatgtcattctttcaggaaggagagttatgatcactgtgcataggtagttaatttttatacttgtccattgttggtcaagcttgacccttgtttcatttttgaaatgatgtatttttttgtttatcatttggtcagagacattccatcactctcaatattctgcataaggatcttatgcagttttgctgataaatgactagggaacattgtcatctgtcactaagggtgtaacacttgctgggattttgtgtcactttatttagaaacttggagggacagggacattaaagatagacaaactaggctttaaatacagcctctgctagttactgtttttgtgaccttgaacaacttgtaaaaattctgagtcaccatttattcattaattcattcttttacacaacaaatattcattgagtacctactatatgccaggtgcaacagaaggccacagaaatatatcagtcaatgggacagagcatctaccatcaaggagactacacagttaaggagaaggcatccactcaaaatgcaggggatgctgcaatgagaagggaatgttaggatgttgtggaaagacagaggatgcacatcttccccttgagagaagttccaagccgattcttgaaaggttagcagttatctgccaggggaagcagcaagaaggaatacatgccattcaaatgactgttccagtatcttagttaaggttttactgctgtgaacagacaccatgaccaaagcaactcttataaggacatttaattggggctgtggttcagtggttcagtcccttatcatcaaggtgggaacatgacagcatccaggcaggcatggtacaggaggttctacatcttcatctgaaagctgggagcagagtaacagcttccaggcatcgaggatgagggtctgaaagcccacacccaccgtgacacacctactccaataaggccacacctactccaacagggccacaccttctactggtgccactccctgggccaagcatgcacaaaccaatgcacaggcatgctctatagacaagacagcaggggctgttcatcatgggaacagggtgatatgctggtagcagtgcagagaagaagatggaaaggagtgaatcaggcaaggaaagatatgaactcatcgagatggtctgtgaccatcaggggtttgaggtttacttttaaggtcagtgagggtgatagtgtgttttgctcaaatggcaggaacttgatgggagagaagtaagaacagagatggtgggcccacgtgaggctgtgtaaatgagtggctggagaaagtgccagtgagacaggagagaggaggaaatctggaagagcttgtcttgagtagaatcaataagagctggtaaccagtgataaatgggaagctaggtagaagaagggtagaaggtaagcaccctgtctaataggggtgaaaggtagtcacccaggtttctacaaagagaagctgtttgggtggtgtaccatttacaaagaaaagaaagactgagggtgatgcagtttgactggggaagtgacaggtccatttgtaataccaccgacctttctgcttgtcctatgtcttaggaacactgtactcgaggtacttggcagaagacttggcatgtcatgggtgcttgataaatggtgacacttactcttttttcatttataaaaatctatttcagcctcagttttggtaaattgcggtgttctctcattcagtgcgagctctttagagccacaagagttatggtcttgctcattgtaccacacgttttcatgtgtgtttctttctctccttctcttctgcatgctgcctggggattggcttccttgtggtcagcaccaatgggcagcgcccaggtgaccccggggactccactctgcctcctcaccacaggtgatcatcagagccctggcaagagggaggggactggtaatggcccgagctctgtgggttctccaggccagctgtaccagagctgaactgacagctccttcatcacatcttcccacccactacctgcccagtcaccgattcatccatctaaccaccattaccttctcgtacctattcatacatccctctattcatccactaccccatcttaccaaggtttaataaatacgtactatgtaccaggcattgttctaaatattgaggaacacaataacaagcaaaagagacaaattctgatatcttagctcaccgatcaaaagactctagaaataaatgtacaattttccctaatactaaggagagatgcatatgatattcaaaatgtacacacacacacttaacatatacatacacatatatatatacacactacataaacacaccacacacatatacatacacacaccacatatacacagacacaaagacacatacacatgcaccacacacacagacacatatacctacatatatacatatatatcccaaacacacagagagacacttatacacatacactatacatacacacatacacccacatatgcacacagaaaccacatacatacagaaatacacatacatagagacatgtacacatacacacacatgtacatacataccacacacatatctacacacacagagacacacatatatacacacacatacacacacannnnnnnnnnnnnnnnnnnntcacatatacatacacactactcaaacagtcacacacactaccacatatacacatgtacatacacatatacaccatacagacacgcaaacatgtacacacacaccctacacacatacattcacatacacacacatatacacatacaaacacacacaccacacagacacacacatacacaccacacacagatgcacacacatacatgcacacacatacacatacacacacacacacaccacaccacacaaaagccaattgagttgtggtctgtgggtgggagaaagctgaccaacagatctgttttctaaggaatgagtaggttggacccacaacctcagctctactgttggccctggtacatcctttaaatgtgactaggcccatatttcctttctgttaagaaagaataataatacttgtttcttagggaacattattggcattagggactctacagagtcagattcttctgagactgcattctaaactaaacaagataataaatgtcaaagaagctggaatagaagtgcccagcctagtgtaagtatttgcttggtgtaaatgagagcctttgtttcttcaaatgcagcataggtagagtttgttacaaataaatagacatagttattcaaaagatacagagtccacccaccagaagtcaatgcccattcaatacatggagaagaaaggtaacctgaaaccatgcctctctttcctccattagggatctccttctaaccaatggaagactttacaagggctttcacgcatttgcccaccattgttcacaactaaggttttgcctgttgagatcactgactggtcgctctatagtgatgggaaataactatatgggtcagtatagcaggcaaggatgacataagccctattccctttaccccttccctaactcaagcatcatactgaccctgtgatggagattcaggcacatactgttcattgcgagatgtgcttagacaaaaaggagaaatagacaggaaaagacaaaggacattgtgtagcccgagttagtcagagccctgcgacatctcaggaatgtgaattgttccacaggttgagcccatgtgctaattaccataggttgccatgggtgttacacagccttctacagaaatggattccttcttgaaagtaggaaatatctatgagccatttacagctagtatctacagtagctgggactaaatacatcaatcaaataaaggagatttggacagaaccccagtagcatccacgtgggcctgttttggtcccagttttgtattgctttaaagcaccacatttcagtgtgtccctggcaaccctgtgagcatctcatcttagccatcccttaattatagaaacattacatactgggcaggcttattttacctgggaaaccaagtatcatggttacttcatgctgtcctattaaagattcaagttaataacctcaacgaatgccctgaacattgggagtgcatagtaggtcttcacaaaatgccagttaccaccctcctctagaacaggcccaccagactcaccttccctcaagagaggcagaagtcatgaatggacacaggggagcatgcagaaagatgacaagagaaaagcgactctcaccgctgtccccaactggatttatggagaaacagaacctccctggagtgtgcacgagcaattccacctatgcttccattgttctctgggctctattcaagtcgagccgtgagattatgttttcttcaaacagagccaatcccatatcaggcacatttgtttttacctctcgccttctgaggcatctgaatgttccttctctgacaggtttattttattgtgctccatttatttctacccgtttcccagctttgcttgataggtgaggtgctgtgagattttttttttccccctcagagcaggctgtccctttcaatggcttttgttaatgtccattccctggtggcaataatagctgatgtaaataataactgcctgggtctgaatgatggggatattggactatatgttcagatggctgtttccatagcagctccagcatggagatacgcacagccatgtgaggtagcatgcatggctcaaccttaacaatggatggagcctgattacagctctcaactctgccactctccggtctggtggtctggggaagttactctttattaaacttcctctcctcacgtagagaggaatcacacccaatgccaggttaataaaaagaactgagctttgtgcttgagggtcactggccagctacttcttcaggtgtccctgaaccattagccttcttcttgaggaaatcctgctctataccaaggcttctgaccttggcatggttgacatctgaggctagatcattttctatggctgaggtccaaactgtccattgtaagatgtttagagaactcccattctttacccactagataccattagaatgtcaacgtcaattgtcacaaccaaatatatccaggcagtctcaaatgtcccctaagggacaaactaaccctctagaaatagcttttaaaagcttcagagcagcactgttcaataaaaataaaattttcggtggatataatttctaattttgaagtcccattatgaaaataaaagaaacttgaaattaacttgaataatataatttatttcattaaacatgcccaaataccatttaataagtaatcaatattttataaaaccattaaatggaagatagttcacattttcatttttgtactgtctgatatctgctattttttacacttaaagcatgtctcagttcagatgcaatgctttcaaacagttaaaaatgaaagaaatactaaagtgataaaaaaattatggatagaggagataacttagtcaataaagagcctgccatgcaagtataaggacttgaattggtgtccccgggatggagatgaaaagatgtttggaggagcacactcctataatcccagctctggggccagctagacttgctgaatctggaacttcaaattcaacaaaaaaccctgtctcaaaccattaaaattaaccacaactggggaacacaccagcatcaacctccatactcatatgcattaaacaaacccatataactgtacacttcacatacacacatacacacacacacacacacacacacagagagagagagagagagagagagagagagagagagagagagagagagagagagagagagagagagagaggaatttatgcagcaagtaaacattcttttcattgcctccatcttaattttttaaataattgaaataaaataatcttaaaattcagtttcctgaccctatttcaaatataggatggtacacacacacacatggcttagtgaatacaatttggacagtgcaaatagagaggtgaaatgtccctttatcatcttggcccctgcttagggaacataggagcaaatggacagagtctacgctctacaattactcccctcctttctgccacacccaaggggatgtctctccatgtccagcaatgaggtgaacgccttccagaccaagactggacagttttctctagaagcctgacctgaagcaacaaaggacaagtaacccctgaattaacacttcacctgcaagacttcaatctagtccagccctcgtctgaaagagcgcctcatccctttgcccttctctatctcagccaggcctctctgcctctagacctaatggaacatgggccgtgtccagccataggccagcatgaatgaattaaaggtgatccctgataacactttgctctggctgccttggccatgttcattgcctgttgttaatttttccacaagaaggactttagcccaagccttcttctgaagcccagaatgtatttgttaaaactggggaccttgataaaagcacccaaacttttatgcagtccagattcctcacttatgaagtcaagcagatgaattccagcctggctagagaaacgggtgtaatcctagccaagcttcaaggctgggagggtactggttagacctcttgtaggcttcatttggtttttttttgtttttttgtttttttctatgtatctcatgctaaggctattactattgttccttaattggggccttgctatgtgacaagattcaggttctaataatactcactgggaggctcagctgcattccttggaatgatatttcatgaacatcctaaacccagatacagagaactgcgggcttcagcacaagtctatgtgggcagaaagaggacaaggagacagatcagcaacctcccagagtcactgactagaccccacagccttgggagcccggaaggcatgacagctcccccatggagcttgtggctctggtggcagtaaacagatggtgtgagtgtagaggctagaagcagagctgggtgaagctgtaagctgaacactcaccactcttggtgaggtttggtggggagaggaggggcaggctctggggcaatctcagccttgaagacaggccacagagaagtagcagttttaggggcagatgatatcaaggaagtctgacagtgtgataagaagaagagtaaaatgaataatggatgtcccatgcttcctacatgttataggaaaatcctcagtgttttgcttttttagcacatgtaaaattccctaaatctctaccaagtcaagtgattttctgattttacagatcagacctctaaagtgtaggcagctggaaaaaaaaatcacagaatttggaaaggatggcaccagaattcaaacccaggtctctctaggccatcttcatgtttatttgtcacactgcctgcccatagccaactttagtaagtacctaggatgagccaagcactggaagatgccatagcagagtgacttaggactgtgccgcatgaaaagccacgtgatttcagagtggttgatctatttctttatcagcagaacagaaatgtcaacattgactgctgtaaagagagaaggaagatgatcattaccttaggcgcatcttggtgttattaaaacctaaacccattttatagataaagaaacagagacgcagaaagagccaggcaaagagtcaagctatccagtggccagacaacagctatcatctctgcaacaagtgaaaaaaaggaaggtcgatgctcaccatcagggcctcggactagaagcctctgaagagccaatcagaatctataaatccaggcacataatgaaactgttatctagcttaaatgctgggtccaatgttataccaagctcagcttctgtgacaacccagagcaagaggtgaggacaaagtgctaaggggatgtaatactaagatcccttcagtctcacacccctccattcagatgggttcttagttggtctcgggataaacctgggccatgcctgcagtttaaaggcagagatctcagtagcaggtcagggatggcagatacacaggacctcttatagctctgccctcaggccactcatgtgactacaggctgattctatatagaaagggttactgcagaacttgaaccagataactgtctgtatccatggtccattcaaagtatggcaagacacaaggccgttggcccatcattctggctgttattctctgttaccagcctctcaactgagtcagtatattttgtccagatgagtcaattcacattctgtaaagagttctacccagtagcacccaaatgcgtattctgccttccaaatggccgttagttggggaacctctgtggctgaggttttcatggctcccattttcactcctgggatatttattccctttaggccaagaagaagtcaagccaccatcttgaattcaaactgccaccaaactcagattcagaaacccagtgttatccgtctcctctctccttccccatctttgctatgtaatctgccatcacatctggctgattctgcctccaggatcactccctccttcttctctgcagtgctcatgtccgagactactgaagtcttactcattagtgctacagcttcctacttcgtagggctgtcttcacatttctcctcttccggtgtgtcctccccactgatgcccaagtgatcctttagatagaagcggtccttcaaatagaagagttttgtcctgattaacacctgccggaagcttccattgtgctgcaggatagccagcctgcttctgccgtcttcatccatccctccaggttcctcctttatgttatttatctgatcacatgagcacttgcctttctcacctcctgccttcctttgctgggatgtctcccttctgtggtctagcttgctaacatgaaggagctctgaaaaagcctactgtttcatgctgaagctacaggcaatagccagctgcctttagccaggaggaagggctctactgaacttggcactcacccatagcatcagcttgtcttgaatctgcttgggttttgtcaacctttcccccttcccagcaactatgcaggtggtttggtaagaggttaatactgttagagcatgcatgaggcacattgcactgtgtctgtcctcctgtctttccttcttcctctgtacagtgatgtcttagatagcatccctaatgtgtctttttccaattttgtgagggctattgtgagtggacactggttttccagcctactaggaactctacctggccccttctaccaaatgtgctgggcctgggcctgctgaaactaatgtctgccctggctttgcatggggctggcacagaaaaagtcagatatgaacaggatcatgagagagacatgatacgtcagcatgaccagcatactctactctcctcagcccaccatctctactaggagaggagttatagtcccacccaacctttgaggaaggtgatggatctatgttagtccgatatgaactgattcagtgtttccattcagaaaaaaaaaaaaaaaaaaagccacgatgtaaaggctagaaaaaaagcaaacacattcctggtagatttggctgcaatctcaacaatcgctgccctgctccttgctggtttattaccctcgcttgccttagttgagctaatctgaattccacgctgcatgttttccagctcctctctgatcctgcccacacttcctctaatccccaccatagatttctccctcccttccaggtaccttccctcttttcctggccccctgataacccactcaaaactgcatgttgtagaggcatgatttggactaagctgccccagctgggcagatctttgtctcctttcccgcattctgccccctctgagtcaggtaacacactcatcccttgagggatcaatttatctggagttgtttagaaaaaagctgaacttgtttttgaataagagcctcggggagcctcagtccccagtgctccctgctatgttattcagacagaaagccaggacatgtccttcccaaaggcctacgttcagttcagactttgtctgagcaagaaactctcttttctagcatgctgtctgtgggccatgacctcaggcattgtttaccctttgcttagtgaatttctaagatcctcatcctgtctttatcccttcctgggctgcttgtaacatcatgactcaactaagttgtatgtcaaattttgtctctcaacagatatgttgaagtggcaaccccgagtaactgtgaacataaatttattcataaagtccccacagatgtgattagttaaagcaaaataagaaagtgggccttaagccagtatgtcagaagagaagagcatcgtatgaagacacacacacacacacacacacacacacacacacacacacacacgcaggcaaagcagtatgacaaacactggcagaggctggaatagtgcatcttcaaggcacaaaatgccagaactgaagactagcaggagctgaggagagatgagctcttctggtttcagggacaggtggccttggtggcatgttcattttggacttttagtctctgcaaatgtcagaatccacatctgtcagtttaaaccactccaatggcagtcgttgttaacaaggccttgggaattcgaacgcttgccaacacagtgaacttgagcttgggggcggtagtctgtggctgaacctcaagtgtgatgcctttccagtggaaaggcctctcagaaaccacagtatcaatctctcagacagtctctgacctacatatctctcccacggtgtaccttcatttgtaatactatatatttcttctaaactagtctctcctccatggccttacctttctgatgtagctttgccttccatgtgttattagtcataagattcgctgttggccctcccctgcctcagcctttacagacaaggcttatgtcaccctctctctgtgtcctgagttagaagccctcggcaccatccctgcctggcttttgtattctgtcatatgctgcttctaggagggctttgcttgctgcacagttgcctgagcctgggctcacatttacagcaagaattataaccagctcaccagggccatgtggtctttcatagcagctgcctggaaaagtccaaagggactactgctttgctgtggggcatcctaaggagtatgtgttctctcctacctctgttcctcacactaaattcttagtccccagtgcaagctgtgggtatttctgttggtgacagccaagtggcttagccccctgacagcccccccccaccccccgagttccaggcttgatacacagatctctgcaagcaagaggcaattctgttggtgtagcgctagctcaaattctccatcttcatccgtggaaaaggccttgtaggatcagaggacaccagtgtggagataggtgagagggggctgttggatggtggcagggatgcctgccatgtgtgtcagaccactaacatgtggaaatcaagtacctagtctagttttacgtagtcagaactgtacatgcactctacctgggtatatctctgtgtgagcatcctgtgtgtgagaccttttcagtttacaagttccttttccaataagaagtaagctgcatgatggcaggatggtttctgcattaaccctcatcctcagcacctcagagtaactactaccattgctataactgcagcatctcccaggttaggccatatccagggaatgtccaggatcgcccctctggggcttagtgttgaattggtgctaatgagtgtaatgcatttgaaggtagtttaattgtcctggtgtaaattgtgtttctgatccaagtcaaagcccaactctagacctggtttgatccctctctatgaatatagactgccagagcctaaatgtaagccaaaggctaatgcctgacccctgctttagatttggccccacctcattacatcctggttgttaaccttgactatggtttgacccttctgagctcagtttacaaagtgcatcttcttcctaagtttggagacaacttttgtccccaactttagcttagcttacagtcttgttctgaaagcagataagtcttttctctaaatttgtccctgggccctggcagtgcacataggctagacctctccagtgcacaaaaaaacagttgaagtcaccaggagataaaaaggtagctcaagcccttgctctgtcttctaggggtatgtcaatcatgcctgtgtatagagtctgttgcatataactacttttgagtaagtcaggtgataaattttaatagatgaaaagtattttgtggtaaaggcagtttcttgtacccagaagggcatttctgtaagaacctcattgtgccatctcacagagccccttacaaccaagttagaatttgacctatacagaatattcattatgcaaaaccaagtccacctagaaacacagagtcaggagatccatgggatgaagcagaatcagcaccaggggaatgatttattcgagtggccaaagggctttcaaacaatcaattaaagtgattctcatctcacacggtgctaacctccatttaagatggaaaatgagggcacctctgtcagcaatatttagcagatttagttgtataggctatgatgaagtcacttctaacctcttaggactggctaggtaatgttgagggagtgtgggatattagaagtgtgtatcttctttacacttaactcaggacttattaaattactttctacagcaacagtagagcggtctgtgaaaaacccatgtctctgtggtgtcttccggctacttaacattgactccgagttaagtcttggctaaatgcaattactgttatatgatgaatcggggcaatttatttattacttgcaaaacatcctagatgatgtcacttgaaaggagcatgggaagatccttaagtcctccattatcaacccggtccacatcatgaggttatgttctgtgacgtgggggaagaagtcagcaattaaaataaaattagacagcaacctcaaagaaagggtgttggaaacaccacagaaagtgctcacctaaacttgaacagaacatgtctctctgtggaattaatatgaggcgctttggttgctaaatatcaagaaaggtcttggcaggaaagcccagagattaatattaaaactaaactcagagtattagggactttgaaatggcggttgatgtacaagggaagtgaaaagagtaaaagaagttaagttgaaaaggtcaagtttaaatatcacttgagcaaagcctgtataatttagctcatataacaagattcacatgacatgttcatcaatcccttagatattagaataaggtgtgctggctggagggcacacagagaggagcttccagcaaaggcaggtatgaaatggaattgcttggtagagcaggtggcagacccagcagggacagatataaatacccatggcaggtatttaggtaaagatggttttatccagctgattgagataggattcttgatctccttaatacgaggagtctccttctatctcctaggtatctgagggaaaacaaccagtcttgcgctgagcaacctcctcctcttccccccatttaggcgagaagcggcagaatagcacagcagtttaatgaggaggaatctggcttcagacttgcaggttttgtgggtactgctgccagcagctcttatctatccccgttgagcttcagcatctttgagaagactatggtagcagaacctgctccatactgtttcagtaaggattaaaagggggaattataggtaacaggcttaaaacatggttgtagttgaagctctgtcctacagcttatagttaagtatattagtgttttacatgtgctcttgaatcctgctcctctcgactcttccattgccatcttctgtgaagccccagcttagcatgtagctgccatacaagccaaccacaatctctccaccacagccctgacattgctgaaatcaaaatacaagatgggatgttctccagatacctctcaaaagctgcaaagagtagagtctgggatgtttataggaagcccatgttgcccctttgcccatctgatctgtccttctacgttgtcatgttctgctcggacacacagctagccctgcatgcctcctcacccaggccaccatgccagtgacttctgggtttatccaatagaagacctcagttagagttgaaagagtgaaaggcaaggataagccccctcagttagtttcagctcctcctttgtccatgtttgtgtctgccccatggctctaactcccccaaaggtctcctgcagttctagcccttgcaatgcaaacttgccctctggcctctggcttatctgctttgtatctctcctgtgtcagtggttagcagcatcctgataatcctctactcaccagggtcttctgatcctgagtgcttttgctccctttaaaaggcttaggattgtttcccttttcctggttggctgctgactgatgtagatagagcctgtactggtttctaagcatcacccctccccttttatgagtagtaagggctggggaacctgacttaatcatctggtctatattttttttctcgtatcaacatcacactcactagcaaaaaaagaaatatatctgaaatacacatctttttcattaaaaaaaaaaaagccagcaatagcatttgtttctccccaggcttctcgctcccctcctgttcactacaatttctaccctcaaaggctgccaaagtagttcatgatcacaattacaaatactttgaatgctttgggatgcaatttgtaaagtctagaggcttgaatctaatgaagtagccagatgctcccctacaaagttgtttcctatcttggacttcaattccatcttaaaataccctatcgtttagagaattcgcttccagccaactcaagcgaaatctatagcgcatacctgactttagcagagccgggaagttacccagcttccttatctgttccctgttgtctccacttggcaaaacatccataatcagagatgcctgctatgcataaaaccttctttggcatagaggtagcagctcagagtcagggtttcaaaggttttcgctgctgggtgccagatacacacaaagcccaagtaaagacagagaaactcttcaacaaaagaagtcattaagtagacaggggtaaactgccagcgcagtgagatttgcctgagataagccacactggggagaagatgcccttggatagctgagaggccactgtgtgttttaaagagcgcagcttttaggtactgtatccccaggagccagcctcctttctttaccgtcagcaaggatcacgagcatggcttatgcagccactgggatttactcggattttatcaattgcaattagacgttcttcatctgtgacttctatttttgctgcctacccttacagggaaaattctctgaagtacagctacgaaattgggcctgacgccagcgtgagtgctttgagagtgaatcattaatcccttgttgccaaattatgttattgctgccattaagtcatccagatgtatgcctggtaagggccctccctatatgagcagagtcaagtgtatcactccagggatggggactctgcttggctggattctaaggacttggataaagccaggtagctgactccaaggctagcgactccagtctctggttcccaaagcttacagacattctgaaactagttctcaaattgtaacatcaggacaccgaatggatgtggtcaagcaatttcacctcaggactatacctgatcctgagaaaaatctttgtgactttgacattttctctcagtttttacaaatgaggatattatattacattgtgtttcattgatttggccaaggtcacccaactagttaacagttacatgtaaatagaaagtcgaggatttctgtttgaggctcattgctttgacccagtatcataaaaccagagcattttaacatcaaatgaggcacaaaggtcatgtagtcccctctacttgataatgtgtacaacatgtccctggaaagcaccttctactgttggtgacatgctttctgccctgttggtaacttgagaagaggcaggacagggaggagaatagagtgaatagaagttccagaactaaaagaagggcacacatcaccaagattatggataccactgaggttaaggtacacccaaattaagatggggaagccatcgtaaaagggtggtcagggtctaaggagaatgctgggttttaacatgagagggctttgttaaacatctaggctttgaggaagtcagaacaggtaggaaagtaggagccagtaaacaaggaaaagtctacctcttcggtggcacttgggaatgatgatcgttttcatacagtcactgcttcatgatggagtactgcccttgtttggtaaggaatccctggttaaaatctgaatgagagaagcagagtgttaggctccagtggatagttcttggggctccctgatcgattcagtcacttccctgcttttgacctcttgaattaaagagaccaagcagggggttctatcttctacaatggcctgttagtgaccagacagcaagaactggatctcctcagaatagaatctctagacagaagagttcttattctgactaatttccaggtcggtgtaatgtgtattttgccatgcacttaatgcacacaggggctctgttacaatggagctgctgtttccacaggcctagggtagattctgtaagtctggacttttaataagctcccaggtgatgcttggtatcctgattgttgaatcactttcgaagtatcaagtctcttggttcatcttctccctagagagctctctcctgtggttgaatgtacagctagacaaaattcgccagtgagttcagaagagtacagagtagcatagaccagctcttcccttgccaacaaaggtcatagaaatccctggggaagatcagaatgtgatagatgcttggtaacattgtgagagagagacaaacatggcccctggactcacatagggaggtcaaatggagggtggggagtagtttccaagatgctaagcactgtatctgatgtttccagagacaagaacagacagaaaacagaaggtcatgtgtggattgggcactaaagctaggaggggctaagactcgaagtcatcatagctttgaggaaagagtagagggaaaaaatgagcgactgctgctttgagaaaactaatgtagcctttgagagtactcggggcacagaggtagcagctggctagggtacaaggtcagtcctgtagcctcgtgttggagacagctgaattagtaagctgagttcacaagattgtttatgatgaccacatcacacaggggactcaaggagagccttaaagcttatctaattggataaattgccacctggtgccttgatgccaattctcattcacttggattgtgttcctgctgggtcttgtggaagccaaggatgaagaagatgcatccaaatcccttgcattcctcccagtgccagactaaaaggcagaagtcatcagagtcagagactgagtctattagggactgaaactgatgctaagcaattctctgcaggatttccagttctgccccctttgaatctcccctttggatttctgggccactcagtcacatagatagcctttgatttaccagcctcagtagtggcacctgtaaattgatggttatcttgcttggtggctgtgtgagaagctagcccagatgtgcttccccgtaactctgatctcagttctcatcctgatcgccaatcatctacagtgtcagccccaagcatgtaactctgacccaacagaagtgtcattggcacttctcatgtcccatccttcggttcttcctcttgaatctccatggatcttatcttttgtccagaatcactctctgcatgtctatcacctttgaattaccaaccccatccctttataaataagaaagcaaatccttagttactaccgcaaaatctcttagagaatgcttaagagaaagttgaattttctgcaggtacatgttgtatatgaagcccgaatggagcagaaaagcccagttgctcctaatagcctcaagatgcagtctgggctttcagctctgaggccttttggttaaactcactgaacatttctaataccaggctctcgcttttcacatgactacctggaatctggatgctcttctgtggtcctcaagcgtgtaccactagttagtcatggccaccactgaaggggcttctataacaacatcttggtcttgtaggggaggtttcctagtactttaactaagaccttcatttaccttggagcatagtacctgaccccaatagtggttggcacagctgatcattttctgcttctggaaatcctatcttatattggatctaggactctatggccagccatgttttctttccctttctggattttcatgttttatatacaagtttgtctgtctctacctactccctggactctaccaagcttcaagtttctcttccaggcctgcttctctttttacttgttttcccttcctgggtaatctcatgaactctcaggctccaagtaccatctgtggataataacaaattaatccttttacctacagctccgactttccctctggagctccagactcacacctctaaccacctacattcaattccaaagtactccaaactcaagcatagattcactctaaagtttttcttttgtgtactgcttctagaacccattaatccaactctcatcttccacgtcatacaaaccaaagctctgtgaccactcttgtcatttttccactgctgtttcctgagtctttgtgactatcatcttccatctggatgcctatagtagtctccaagctcatttctccaagccactttggctccccattgaagctgggataatatgctgggacataaatgtgaacacattgttaccctataaacagaatttaaatgtctctctgtgtttcttgggctacagaacaaaacttgtagcctacagtgtcatgtgtaaacattcctgctcctctctctagcctctttcttagccttttctctttattcttttttaacctcttaaatactacatttctgccatacaccagaccccttgccactcacacagcctgacccaggatcttggctttattacctctttatgcttcagttgtctagctacagccctgctggtccttcctcccaggagcgacttacttccctgttctgttctttctgggcggtcatgcacctctctgtccaaacccttaacaaagctgaaagtttgtcattactaacttcttgtcctcattgttaaatgccagtgattgcaaactacatgaagacaatactgtgtctcttttgctcaccatgacatctccagatgcctaccactaatggaagtttgcaagtacttacctaaggaatggggtgtgagtcttgatagaccaagtgatgacagggatcatatacaggaagaggctctcagggaatctctgccttgagctactatcctctagaacaggaccttaaaacagacactaagtaaagtttaactacaccatgaattcaatgatttagagccaacctttcctctaaatccgaatataaagattcttagtattggggagctttgaatttggggtgtctctttcctttgggcataatacattatagcctagctttttattagaaatcatatcttaagtctcataaatgggggctacttaggagtcactcagaattacccccactctgtaatgtcagactgccctggctaacgatgtgctggtgattccaacatgaactgggaaatcactggactgcaaaacaccagaaccttctcagacagccctggggttagatgagttggtgttgcctttatcttgtagaaaaaaatgaataaatatatcaccattagctacttgtagaagaaggatttttgcccctacagttagctacttgtagaagaaggatttttgcccctacagttagctacttggagaaggatttttgctaattgtaggagaaggaggctttagtttggccccagcacttggacacacaggagctaaatatgcatgactgcatgaataaataaatagttctggcctgtgcccttctgtcatacacagtcatcacagtgactgtgagaggagtcctttgctagataatggcattgcagcaatgtaaaggacaccacacctactctcaaaggcctcccattcccaccaaagacactctgctatgtaaaccaacttaccaaagttaactaaagtttgaggaaagtgcctggagagaatatatgctctatactcagaagcaaaaaacagaagagttatcagtgagctggaggcctgctttttaaacagccatgagtgtgagatttaaaatgtgagaagcaacgtttcaactcaatgcttagctgagttctatggaaacatgactaaaagcaagagaaaactcaatttggttccatgaggacaaatgtgtgtgggcagagacattatccctttagccaaacaccaaacaaccacaaacatttagcgagcccctattatgagtcaggatccgtgctaacatggagaacaaagataaatgaggtataattctacccccgaggagcttgcagaccagtggaaaagacagatgtaaaaacaggcaactaataatatcagtacattgtgctaagagatatcgtgaggtgtgtgcaaagtgttataaagtgttatcaggatttggaggagagaggaaactctgccagaggcgcaggaggctgcagaaggtatattggctgatgaaggatgaactggtgctgatgttgcagaaaagtagagatgagtttgggaaaaggtgcttccgacttcaagctgcctcacaaaaaaatgtgattctaatggggaaataaagacagcaggagaaaattgccctaggatgctggtaacccatggaccactctacagaatgtctgaaacaggaaattgccctccatccttagtaaacacaagaaaaggctgggctcagcctttctttgcttgcttacttttgctatggagaaacagttggttttttgtttgtttgtttgttttgttttgttttttagaagagaggggttgagaaactagggattttaggagctgaattcaaggtctctgatcactgaggcctaaatgtgttctattcaaaccccagggatctaactcttaatatcatcacccatgcgacttctggcaagtcctttagtttttttcttagtgtctgcctttggaactgcttgtgaggactgggcaagttagagtcctgaatcatccatcctggcttacagatactgtaagtggacagttcccactttccactaccagagattgagtcaacaagttagcacgtagtatttcataattgccaaaattgaaattcatgttttctgaacccaagccaattcactttaatccaccatttttttcctctactatttgctaaaagaataaaacaagatgatcccttggaacagaatggtttttaattgtgttatcttagcataaaactatgattttcattacatgatctgaaacatgaacccaagaattaaatggtggactaaggtttgagctctcatggcagagctgcacaatgaataaaatcttatgctcccacacagcaggtatggaccctgggaaactctaattgcatagcacgtcagtttcttctctaagaggacatcataataatcccaaacttttaggggattaacttgcaatgtggattaaatagagcaatatatctgaagctctctgaagctctcagcacagtgcctggcacatggttagctttaataaatagacactgttgtcactgtcactgttgcctgatcacatgtgagccttttcaacatcttccttccctttccctcccccccccccgcaaggtgcttccactcagaattctaacactgtggagccggagaagcaggtcgacaacacggtgaagatggctggcgtgattgctggcctcctcatgttcatcatcattctcctgggggtgatgctgaccatcaaaaggaggtgagtctcaacactgccgagaagatcctgctgaccccagaagacccagcaccaccatgtggccaggctgttgctctatcagttatgtccagtagcgctttgctgatagaaccctggacttctctgtgctagtgtttaagagagatgtgttgcctccttggcaagggggctttgagaagagcagcttctaagatggtcagggattcttatggttccctggttgtgctgcggagtctggttatgatgaaataagtcttcttggaattaactactctgtgtgactggtgatgccctcgagatgtttggggaactccaggagcacagatgaacacaaggacgtaatgctctacctttctcacctgcatttccctctatccaccagtggagagcagcctcctgcgctgccttcaacatctgcgaaggagtgagactccagagacttccctacttattcatactccatgtctcacccgactgtctcaactcagtgttactgcttagtattctctttccttgggatttttttcttagactcctatgggcaactaatacagtttttcatatgttgtatttatatttattttaaatcacattgttaataagagcacaagtaccaatacttcctttattcccaagattcaaactcccacactcatcttctgcttaaaattcagtcacaggattgaagacaatacacaggaattgaggagagagattaaaaaaaaaaaaaaggaaaccatgagtgtgagttagcataatgattagggatgattgtatattcctcaaaactgggtctcctgagcaaagtctctctttagcctttacctgtaactctattggcacacttacttcccatatatatatatctgtcttcttggtttcgcttttagactcccatcacagcctccatcttcccactttgcagccaaagctaagaagccatcatccatgttatagtaacagctgttggagtcccaactttctacaacaaatgtagtgattttcatgtctctaattataccctgagaccagagctctgggtttggttagctatggagttgaggaccagatcacactaatgagtaggaccagggaatttctatcatcttcaagttgcaagacacttttgaaacttgttctcaagaggaaaaaaaatgcccccaaagacaaatccacactctactcaaggagtcacaggagtaccaatgaaaataaaaattgaaagccaatgtcctcattcccagctgatgatgcaacaatgctggcactggcatctcagctatgtagccatgagtacatctttccccctctctctctctcttttttcaagctttgattcagccagtcttctttctcaccagggtatcttcttgttagcacttggccttttgttaatataatttgtctaaaaccatcatttcttttctaaagtaaccagtggaatagcttaagagttaggattctcaaccagctatcgattttcccactgaaaaaaaaatctcgagtggaaggaaggtgctatgttatcactggggataaagagactccagagggttcacttcactgttatctcatcatcactgataaaacgtggccatgctgtatgtcccagccactaatcaatcagctgccattatctgaggtggcgcatatgctttgagttctctgggagtggtaagcatattgcacatataagatcactgacaggtttcttagccttgctggtgtgttagaggcagaggtgaatctgggattgtctacatgggagaagtggccaatttaatggagttgaatatctttgatagacctgaaattttctgattctttgccactgatttgtaagtcagataggaacttccaattttgctctttctaaagcctggcttaacctacgtcaccatcgactgtgagcttgtggggaaaaaaaaaaagcttcacttccttctcagcagctatttttgaaatgtgtgattttttctgggagggaggaaagaagtggttttctgtttctcgggtgagagcacatataaagcgagtcttccgtgtagatttaacctcttccgggtatctttatcgccccacatgtctagaaaactgtcagacacaaccaacaggtatcacgtgatcactatttcacacccttcccccgagcaaatttcagaccctatagcaatgcacagcttggggctgctgatctgtacttacatatgttacatatatggacatgtttctgctggtagaaaagaatatttcagagatgggtgaagtggggtggggttggggtaaagaagagtagaggagatttaggggcaagaggagagaaaggaagggaggaaaggtaaggcaggaaagggaaataaagaagttgagcttgggtttgcttctttctactaacctacagtgtttcccaatgactagagatgcctggaggacaaggaaggccccagtgaactcagtccttctgtgggattctgctgactccagcccaatgcatcactatgggaacattagccaatttagtacactactggcctgctgctagccaaaatgctacctgtagcacactgaaagagggacattttaaggaacaggaaccctggaataataagcaaatcactccaactcaggagtcccactaccacctccagtctctaagtcctgaattgattctaccataggtctttcaaggctatagccacagctgtgttttcataaacacagttgtccctagattctccctttcaggggttcactaccactggaaggcttacttgccactctcctctctgtctccttgctaggaagttcctggataacagaactagccagcgaatgtatttaaagtgcaaaggatataaagggggacttagtgaagaaattaatttacatttgtataacttaagaaaggaagcaaaataggaaggaaaaagccaataaaacgtgacaaatgttttatgatcttaccttggccttgttttatcctggagagagggttctttggagctaaaagtcaaatactgttgtcaatgggaggcttaagtaagttcttttatggtttccaaaaggctcaagttaaagtttcaaattatttttgaatcactcttggctgatcttctttgattgtggtgcattataatatgctaatataataataagcatatgtaatctgggcattatgaaaagaggaccctaagcccttctgacacaattgatttccaatgtggttttggctatgctcgctgaaaactacccaccctttattctatcattagtgaattattctcttttgcttccggatctaccagactgttccagaagggatgatctaagacagacaccatgctattacatagtaacacataccactttctttctctttcttttttccccctgagctcctgatgatgagaagtcctcattgctaacacctctatgcagtccagagttcatcctacactttactttctccctttagagtccttagactgtctcctccaaagaagagcaagcaagagattgcgaggctgcctaggttgttccttacctaataccatagagcactggatattctttatgcaaactaagatacaaagctcaagtcattagccattcccataaagaacctctacaaattagtgtttgttgggtagtaacatttcatgcacaagtttaatgaaggtcagagtcaagctgctttgggattttcttcctggaacctgagcatggaatctgttgtagtttcctttatgttgttgtgattaaaataacaaaacaaaaacaaaacaaaacacagtctaaccaatgcaacttaagaaaaagaaagctttatatcagtctacagattacagtttatcattgagggtagtcagggcagaaactcaagcagattcttgaaggcatgcttacttacaacaacaacaacaacaaaaaccccacagaaacaaaaatcaaaatcagcaaaccaaaacagtaagataaaacatgccaaaactaagccaaaactcaccaaaaaaaaaaagaaaacaaaagcaaatacatggagtttgttttgtgttatgtccaagtcttacaggaactattcagaccttgttctttatacctacgtacggaattagaatgctttacaccaacaggaatattcaccttacactgtagcaaatttattccaaaactatcatcaatgtgctaacagcaatgctgcaaatgacattcacacactgacctaatttcttcattccacttaaactgcagagtgttgggattgtcactgtcacccttctaatgatcgtgtctcatagaactgatggcacttctattttgctcgtgttttgttcttaaaactggaaactgaagctcaaaggggttatatgagttggccaaggtgctgggatatgtttagaaataaatccagactgtgattccggagcccaagatgctaattttcaccagtcctgaatgaccaatagaaagcaagtgaatcatagagcaggaaacaggagctttggttcaaatatcactttccctctcttaattttgctatactcaggctttggagatatgattctcccaatgacatatttctttacctacaagagtcttattagtgtcaaatgttgacccctacccctaagttcttctaaatatcactaccaagtatgatggcctaggaatgtcttcccacattcctaccccattgacaatcccattgtcttcctagtgacagacaatccattgcatgcagcccattccccatattgccggctcaagtcttcttctgggtgtttatcacataacctggtgctgaagaaagaagtagcccatgagaaaacctaaatataagcaaaagagtgagataaactggactagttaagagagcctgggcatgttattgagtaagtttgtgtgtgtgtgtgtgtgtgtgtgtgtgtgtgtgtgtgtgtgtgcatgtgcgtgcgcactcatgtgctgtatgtcatacaactgaaacagaaagtgttaggaaattacccaaagtcacatgactatgtgacagtaatgtgtctcaaactgagtacatctgatatttaagttcatacatactcttttcaaactcttaaataatattatctaccctagattaaattgggatgcaaaattgtgtgccataattttgaaagggtcattgaggtgagaaacaaacaaaaccaacgaatgaaatctgtcatcttggacctaccctgtgctgaacagctgcttctcatatactcagcgaacaactctcccatccccctttctatttgtgcttataccaagtctgggtgcttgaaagcctgtttccatttgcacacacttagacacctatgactgtgtatcttaagcttctttcacatttcccttatttcccatcccatgattattgtgaagaacgtgccccacatctcatcttgactcttgttttatctttagagaccactgtcccttttccctccaactttctcttcacacgacccttatgatcattcatctagaacaaatctctctccagatgactttttggctttgcctttaggacagagacaatgttccttttcatatcgtgacatttgtactttactagtcacccacttaggccagaaaacaattccatatacctgaaaataaccactcacaagcctggcttctctgtgactttatcattcaaacatggaaaaaaaatgtagcccaatggtttgtgacattggctcttgaactaagatggccaggactctaacacctgccacactacttgccagttatgtaaatctgggaaagttgattctttgaacctcactttccttgtctgtaacataaggataacaatgtttcatagggctatggtaaggatcaaagaagtagtccacatgatttacttacaatagtatctggtacataagtaatactctactgtttaagtagtagcttttttttattacatttaactttcatttttcattccttgagaatttcacacaatgtatttgatgacattcacccttccctccactgttcacacatccaacataccttccctacccacacaactttatatcccctttaaaaaacaaacacatcaagtaaggttgatgctcctcagatacccttgcatacgtggtcttctactggaacaggttagcccatcagggactatatacccttaaagaaaacaaaactgattttcctcccagcatccatcaacttacaacatctcctcatagagggcttggactttgtgcccactcctccctctatgctgagattatatctggcttgagctgtcatgggtcttgtacatgctatatcatctgctgagcatttatgcatgcaactgccctgctgtgtcctctgtttctatcaagtcatctacctcctttgggtcttacaatccctctgccacctcttctgtgatggtcttacactaatatctgatacataagtgattgcattgtattaaagtgctatctattattattgcctcctctataatttttcttgcctggctttcatattagaccaggtgggctggattagaatatcatttgtctatttaaagtacttggcagagacgggtatattagtagactcccaggaaatttttttaattaataatgaaatgatgtttgaatagataatgaatgtgctgttggatggatgacgggtgaagtgagtggattaaatagatgaatgggtgggtctatgccctgaatggatagatagagggatgaattgttaagtggatggatggatggatggatggatggatggatggacagacagacagataagtttatgggccagatagatgagtagatggccatatgtgtggttatatagacaagtcagcactgttaaaatgatataaaacaaagagaaacccgaagccagttttgtcagctagctaaaaaggtgattctgcagtatttgatttattaaatttggggatattgtgtttttccttttctttcctaagcacagctgtctttgtgttcaagagttttggtttcaggcaatctgttatctgcagtatcagtgtatccttgtaaattcagaccttcagtaaatcttcttcaaggtttagagaatgcacacatgtaaactgtgttatggtcacagagtaaatgcctgtaactttgcaacttgattgagaaatgattgcccgttattagaagaccacagaccactaccattctagaagtttctttgacaacggttcaaagacagcactagttttggtgacctccacgataactcaggagaaggtttctggaacaggccatctatgtttgaatgggaagaaacatgttgttaggatgaggtggccccaaagaagttaaccttgaatgttgagagcagaaaatagagaggaccagaatattgaacacagtctgctccctaaaagggagtggctgcagatttggaagaaacccaaattccagtatctccacagatggagagtctgtgaggggtgccttcttaaatccttgggctcctcaattaaaattaatagtaactttgtctgcttttgtaaggaagattcaaatagatgaggcatgggacgttgtcaaggttggtctactcttggtgccccattttcttatgccctcaagcagtgtaagctacatggtggttaagaacatgacctttggaaagatgatgtcatcaaatttgcatactggttgcatcatcttcaccacatttgcctttgtttcttcttctgtaatgtgaaggtgataggatccttctcttcagacatttgtaaggaatatacaagttaatctgtggtaaggtcatagaatagtgctggtacctagtaaattttatattttaagtaatatagttatatatattgtgttagtattatgtatatatgtgtatatatatatatataattgataactatttttactgccttcattatcttggtgatgaaagaaagaggcaacaaattttatatctgtagatttttcatctatgcttagcctattccaaatatagattagtattaactaatattaatttagcataatttctgaaaaagactatatactctgttttatattatttgaatataatccaaatagagaaatctgatgtgaatgaccacatacccatgattactcttaggagtaagcagtcactgcttccaatgtttgagttgaagaaattggaacaagggcctacataattacttgctccaggctactccgctgtaaatggtagtaccaacatgttgcagcttcttgtatttccatgacccaaaagctatttgacgtgtctgtcatctgtggcaacgacttagtacaaggatcaggaaacaggttgagaggaggagtctgcttgtctaaaatgtcacagtaagctgaaattgcaacattagcctctcgcttctcaagttgcttgatatatgtagaagaattaatctattttattattgtagcaaaaggcctgagatggggtaagttataaagaaaacaaacctattcctcatgcttctgggtagatccaacagcaggctgtcagcatctgttcttcttctgcaaagggccatcttgctgcagcagcacatggttggaacgtaccatcctgtaaacagactagctatgtattcctcttctttcaaagccactagttctgatatgcccctgaccctgatgtttccatctctgtctccacctctgtctccatcaacttcagcaggtctctgattgcatcagcacatgagttgggggggcagggctcaagttacactaccagcttccaaggagacattcaagtcatagcaagagataaccggatcccgagctgcctgcttctaaagaatagcatttcctggcactgcatcagctattggtgaagcagaagaatgaccagtgccaaccatagctagtgaatggggatttgatgactcatccagtttccatccatcacagaccttggtctttccatttcattctcgagggccattattcatttggttgaggattctgaaaaacttggactggggttggaggaagcagggagcatcactggatcttgatctgctttgattcattttccctacctcagcatactgagaaagcttgattctttatgttttcttaccattcacttttcttctggacttttagggttattggttggggctttgctagccctgccttgggggcttttgctacttctgacttgaaaggtagaaatcctgagctctgaatgtgtgtggctaacacatctctgtggctataaagactgaatcttcccttgacaagcaaatgggataataattgcaattaggaaataattcaagaggggagggcactcttcttgcttactcgggaggatatttgggaacctgaatttcctagcagttttttcatagtcctcaaatgcatcacaatgtagataaagctgatatgaaataaaacacatccctatttatttttcttacagcgtaagataaattacaacaaagggaatttagtggacatacataaaagtttgtgattctttagaagccaagaactagtgaggacattagggaaagcctgaaggcagccatttttcaagcttccattcaggagcctgaattcttagccatgtgaaatgctacataaataaaatagatactaatatcaattctctggctttggtgactagtagggggccaacagacccacttttaggatatcttccctatggcctctctgaagaattcctggaatcttggaatacagttggaaaaatcattggcagtagatagaacatagagtcacaaactttattcaagttaggagctgttgacactcggggctagaatgcttctttctcagtacattgcttcttcatgatgttaaactttgccatggtcctactatgtaacaaccttgaaagtctaatgatgtaaaaaattattttttattttgcccggggattcactctggatgggacataaagaaaatgacatatttctgttctgtgacactcatggtctcagctgagataacttgtttgaattctagcttgggctggaaagactggaaagtacctggtcattcctttctctttgtgtaatcccagagcttctccatgtgttctcttcagcatggcagcattggcaaagttgaatttcttacatggaaattctggcatccaatagaggggtccagaaaaaagaaactacaaaacatctttaaaaataatagcaaaaaacaaataaacagaacacctagcttggaaatcccagactactatcttactacattctgtttgtcacctaggtcatccatgactcattatttggggtagatactacacatgagcctgggaaatgtaaatggcaggagagctatccaggatgctgcccagatatttccctgctttttctgtgacctcctctagaatagatttggaggcaatctttcctgatgaaaggcgctactgcgtctgtgtcgttgcttggatcccaggaatactgcaatgtggaagattggtaacctatttctaggcttccatgcaaagcttatctaagacattcaaaaaatccataattataatgaagtttgtttgatctgtctgtaaggaagaactttaaaacagtacaaacagccagcaccaaacgtggcttcctctgcgtgagatgatgagtctctctgtcagaggtgaaggtttgctcgcttcttccatcactaatagcagctgacgtttaagaacatgcatctccttgaggtcagggttactaatatgatgtgcatatctaagaatcacgatttcatataaatctaattcttctttgtttgtcttttctttttcccccttttggacatttccttcatctgactgcccatcaatctatagaagaaatgcttattcgtactcctattacttgtaagtatcgagccggtgttaactttgtgccccagaagggagcctgtagcatgcacttcctcctgcaccaaccgattggttgtctgttggtttctcatatccacctctgtctagtcttctgtagtctggaaggttttttattttgtatggatgcctttctgtttgaaaaatgcgctgtcattgttcctgtctattctgtttctgtcatcctgatttttccctcgcacctttgaaggtgtgaggggttggttctcctttgtgagtgtcagtttctaactagcagcacctcagttccagcaggaggggaaggtaagacagaatcacagatctcgggaacttctgggtccctttgtgcctcttcagggaagaagtagtcttggggacttaagggataaaaaggagtccattggctctttctgatgtaccaggaagactacagggagtcctgactattccaacctagcatcaaggatgacagaaacatccaaggtcttggctttcagctgaaattccctgtttggcttttaacattaattatatcactttatccatacattttgttcacagctaatgatggctgctgacttatcaactttttacaactcactaaataaaagtgattttgacatcaaatcagagcttttcaaaacacaagggtaaaggagaagaaactttaaataatagatccgtcctgaggaacatttggaaaaccactgaaatactcccatattcccaacgtgtgtctctggacttggaacatgagaaatataaaatagagaaatttgaaaacccatcacatattcagctagcataaggataggaccagagctcagaatgacaggttcttagtcaacagtattgccctccattttagatcttcccttatccttggcaaacacagccttgtgagaaagcctggcctcacagtagcctctgctgaaacctccccaggtagagatgaagacagagagtggcttcctgatccatcctgctcagttggtgtcaagctgtgaacagagaaaatgataccaccaccatcattcacatagggaccaatgccctccaccactactgccaaaggtcctagaagctatgccttacctgttcacttagcaaacacaccttgagcattgagtacacacactgtattccagttagggagaatgcagaaataaggaccttcaatatcaccgtatggtgttcttgcctgtctaagagatcagcgggagcaaataataaaataccatgtagcagtttccatttatcactactcaaatcaatcctggcagtggtggctgcacacattcctcactacccaccccagtgttcttggttctcaaatgaaacacacacacacacacacacagcctttatattctaatatgcttttagcagctcaatggccaggctactttctaacctccacatggctaatgtactcccctctgatattcctgagttattacttactaaaatctatattccatctttgttgccctagatccagtggaggggggctgggactgctcttcgctggctcttacatatcggctatctctgttctgtacctcaggcataatgtctcctctccttccccggcatggtggccaactctcttcctgctccttcctcagtcccttgcccagaaatccaaaagtcctgcccctgtctttgcccagccattggccaccggcaactttatttgccaatcaaaactaactggagcagggtacctcagtgtcttatgtgcaggtgtgcagattctcgtgcaattttggggaccaaatttatataatataagcaacgttaaaccaaatccacaacaataccagttaaaaaatgatgtatagtatagggacaccaaattaagtataagcttattaatgtggatggatacacttaccagtggatttaaaggtagatgtatccaatgctggagaaaaatgaccattttgattggtctgaatggcattttcaaagctgtggacatacaatacaatgcatctgttctgatggaatgagtaggaggtttaggatttgtgtagttttatactcatgtcttaccttggcaatgttcctagactccaagtctcatttttctggtactaaagggaaatttcacttaattcacaaacttgccttcaagagagaatgagatgatttggtaaagtatttctgctcatgaaatattaggttttttcctactcctttttagaaagaggataggtttgtgacagtaatgatggcccctgggaggtccgctgatcttacaagggttcttatgcaatccatagtgggtatggacacatactaactagcacaaattctgtgtatatccttaatctctgggttagctggtctacattacatatctagacatggattctctgttctttgctgtgccggtacctgtgaatcaaagatgaacagttagaagtattagaggcaggtattcaaatacttgtagctcaagtgtgacaatgaataacagactttcaattggtatgaacatggggttctgtgtgatatgttttagaacatgaaacccaacaagacctaggacatgaaactcaggcatgttctgggaagcatatgcatgtgcatgggacatgatggttctctgataatatttatacatttatattcatcaatcccaaagcacctgttgtgtgtcactgtaaagaagtctctgcagtattttgccttccaaagagaagctgtaggtagttcggtttttcctagggcatcatctttccatacctaacctccagaaaatacttgctagcattgaagtatttgagcaccaaagaacctgaatggataagggacacctaatcttcctgagtaggagaaaccactagtatataacaagtatctgtgcataattagtttactaagtccccatcaaagtacagttttgtaggcaagcctttctttcttttttttttccattttttattaggtatttagctcatttacatttccaatgctataccaaaagtcccccatacccacccacccccactcccctgcccacccactccccctttttggccctggtgttcccctgtactggggcatataaagtttgcaagtccaatgggcctctcttcccagtgatggccgactaaccatcttttgatatatatgcagctagagtcaagagctccggggtactggttagttcataatgttgttccacctatagggttgcagatccctttagctccttggctactttcactagctcctccattgggagccctgtgatccatccattagctgactgtgagcatccacttctgtgtttgctaggccccggcatagtctcacaagagacagctacatctgggtcctttcaataaaatcttgctagtgtatgcaatggtgtcaacgtttggatgctgattatggggtggatccctggatatggcagtctctacatggtccatcctttcatctcagctccaaacgttgtctctgtaactccttccatgggtgttttgttcccaattctaaggaggggcatagtgtccacacttcagtcttcattcttcttgagtttcatgtgtttagcaaattgtattttatatcttgggtatcctaggtttggggctaatatccacttatcagtgagtacatattgtgtgagttcctttgtgaatgtgttacctcactcaggatgatgccctccaggtccatccatttggctaggaatttcataaattgattctttttaatagctgagtagtactccattgtataaatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccaccagactgatttccagagtggttgtacaagcttgcaatcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgtttctctgccatacgggcaagcctttctaacatcacgcagcaatgaaaggggtggagaatagattgagttggaaagagaagcatccatggaaggaaaaaatggctgggacaaaagaagataaatatgaccatagatatgttaatttgaggaagctggtagaattcccaagtaaaaatgcccaggcaaccttgagaatacagaagtagaatgtagacaggaagaagatatttgtaaccttactctgagggtgacaggggagaatatggggtgggacaattaaaactcaagaaagaatagaagcaaacagagtgaagggccaaggctcctgaactgagcatccttcacaatccacaggcaggagttagaaggtgaatgcaggatgataaagcaaatagatgatagaagggaagagatgtcactacagaaggagaggtaaaaagccataaaaaatggtacagaggacagaggtggaaggtgaggggacagtcagtgcattccaatacgaaaaatcacttgtatgtgttatgcactaaatggtgggcatgagagaggctgaagatgttggacatccggaaactatggaaagggaggtctggaggcaagctgtttggagacaaagaccagcctagaagatagaaagatgagtctggatcattggactaaaaaagacaaggcggaagaaaaaggacagaagggaaatgggtcagcaagatggctcaccaggagaaagtattcactcgtaagtctgagaactcaagatggttccccagaacccacagtagaaggagaaagcccactcctgaggttgtactctgacatctatatgcatgccaaagtatacatatatgtctgtactcacacacacataaataaataaataaataaataaataaataaaataaaaattaataaataataaaaataaaatcagaaaaggctggaagacagactgacagtgatggtctccacattccctcctctaagtgctggaatagatcctcagtggaagctttgaacccccatttttcaggacataaaccagcaacttcagcaacaggaggaacttgtggcaaatgcagccacaatctagaacccaagtaatgtcctgaattggaacctgaactatggcaactccctttgctgaattgagttcatattacactttaagaagcaataaggaagccagaagcccagttgtcccatttataacaaaagaaaaaagataatattcagcgcctaggaatctagaatacattctctctaaaatcccccaaatggtgtgtgtgtgtgtatatatatatatatatcacctctgttgtggtttacctaaacaatctttactgtgaaaccaatgctaattcactcaaaaaaaataatgaagagcctactatatgctggactcctgccaaggttttaggaatttaggaataagtaccaaaaagaaaaagaaaaagaaaaagaaaaagaaagagaaagagaaagagaaagagaaagagaaagagaaagagaaagagaaagagaaagagaaagagaaaaagaaaaagaaacacattcactaatgtagaaatgtctaataggagagagaggaaagagtatatagcataaaaatgggatgaatagaagctaagacaaagataaataaaatagacacatgataatatgtagagtgtaagaaatagaggaacttctatagcctcaaagcaaaacagctttcaagtactcaccttcattgaaaggagatacacacacacacacacacacacacacacacacacacgaccaaggttctcaagcattttctagaagggactagataataaaatttttatctttctatttgaagtctataaacaataatagataatgtatggctatcttccaatagaggccactaaacagagcaaccaaagcatcaggcaatggaccattgattgccagtccctgtcctggacttcatgagattcatcctgcttttctgagctcctgctgtgtgcaacatactatgcttggtgttacccatggaaagtggaatttggtactttctaccaactaacaaagggtggaaatgaaaggagcttccagctgatccctactgtgtgccaggctcatttagaaggagactttgtgagataggaatcatagcctcatagtttcattcagatgtcagaacccaggtttaagatgttttttataactcatagaccaaaagcaaagcagtggggccagactttgaactcaggtccacatgaacttcaaactctgcctgttcttctcaccaagcccccattcttggggagaggtaatggcaagaacaatgaatagggagcctttgcccagggttcaaaggcaagtctgtctatgtagaaggcctctgaagagaggcagaatatactcggttgccgtcagaactaaccagggtgttggtgtgagattggccaaaactatctgtgaccaggataacaaaggagacagtacaagcagaactgtgaatctggaaacccagggacacaaagaatttaggagaacatatatgcatgcatccaacacacacacacacatacacacacaagacacacacacacacacacacacaggtggaaatgacatgtttggatgtcacactagatcagcattcttgatctgccttccctatcaagttttaacaatcctggatccactgtgagcctctgtcccttcatgtacaagatggtgacatgacaatggcttcccagcataattaaaaagtatatatatatatgtagcatcacatgataatcactatcggtagggattttccaagtgaagccctcattccttccattctgagctgacacaaatgctctgtggggttcatatttgcctttctatattaaagcagctctcagcaactttagctgttcactgtttgcctttggataggctattaagagctagcgtgtgtccacaggttaatttacctcagagtatgtgataggcacagtgattattctgaacagggacattttagtcaagtaagtcttttaaaaagtcactgagaatttacccactatggtggccaggagagagcagtttctttggatgtgtgctttgtgcaaacgtcatagaggtgggagatggccacctagctggcctgttgaaggcactatatgggagtcctggattttttttatatatttcctgtctcccaaattccagtgaatttctgtatatattctcaagttctagaccaaatgctgcctccactgagaagcctttcttgattctcagactctttaagaataccctcctcccacttctctgcattccattgcactaactttgtatgaatgtcaggagaatgtacatcttcagcttgcttctctttcatgagggcttatctctctttggtctctgttcccctggcacatacagtgaatcccctagtaaccacatatatattgaatgaacaagatgaaatcaaacaatataacagctaaagttaaaaataaacatggtgtcatttttttaataatttatattttccttgccttttaattctgaggcaatatttactcctgtgttcgcatctgtgtgacctaggcacatgatttcatttacttagtgttggtttcctggtatgccgaacagggttttaaaacacatagatagtcaatagaaaagtgtttgtaaaatacctagttcttggtagggcctttaccaagatataagaggccaggttcttctccatgatgcctatgcctgtccacgctccataaatacctgttacaaatcaggtattcttgccacagcatatttaaggaggcatttacaaatgattatgtcaagagatgttcaaaaatcattttctgtaattcatcagtccttttgaattaagacaaagaaaaaaaataggggtagaagaaaaccatgcaaggcaatcaataccaattacccagagctgacagaaaacatgctgacaagtgaacagccagggcataatcacagtctaaggccaaaccaccctgaaggcaattggtctcctccaatactttgccctgtaggcaagacaaagtcagtactatcactgctgattcataggccctagcccagctagccccagtctctttgaaaatgcagccttctgtctgaactggggctgagggaggttcacagttgaacccaagacctcacacatgctagacaagggcattaacactaagcaaccccatcttccttttcacgttttcttttttattgatcatttattcatttacattttaaatcatatgcctcttccaagttaaccctccacaaaacccccatcccatcctcctccccccccccacccctttgcctctatgagggtgctcttccacccactcccctactcctgcctcactgctctagcatccccctacactgaggcatcgagccttcacaggaccacagaactcccctcccattgatgctggataaggccatcctctgctacatatgtatccggagacatggttccctctatgtatactctctggttggtagtttagtccctgaaagctctgagtggtccagttcgttgatattgttctttgtatggggttgcaaatccccttcacttccttcagtccttcctttaccttttccattggggtccctgggttcagtctgatggttggctgttagtatctgcatctgtattggtcaggtcctggcaggacctcttgggaaagagccatatcaggctcttgacagcaagtgattcttggcatcacttgtgttggggtttggtgtctgcagatgggatggatccctaggtggagcggtctctagatggcctttctttcagtctctgttcctttttttgtccctgtctttccatttctgggttaaaaattttgagataaatgggtggcccattcctcaactgcaggtctatctcctggagttggtgtctaaggcagggtcacattaaattgctagcactgcatttgagcatacaatcctcctatttcaacctcaaaaaatatcttccctcatagtcctatgacaccaaagccttcctgactcagaatttgcatagtaaaaagcatcttagtttggtattttgtatgatgactttgagagaactctcctgacatgttcagcactcgggtggatgtgtcccttccattggattgtgcctttgtccctgcagtgttctccctagaatactctggccttgtgtgcctagaaagttccaatgtatttaacaaaggtcaccccttttcttatggtggccttctccactttccatggatcatatccatagactgggctcgcatctttatgaccctcatctctcatgcatttacctgttaactcagtcgtgatctgcttaggtaacactctacttagaacagctgcaggcccatcccctactatactgttcattatccagttttcattgccctacaagtagctcagtatgcagaccaattcagacatctttatgagtggatatctgtggtgggtatccctccatgcttgttttatctctattgagttatatattatttgattcggcatgagttggttaatatccatttttatttattttggcatatgttgatggtaggctttcagatcactgtaggctttatagttttatattgaattcaaactagaaacattgtattcaaggttgcatgtcacaattataaatgcatgaaattaatgaaagctgtcacagtgagatagatataaatgcagtagtctagatcctgtgtacagataaatttggtgagggagtgctattgaaggatgctttattgtttacgttattggattagagttgaaccatattagtcatgaataccaaacagagccaatctataagccagagctctgtcactttaatcagggaaaatacaaagtaactatttctcctccagagatcagaaacgatgtttattccatactttcaagtttacacctaaacataagcttccatgccaaccaggtattaatgatgccttaaagcatataaacatctggctaggcttctaaatgtttctactctacaattgagtttgaatgctacaaagatgataaagggaaatgtgtgggctgtctgctgatggagaggagtatctgaaatgtgggtagagaagatgctctcatgtggtcaaatcctcagatcccctttctagaaggatggtcttagtcacccagaatagagacttctggactgtccttttcaggactttctgtttgatgttgcccctccaggtgtatctagtagccccatggggtatatagtagtcaacatagggttgtcaaagccaccctggctcccatggggttgctttaagtcatcactgtgactacatcactatttgatttcttctaccctcttcttgacagggcaagcctgtcagtctccctgagtctcattacaaaacactgtctgcgccactcccattggctcatatgtaatttggccactagagacaaatgggtttaagtatgttctgtgcctttccctagagcatgctttcttcatagcctatgagcactttgtgaatcagccaattaaggtaattccttcctccctcgtttagtgggtagactctaaagaatcctttcttagataattttcttcataggcatttgttgtctgtgctgatatgaagaccatggagccattgctatatagccctacctgagagagatccaaatatatcccagatgagactacagaaatatccttttgttgatacaaccccattaaacctccagtgtcccaagtactcagtcatagcatcagaagcaggtttacttctgaaaacacttcgtataacatgcctcttcaaagtaagacatatatacctgcagatagagccttaggaaagatagaactgtgggacgcacacactgtaaatgcctttcttgatattttaccagagtgcttttaatggaaggaagtgcttaagttaagccctgagatgcgcctgctgatggtaatgattacatcttgtttgtgtataatgctttatctctaccaaagtgctttcccactcattatctccttgtctggttgggtttggaggtatttagcaaggtattatgagacagatgatagagtggagcagaaaagagccctgggcattctggctctgacgttttagagacatctttaactcccatctctggttctatttctcatccgtaaaataggagtcacagagttatttcagaacagctttggagggtgagaccatgttctaagggatttctttcctttcctttctttgatgacttcatacatgagtactgggtttatatattgtttactccttctcccctctccaacttttcccatctcccctctattccctctcattcatgaaccttgttgttgttactattggtgtgtgtgtgtgtgtgtgtgtgtgtgtgtgtgtgtgtgtgtgtgtttgcacgtgcgttaatgaacactgctgaattcacttagagttgctgctatatatacgtgtttagggctggcctcttgcaattggacaactaatcagaggctcatccctggagaaaacaaattctccctctcttagcaactgtaaacttcctagagcttttcatctagtggtgagtcttgcccaggttgacatggtatggtgacaggtgttttgacggtgcaggtcttgttaggcaacattgttgggatatcatgagtgtggcttctctgtcacatagagaagacactatctaccaagtaatttccttgtgtcagctacagagctaagttctgagtaattagttaaaatgctcttcttttgaggagtttacagcttaaaagggacatgggcatgtcaacaaatagttgtaaaataatgtgctaaatacatgaaagaggtgtactgaaggtagaaaggggaggccttcattgacaactgtgaggaaagatcttgtggattaaatgacccaacaacattttggaaatatttttaattaaaatagaattacatcacctccttccttccattttctccctatagcacctcccaaatacctgccatcaacccttccatgcttgcccactcttaaattgataaaactaatcaaaacaacttttggactattatgattacatgtatatgtatgtgcatatataatatgggcacaaatacataaagacaatctgctgaagtcatcttcgttgtttctgtgtgtttggtctcagggttgaccatttgtagtggataaccattgagggccacatccctagcagaggccctttctcctcttcccagtcatcattacttgctgtagttctttgtctaggagtggaaccccatgaaaatttccttcttatacataaacgtgtcttttggtgttggcattaattcagcttattcacgtagccatttctaggagagactctttcaaagcagctttcctagtattctggcttatacaattactttccttcttgaccataccatcttcaaatacaggcacaaactcacacctttatttttcatagctggttttgtggcatccttggggtaaaaagactttgcaaggaaaataaaagagtaagaaatgaatggagaagaaagggaaagggggatgaaaaggtcagagaaaaagtttgaatcctagttttactgcttagcagctgtgaatcccaaacccttgggttttagttttcttatctgccaatagcactgacagtcctccaatcaacgagctatgttaagagattacgtattacactacatattcagggttaataccactagaaattagtggaactgtagcaccaactattgttgggtttatctaagaaagaaatacaggggaacaaagatgtagaattattgtagatggtggttcttatgctttataaaaatctctcctctgagaaatttgtataggacacctgctccccaggcatccatctgtggtgacaccaacaagagagatcagagacaaattggtgactctggccagaaacatcagtttaggcaatgttatttaatactaacagactctgtgtatcagtaggaagaagaaaaggctgcagttggcagtttcatttctaccacagctaattgcaaatacaggtactgaggtgtagacttgttctgtatgatatagctgtcaaaaccttccattaaaatgcaagtcaccacaagttaggaacatagggctttcatgttctattataaaatgcctcaccagacacatcaccaccttcctggggacagagcccccgataagttggtgcaaaggtagaaactctagagaataaagttggcagtcacatagaaaggaggccaccatctacaaccaggaaagaagtatttgagatattcaaattcaactagttggtgagtatataaatattgtaaaatctactagcttaattatacctgaaacctgggtagaggaccacccccagttgcaaaagcttgagaattcagcatcattgaagaagggaatttggaagaggagaggcatgacctctatttaaccaaaaccttcccatgatcctctggatctagagagtcatcagttagaatggctttaattgtgatgatggaacatgcatttgacaatcaaagactacagagaacagaatatttgatggtactatttccttttttaaaaacctcattattttttgtttgtttgttcttgtgagtacatatggggtgaggcatacacctgttgtgccatgtgtgtagagatcagaagacaagttgtagaagttggctctctctttctaccatgtgggtcttgaggatagaattcagtttatcagcttggtagcaggtgcgttctgcccactgagccatctggtcaacctaaccatttccttttacatgtgttgagtagaccacccttgcttgtgctgtttataaatgaatagaggtcatttaagaaatggcaatactgtcccaggcacatatttaaattgtatgtaattatttgctgacatgatttcttatcagggtcagggtgccagtataaaaaggaaaggctccttggccatgactagtctcctaggaaacgtgttcttcacttgtatcactccaccagcatatcatactgctgctgaaaccttttatataagagagagagagagagagagagagagagagagagagagaggatatgaatgagctgctctctaaggttttatcccagtggctttgaacccctactcagaacattctaagagtgttgcataagttacaaccacccacgtgctttccaggagcatgggaagtatagtaccataaaaatgctgttgttaatgggagacttgaattcttgtaaaatgtgaaaatacaattttattaagcctataaaccaaattgagcctcaaaactaaagaagggtagctttgtttcagaaaacaccttagcaacaacgtgctaaaaagaaatagagcaaagccaagagaatctttgtagtttgttctttcttccccacaccatttatcatctgggcatcaacaggataagaagagaccttctcataaaaaaaaaaatctaatctcagatctaagctatgggaatagaattttaggctatattttttcttccttatcttttctaaacacaaaaggttccatgaaggagtgggacttaaggtgttgttttactttgcttgttttgtttctgttttttttaatagaagacttcacggtggatattttgaccatattaacatggatatgttcccaagtcactaggatggggaaggagaatatgcttagtatattatacttctataatcttatctctcttcatttaaggatgttgaatgctggttttgtttggacctgtgaggagactaataatcacactgtaaacagccctattgtaaaaggtacaagtttgggttcagctgctagattttagccctccctccacttcttccctcactcaattgttccctccctccttccctccctccctcccttcctgacttccttccnnnnnnnnnnnnnnnnnnnntccctccctccctcccttcctccctccctccctttcttctttccttccttccttccttctttctttccttctttccttccttccttccttccttccttccttccttccttccttccttcctttactttctttccatttttgaaatagaatcttactttgttgtccaggctgacttggagccttaccgccatctactctaagcctctgtttcctcatctgtgaattaagaatagtaatcccaaattttagactcactgtgcagacttactgggacaacatcaatgttttacaagtacggtgcctgggtctcctttaaaatatttttagattaactgacaccaacaaataaaagttatagacatcaggagcgaaatatatgatgtctcagagcttgggaacgttgtgtgttgtttaaatcagcataaacatgcccatcctcttacaaatgggtttttttttaatgtggaatgcatacaccatctgtgtgctgtgcactgagtacactatacatattataatatataatatatatcatatatatgattattatattttggctttatgtctacttctattttcaagatttaaaaaaaaatttatttatgtatttgtgtgtctgtgctcctctctgtgttcccatgcatatgtgtgtatctatatcctgaaaggccagaaaagggtgccaggtcccctggagcttgggttgcaggtggtgatgagccacctgatgtaagtaccacaaaccaaatttggatcctttgtcactgctgagccatctctccagccacattatgtctactattactttgcaatttacaaatgtctttcacataggtatttcatggaacctttacgttaacccgatgagaaaattccattttaaatttaagaaaaggaaggctcacaagactgactagggacaagggcttcctgagaaagagaacacagagatgccattactagtgccatgatcttatgttgcatgtgagatgcatgtgccaaagatcctgaaagagacttctctacatggaaagaacaccaacaagagccacagccttttccccacagagccattatttcagagcccatgtctaaagataacatgcaatgaatacagttcaaagttgcgtctcacctgaaagtgtatagctatggcctcagattataatagaaaaagatacagacagaaaaccacataagatatactttatgcctttaaatacattctctgtataaacaagacaagaaattaaacagagaagtcatttgtcttcttataattgctatgaaatttataatccactgggaaaaataagggcagagattaagagaggagaggttagaggttgttttgtgattgttttccaaacagtcctcttgagtcccacttttaaatgtaatctcttaacacatttcttgtttatactaatgtcctataaaagggttgtgctgtggacagatttgatttaaattcatctgtaccagacacaggagtaactgattatagagtagtcaaatgatgaacttattgaacataatctgtcccaggtgatcttttctgggcaattgaggcttgaagagtatttttttttttttgcttcttttaaataaatacatgatggtgattccacatgttgaaaagaatcattctggctcttgattggggttgcgtaagtcttctcattaactatgtgagcactgcagtctttatgacatcaagtcttcggtctagaaacgtcatttgcctcttcatttgggtgggcctcctttgattctcttttagaagaacacaggcttgtgaactacactacaaagggcagtaggctgggcagtcacaagtaaatatgtctcaaccttgtcttgaactcactgggtatgcagcctggactttttaactcatcattcagtctcaccctggacttgaactcactatgcaagtcagcttgtgagcccaccatgaagagagcttgtgagcccaccacgaagagagcctgatcatgaacccaccatgactcgacttcaacttcctaatctcctactttacctcctgtaatatttagactgcagatttcactaccatgcttagcttcttgcctttattttgttttgaatcacctttttaccatactttttgatgtatagtcttttgtgtgacctgtagatttctgcctgaaagtctcattctttccatgccgttacattgatgtttcgaaatttctgtcctcattgtgtattgttagtatataggaataaaattggtttgcatattctgaaaaacaattattccaattgatttaacgttcaaaagacaaataagagtaagtcttaagtggaaaaataacttacttcccatgcaaaataattttgcatgagagattggttggcaaacccaagccagatgtttatcaaagtgcccagggtatgcccaaaggaagttcccatatttgtgccttcctataggctgtgttgctcttcaaatcagggcccatccattgagtagtagttctggcaattacaactgagtggcaggaaggtatggcaagatttgatggatgtaggcctggctttggaccatggtcccaccatgggctagacatatattcttagcaatcatccatcttcccagatcttcatcttcccggatctccaatgtaggctatgagcagagagagcccagggtctggcacccagcaacagcttattatttatttgcaagaagaaatatgcgaagaaaaaccaaagagctttctgatactggtgatttaacaatggggcagactaactgtgaggtaatgagcctcctggtacaagagaataaagtactccctatctaggatattagaagataccccaagagtcgctccagcagtgttggggtgttttaatcctccctccttgatgatagaaggagagccagttcctaggtttctccagttccctacacatgtgacccagagtcacaaagggctcggaagcagtagggagaaatcatttttggtttgtgatttgtttttatttttgttttccttttaaaaaataaaacaaattcagaccagacttatctttccatcagctgcagtttatgattgcccattaaactcaattgctttctctggaggctggtgttgggacccgtcatctgtagcccaatgccatctattcttgctttccccaagagtgcagacagacaagccgccttcttggtgtacactaattaatttatctcatgcttgtgattttatggcgcttaagtgctggagcatttctgtttattcttctccctgcaaagcatctcacaacgcataaagaccatgaatctccattgtaagccgccgtctgtcttgggctggaaaacagcctgccggctgcctgatgtcttgctggcactgtctcttacagccagagtaacacgtccattaatttatccttaatgacattttgacataccaatcagttcatcagatgttccttttgcaaggcctctcctgcacggccgagccagggtgccagaccactcctgatgcataatacatgagaccagcacaccgctcagtgcctttaacagacagacatgtctgccagtctaagactgcatgttcctaatggcccctgctccctgagtgacctaccctgatgccttcagggcagttgtctcttgcactgcgacttgctgtgcttcaaggaagcttgacagggcaatgatagggttctgtgttcaaaagcacatttgtgatattgctgttttggggaaataaggccagcaaccctttgccccactcaatgggctgagagagagtaagttccagtaattccagcgaatctgtggcaatcctggtagcccacgtttcatcagtatcctggcactacttagaaataaaaatcacaaagctactctgataataatgaatatcaaaaaaggaaagggaaggaaaggaaaattatccctaatgtcttctctcttctatcagccatacacacagatatactacctagtggttgtgattacaatgtaggcatggttttatttttttcgtattttaacttaatgcaacccagttagcatttttccatgttgttacagagttttcatctttaatggcactccatcattttaatagttgcataatattccatccaggggaagtattgtaatttactgagccgcttccctattgttagacatttacgaggctctaaaggattgcatgctattaaatagaagcttcagaggaggtgagagacacagcaggctctgaagactgaagaattgggcttcaaacccacctgctccctttacccagtttatgagtttagaattaactctctggggcccaggtttctcatcaataaaacaaaaaagaactaaccagcacttcatggtgctattatgaagcttcaagctgtttttaaggtaccagccacacacgatggagtctatgaaaaatgaaagttttccatttaaacagaggtactcctggtaggaaaaattccccactctgaccccaaaatatttggcaatgcttatatatcttttcttttttgaaagatgggtttcactgagtagtatggactggcttccaattgggaagtatcctgcgttagtctccaaaggtctgggattataagtgtgtgccagcacacccagccagagacatttttaatgtgatatctgagagtaatgaaggcctggcatccagaaggttgagatcaaggatgctaacaaacattatgtattatctaaaatatctacaatgtcacagttgatagaagtagtgcatatagaaactagagtggttaagagtcactttactgtctatgttaggccctttattttcactattgtttatatttccttagaataaagtctcaagagagtagaagatcttgcttaaaggtatttgtccttaagctcagtgacagtgggaggggctaagtgtggtcctaggtaggaacagaggaaggagaacagagaggtggcatccgttcctctcttgagcaagagatgatgtcctatgatgggtacatctcaaaggacagagcccagtatcttctaggaacttggaaaggtacagatatttagttttaccctagacttacaaaattctaaaactcctaggatggagcccaacccaaacatactagatgattgtgatgcacgcacaggctgtacaagctggggaatccttgctattcactcctgcagaacaaagccagtttctacaacagtacagatgagtctgtcaagtacagccactttgtacagaatagtgtggaatctgaagttatgggaaatttcaaatatggaggctccatccatccatccatccatccatttatataacataataaaagcacttaaaacatggtgctaagtgctcagctaggtgctagagcacagaacacaattagaaactaatgtgtcctgcatccctcctttccagggtactgtgcttctggaaggggctgtctgcagagggcatgggttcttgtggctggcattgctcagtaagggactgagtatcttctgatttgacattacaagggtttctaggtatggtagaggtgaaggccctagggacctttccagcccatataatcgaacatcttacacattgtataaataaaaactgaacatctgggcacctgtgggaccatctaccctggtgtctagcttggcttgttatcatgttagcaagatttgcacaaataggtggtggtggtgggggggacaagaagtgcagacagaaaaaaatagttaccctggtttcttggtgtgttcctgtcagggagcagataaaagtaaaatgcgggtgctggagaaacgcctcagcagttaagaactggctgctcttcccgaggtcctgagttcagttcccagcaactacatagtggctcacaactatctgtataaaggggtctaatatgtaggggtggcatgtaggtgtgcatatagacagagcactcctacacttaataaatacataaataaatatttttaaaggttaaaaacaaacaaaaactctcaaataatgccaaaagaaaaaatactctattcttgggagtggatgatagtgatgacagtgatgatgatgatgacgatgatgatgatttagagttgagtatatgagtatgtgagtatgaggttgtatgtacatgtatgtagaagacctgtcattcctcagatgccattcactttagatatttgtttttcttcttcttcttcttcttcttcttcttcttcttcttcttcttcttcttcttcttcttcttcttcttcttcttcttcttgagataataagtacatgagttctccctttcttaggctctcattggcctggaactcacttagtagactagactcattggccaacaagcatttacctatttctgccttacaacactgagataacaagcatggctttcttttattaactgggttctggaggatcgaactccattcttcctgcttgcagggcaagcactttatcaactgagctatcaccccagacacaagtgactatttttaatctgtacaagtcatgcagtagatgaaaatatatctgattattctacagatgaggaaactcccattacccgcatgaagatggagactttatcatgattacaccaagagttacaacctaggcagctcagaactaaggtcaatactatttccatagcactaaaatcggaaaggctgcctccccagcccaggactttcagagctctgtagcttaaaagcattcaggatagcacccagcatccgaactgtggattctgtcctcatttttctacaaagagctgcttcccttcccactgtttattattcaacaagcatcatgtatagggcgatttctgtcaacagcatgtccagttgtaagtgcttgagaattctttatcaccgtatctaccctggagcagtaagagaatttgcaatattcgacactagttcacacatgaggagactgagttaaggagaagtgagaaactacccaagactacagaggtaggaaatgacagaccatggtttgagcttcagggcgtctagcttgagagtccgtgcctttcccactggacactacttcaggcttctgggacagtgtatctgtccatatgcacatttgaaagtcgcccttatgtatgctgcatgccctctgctaggctggatctatctgagccaactcaggagcctgtccagtggggtctaactgcacttttggtaaaagaagaacctgtttcaggagagacagacatggttaggagacaaatgcagacatagacccgtagaggcagcaacacagagagctagacagcagaaggctggaggtgacaggtggtagccatggtcccttgggcattcaaaccataataagatctgctgttgctgttgctacttgtgtaagtttgccaaccttggaaaagagggatgctccaacacaaagagaggggaaggccccaaagtctcagaataggtgcctaacagaggcagtgggcagacaggatgcgcagtgtgagatgtgaactcgctgcagatatgcacatgtgggtgtccgattgcctgggatgaagggagccaggtgagaaagctgtatgctttcattgacagaagaataacaacaatattcttagagagcatccagacacttgactacctgggtttgagtctcatctctgcccctggaaagtttgggaatttttatgcaatttttttttaagtctgtctgccctgttccttcatctgtgaggtcttggcaatactgttgctaaccatatagttattagagctaaagccctgatacactgtccccacagtctttgaacagtgcccggaataaagaaagcccaatgcaaatgcttattaaatgggcacaatatgtgtattatctattttgttaaaattgtattagtttcttaaagctactctgacaaagtgctgcatgctggatggcttaaaacaactagaatttctcctccaccctggagatatgattcaactagtaaaatttttgctgtgcaggattaggaccctgagtttggtccccaagcaatatgaaaaaagggggtgcttgttggacttgttctcttagcattgccagggtagagactagcgactcctgagcaggttggccagccagcttagcatcctcagcagctccaagccaatgagatgtcctgcctccaaaatcccaaggtggctggttcttgagaaagaacacccatgttgaactttgcttccatacagatcaaacacaatttatattgaggccagcctagcctcaaactcagaaatctgcctgcctccgtctcccaagtgctgggattaaaggtgtgcgtaccactgcctggcttaagattaaatagaattaaatagcatttaaggatggctggtgatttgtggtggtccttggctagaagctacatcactccagtctttgcctgttgttatgtgggatgggagcttactcccacagtagtctgacaaggacgacagtgttaatgtcacactgtctgccactattgtctatgtgttaacgattttaccatccccaactaggtgtaagagagaatgctgtaatacactataaaccctgtgcacactcatgacctctattgactctgagaggatgtagctcagactagaaatctgagttagtggagtttgggttttgaggtttttattttgctgtgtttgtaagagagtggaattgtatgtaacatgtactgaatctgcttttataaaaatttattttcactcacaatttatatatatatatatatatatatatatatatatatatgaaccatatatagagatatatatacacacatatatatatgaatcatatataatgtgcttttcccatattaccaccaccaacattatcctctcttacctcttctccctcctgccaaaccactagttctttgcaataagttcctctcctactctcgtccgttacttttaacggctgacttgcacgaggatgggtgggtgggggttacttaattggggaagaacacttaaccactgggtacaccactgagggttatgacttcttccctccccacaactctttactgcctctcacttctcagagaggaatggggcctcctgaactgtattcccctccatactgaaatgttgcggggatcatcactgagcaggctgagtccaggcaaccactgttgttgtgcattcctgggtgcaacaactatgtcatgtttagaagacggcgtttcacggctctccttctcatctttgggctctttctgctcctcttcagtgatgctctctaagccttggagaaggcaaaatggatccctcagttagggatgaacactcagtactcagctgttcccttccctttgatctgctttgatgctctatgagtctctgcattaactgttgccactttcgacagaagcctctctgatcaagactaggagaagcacgggtctttgtatgtaagcgtaagtatttagagggcactttgttaccttgtccgtgcagcaaaccaatagcagtgtgctcgccctgtggcccctgacctccttctcatgggctggtgatcaggtttacagtgcaaggcaggagctccctcctcgccccaaacctcaatgccaaccggacagctgccagccagccttctatcagtcatcactattgtactggtggccgcaaatttcctggtaggttagtatcgcagctcagagggctcacagctggggaaaacgattgatagcttttatcctccagcaggcagccggcttttccttctggcattataggaaagctagccagcaggaaggaaacttcaagctcacttacagcttgatttctcagtgtcctgccaagtgtgtggtttcctcagcatagggtagagtcatctaatttgcatctctaatcccatccctagaggagaggtaggagaatgttggaacgggtgtctgagtttaaaggcaagaagcaggaacttggttctgtggctcctacctgtgtgctgtgtgctttgactaaacaccccctgtgcaggcttagtaagagggagtctcttctatgaaattggaaactagtgtagtcctctttctgttatgaggagcaatcctagatagagaatcagtcatgtggcctatcgctgtacattctatctgtaaaatgtatgaagaaggcttacttttaattagtgtgtagccacctttatcctttctctgtctctctgcctctgtgtgtgtgtgtgtgtgtgtgtgtgtgtgtgtgtgtgtgtctccctccctacttccctactctttcttctttgtattctatgaggcgctataataccttcttgcttcaaggttcaagtctctgagagttaccaagatattctgcccaaagatgctactgaagggtgggtcagagtcaaggccctctgggaaggaacaagtgcctgctcactcactgggcagacccaggagagtgtacatggctggtcatttccagaaaaagtctttaaaatggatcagccaaaatttccagtagtaatgtggatgctgcatacttctgttccaagacaagaagagatggaggaggggatgagagtggtataggtctccctcactgcctctatgccaagaaagtttcccagtctgtgtttcaactcttctagcagtgggcatcctcatctccccagcaggagctggaatggactcctgtctgttttgttttagtcaggatacccttcctgtctagcagccacaggtataaaacctcaaacctcatgaacaaagggggaagaaaattatttgaggagagggatgaagaagtctacaacaggagagagccctttttttagttggctcagattactatcttgaaacattctccagctctaggaacgtggtgcagaggcgtccataggcttctgtgtgctcttttcttcagcttttggtaccccctgctggtgaaatcctgagacctaattgacaagaatcacaacaccaatagagaaatatttgcaagttcagaaaagtcacacgtacttgtacttgagtgttaaaagccccgaggatccagaccttaattaatgagaggaccaccccaggagtcatgactattttatgatgttggggtgttttgttttatttttaatgttctgtgacttgggatagtctgtgggatctaaagttaacaacaacaacaaacagacagacagacagacagacagatttctgtgaatattccactaattctgccaatattgtaagaataaaatactgagttatctacccaacatattccgaggcacacactgatgccatgcactgttccccttctctttgcctgtactcgtctgcttttgaagtggttataatttgtacttagagcaggatagccatcttttctacacttcaagtcacagacttgttcaatggaaatttgtgcaacaaatttatcgagtgtgggctatgtgccagatcctcagcaagcaactggagtaggcatgtggagtccaaagcccttctcccaagaggtacttcctagtgggtgagaattgagtgactaacacaggagggatgcgggcttagctgatagggtgtcgatatgttacctggtcaccaactagagttcaaaccaaggtttaactctctcagcaccaaacatttcttctctgcattctccatctctgtgattctctatgtctgaacttaattatttaatgcttgcctttgccatttatctctggatttgtcgagggtcaaggtgaagaggacaaggctttctttacacttaacagagcttgatacatgtaggtgctcaaatatctgttcaaagaatgagtcagccggagaggagaaaattacagttctgttagtggagcagcaagaagcctcagagaaggtctgacattggaatgactttcaacttgaaggatgaagagaaatgcccagcggaaaggaataagaaagcatccaggccaagtgtcctgagcaatgtggggtagagggacataattcctgtttgctaggaggcatggatgggtggtgaagctgaagcccagtccacattttaaagatgttgggtattttcagatttgagttttctccagaagagaaaaataaatcaataagagggaaaagataagttaaattctttggtaatgacaagaactatcaattttttcctgttacaggtattagttataatttttaaattttgaatttcaaaggatagagataggtctgtagctttgagtttgtttgtttgtttttctctgtgcctcttctgtttccacctttaaggctgtacttattgccaaaacattcatataggatgtccattaccaaaacactcacacaggactcctatcaccagaacaagcaggaggtttcagccagccatgggctacatgcccaggacactgttatggtttgcaggagcgccatcccaaccccaaaggattgtgggttagaccgtggactgcaatgctatgaggtgcggtcaggcttagtggaggtccttaactcaaaggagggtatttaagaccacagcctatgcaaatattgtgcttcctggctcttgtcctgagaagtttgctctgcccgctatgaacatataaaatcttcagcccttgctagaggcaaagaagcaagtggggtcacccagtcaatgactagtaaaccttttcttttaagaagtttattgtctctggtatatttttatgtaaaggtagctaatatagatatcatatagtggatgtttatagcttagttgttaaattttttaaaatacctccatgtttggagaggttcggcctttcctttcttttcttttctttttctatataggtatttggctcaatccaaatatttctataaaatgtcatttttctaagaagcagtgagacctcttttggatattattattcctttggaggctgatgatttgtgttgaagacaactctctctttattattctaccctgaatggaatgagattggctggaagttctgccccgaaggaaatattaaagcctctgattcattctcatttgtagttctcaagttaattctcttatcagatttccttttatttcctgctggggcaatgtgagcgagcttagatggaggcaaaatatctgttgtatatcctttcaaatttatgattatgaaggtcacatatacatttttaaacacatgctttttgataatggatgaagaataaaattttgaatgccatcagctacaaaactgttcatttgtcttatgttgctcttcttcttggctgttgattgactgatgatggtagaaagggccaggctaagcaaggcttgatttcttgtccttctgctgtctacctaaagtagttccactgatacagcagtctgcctgtggccaaaccattaatgaccaaaaacatgtgtttcttttcttgagtgcaattccttccccggaccaatttttaggaataaataaatgaagaattccactttaggctgcatggatcttcagattatggccaaatgaggaattataaaagctttttttcttctcagtcctagagccaggttcagtctgtccttttctctgccatgttttctgcttcaggaatgcgttcttcaggggctccctcagaggggccttttaacacctgtagcttttaattagattcagctaaagagaactgctataggaagtcagaggatgggaagagaggagccagggtattgtggcctgtgatttcctctgtgtgttcttctaggtctgactagaaaacatctgcccttctggacttccctttccaactcttgaggattctgattaggtctcccctgcttgtccctcggggctcctacgtgggaaaaggtctcttgtctctgtgctacatcatctttctgtccccaacaaccttttttaacagtcctttctataaacaaagactttttaaattatcttcatttaaaagtgccatctgtcattctatatagtctacacctacatattagacccctgttcttaggaggaggctgtcagttgggagtttggtcccagataaatccttctaaaacacttctccatccagatttgttttttcctttgatgctccttgtcgaagggagatgctaactcttgaaatgacctatctcatgattagggcatggtttctatgttacagttactttcgcctctttaggatgtttgttatttccaggctgaaataagaatagcaaaggttaaggttaaagccaggttctgtgaagactagagcagtagactcagagaattatccttgagagacttatttagcctgtagctttccatctgctaggaatataatgactatatttagatatatgtatgttggaaaaacccatagggaccacatggaaggaagggtcaccacatttttatcttctgtgatatacctaagccccatcattttaaatttaagtgaaatagatttttttttaatccatgaaagaagaggcctttgacctttttagttccccagcgaggaatcaaagtcactgtcacttggtataattcaaagacaggtggaattccacagtggaactgccgggagggggttgagacgttagaatgtggtcagatgaatcagcaaggatttcatagcaatgtccatgtgatcgctgtcatttatgtgcccggtactgtgttgtgtgtattatatgtgctgcctcatttagtccttacatctgtattaggctaatcctcattgtgtacaaaagttcaatgaacagagaacaataaaactgagccagggaggcaacagaggtaagctctgaacccatgtctgtctaatgctaaaggaggtttagcctcagtagttggtgtcaggactactagaagatcttaatggctatatcttcaggtaattccaacttacaccaaactttgagaaatactctgatacactatttattattattattattattattattattattattattattattattattgcctccgtggttctctagaactgttgctcctataagaatatccatgagtcgagtctagctctggcttctctttctttgagcaaagagactaatctttaccctcgccaaccatcaacccctacttcagtctactgctctataatgagttcttttattagtcaacctatgaggaagactaaactttatctcttatgagatagctatgccttatcagttaaaatgtaagtaaaatagattattaggtccataaaaaaaacctttgaccttttagttccctagtgggaaataaaagtctctatcacctggtataattaaaatagagatagaataggtgggtgatgtttagttgcatgaaaagagaaggcgcctcctgacctcttcctccctctaagaaagtggggagtctctctgatttcccattataagttcaattatataccatgctcattctatgaatagaaaaacttaaattgcatatttccaactaaataaattgatttctagtttcagaattgcttgtgtttacttgactctgacattggagagtcggccttgcctctgcttttattgaatgaactaaatatgctattgagaatggggggtgaggaaagagaccaacctctctttctagtcctctaatacaactagaaccatctgactgtgatttttcccttgcacatgtcccaaaggaagctggctaagaagcagaaggagacccagagtggagcccagagggagatgggtcctgtggcctcgactgacaagcctaccgccaagctcggcaccaaccgcaatgatgaaggcttctcctccagctctcaggatgttaatggattcagtaagtcaagccgcctaaggcgaatggagtctccagggtcaattttggtcctggtgcctctcctgtggatcccacacaaggaccaggtctgggaaagcatgcaatcagagtgctttcctgagatatcagaggtgaagggtcttctccctggcaaaactttagggcatcccaatctgatgtaaaaggcatatttgcatatttaagattataggactgggggtgtagttccaccaatagacatgtcacatgagcatgaagacctgcgtttgaatccccaggacacaaagaaaaagttagtcagggtggcatggggaggtggagacagggggatttcatagggtttactgacagccagtctagcctaatcattgagctccaagtctttttttttttttttccattttttattaggtatttagctcatttacatttccaatgctataccaaaagtcccccttacccacccacccccactcccctacccacccactcccccccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggtcgcctccccagccgggcgggcacctgtcctctggtccggaaggtggccggctgtccccggcccacacagggtgctgcctcagcgcctctgtgcttctgcctgttccagaagctgtctggttctctggcgcaccctctcacctgttcagactaatttcctaagttcggcgggtcccggaccaacgagctccaagtcttatgagacaccatgtctcaaaaataaggtaaagaatgattgaggtagttatattaactgttgatattcacatatatatgcatgtacacacatgcaaatatgtgcacatatctataaaccatatatacctaaaatcaaccaactataatctatgcctaagcagatataatgggaacaagtcatcctggatagagtcaggtcagggagttaaaaataaaaacagttactaagaagaaggaggaggtagaagaggaggaaaaggagatgactttaaggcaaaaagaaaaaagaaaaaaatccatactgaagttattggctggcaattttcaaagctatttcacatttcctgtgtaatgtagatgagtcatggaacgtctatgtctctggccctaatagttcagaaactgagtttaaagtaacaatctctaaaatcacaattaggtccagtatccatactaaaaactgtgttcccaagcatggttttattaggtcaagactatcttcatcatcatgcagagttaataaggtgtccttggctaatataagtagtttaaattccatggctggtccaagcaaaggagaactccatggctgggtagttacaaacctgtttggtgaccaggcttgagaaaatgtccttttgctctactttttcaaccatgctatacactagttccttcctggatctgataataagatagtaaattttcaccatttatcttatacattgtagacagaagaaaccatttttcataaagactgctttagatatggtctgtgtgggagatgtggagtgacaagagcactagagaataaaggaaaccaatataaatgctgtatcatctatgatgaagacacactgggttcatttctgccatcagcctacgagacacttagtagggctgatcttatttggtaggtgagatatgtttgcctcagattcccagagttacatagatcatttctcaaggatccaaaatccctaagctggagcatagcattaaacttgaaaggtttttccaagcaaaatgatggatgcgagacaggacagggactgagggccatggattttttaatactacccagatggttcttagagacaccctagttaagtactcagaactttgaggatggcagtgattatgttcagatggaggagtgttgtcttttggagcgaagattagtttaaatctgctatatcccccaaaagaggctaagaagaaaagaatactcatatcctttaactgcattcaccaattagtaatattttttcaatattgacatccggttgcactttctctcactgaacagaattttctgagctatttagaagttaaattgaggatggaatgtttctagaatatttcatctctagagatttgggtatgtgtttcctatgatataaaacagctcttcatcataccacaatagaattagacttctgtaagagctatgacgtcattccaatgatactgaagatgcaagtccacttttaaagttcctgtgtgtccccagaatatgctggaacttttgctgtaaatcaggacccaaccaaggtgctcatttccatttggttttcctaaagtcctctggccttaattttctttcaggacacttttcaaaagtctgaggcagttgttccatagagtggtccatgagacagagttgtgtgattttcatttaagacatcagatttcatttaagttaatcattttagaaaaagatacacaacgtggtggtattgtttactgctctaaactttatcaatagccacatgatatcactactctactcctattgaccatgtaagtttgaatacaacttaaggtttaataatggttttaagacaaaaatctaaaaatatactgacgatcttatgaacaaattttaataatttttgcctcttcttggagataagagacaatctatggtctccttaaccctacatatatcccattcctgtccttaatctgggtgaattacccatattcatatatttgacaggattcaggaacgggaggagacacagaaccagagaatcgcagaggagctggctaggaagtgaccttggtgtgtacttgaagaaaggttgatcctgaactgcactgagctgtccctggttctttgagcattgcaagtttagccttaaaaaggacactagttgtagttattcataccaaaactctcctgcacatcccagccttgtgtgcacacattttcgctgttctaaaagttccccaggaagacatcagatgccgaaagattatggtccagcaagcatggcaatcactgtgaccctgaaattgcaggtcttaagtctcgagcttgctagtcatatgggaaaacaacctaggtcacactgattccttggatttcaaagaaaaatacaaccactgtttttattgtggataaaaagttagacctccaagataaaaactcttcttcactaatgaaaaagaaagggtaaaaacatgcagcgaggtctcctgggatgttttaaaggtcaaagctagtcttcccaaacagatgtgtctgctgtccatgtcgtatatctgtatatatctgtatatacatgtatacataaaccatatgcattcctatgtatctgtatatagatatttattttattgatatttctttttaaaagtcaagaaaaaaatttcaattggctggttatattcaattattatgaaatcatgcatttgtttgaatcactaaatattttagaattctttctgcgcatctagtgtcttcagactgcagctataaacatactctagggaattttgttcaatgccctaaaatgcatcaggtaacgtttaaaatgccctgtgggaccactgggatgagttttgaagggggaaaaaatgtaagtaatgcttacactagagatgtaaaaattgcttctgaaatcaccctgatgtatgtaaaattgaatctattttcgtgacattagggaagtggctgtctggtttctgaatcggcatctttaagagtgactgagattatgtgcaaattctgaagcagcataggggggggggggggcagaagaacattccttatatggggaaggattatagaaggacatgccttgggcaattattccattattgaacaggtgggccgtacctttattcaaattctgcctcttcctgcttaggtctattttctggtcttatctattaccagtgactgttatgtttggcaacatctattcagtcaagcctctcactgttgtataggaacaacgacctctggggcagtggggtgacagggctctgtcagacatgggctgttgctgtggagtgcttaggcattcttttaaaagctgtgcatgtcacatttcaaggacaaacaatgcacattgttttccatttaaagagaagctggctttttgttaggtaatctgattttgatcttggctgccttgaatacttgtaatttttttccctgtgatcttttgctcactgggattgtcttctgggtctttcttcaagtacactccttacacatcaggcttatgtctgcttctttatcttttgtgtctctgtcttctcctcgctcattttcagactaaacaaaatgctgcaaaacaaatcacagttgaatcactaggacatgggggcccggctgttctgttcacctttctcatagggcatttaacttcctgttttactggctaccattagttagcactccctcggagatagaattacaggttgtgaaccacctgatttggacactgaaaaacaaactcaggtcctttggagagcagcaagcaagcacttttaaccactgagccatctctccagcctccagataaatatttctatttgtgcaacatatttcaacactagacccttattttctttttttattaattgaattttttacactccatattccattccccacccccatccaccctctgtctgctccacatcccacacttcctccctaccacaccccatctccacgtggatgcccccacccccaccccatcccctgacgctaaactccctggggcctccagtctcttgagggttaggtgcatcatctctgaatgaacacagacccggaaatcctctgctgtatgtgtgttgggggcctcatatcagctgatgtatgctgtctatttggtggtccagtgtttgagagatcttggggttccagattaattgagactgctggttctacaggatcgcccttctccttagcttcttttaaccttccctaattcaacaataggggtcagctgcttctatccattggttgggtgcaaatatctgcatctgactctttcagctgcttgttgggtctttcggagggcagtcatgataggtccctttttgtgaggtctccatagcctcagtaatagtgtcaggtcttgggacctccccttgagctagatcccactttgggcctgtcactggaccttcttttcctcagactcctctccatttccatccctgtaattctttcagacaggaacaattatgggttagagatgtgactgtgggatggcaaccccattcctcacttgatgtcctgtcttcctgctagaggttggctctataagttccctctccctactgtctggcatttcatctaaggtccctccctttgagtcctgtgagtctttcacctcccaggtctctgtagatccttattttcatgtcatagatagcttataggtttaatattgtgcctgttctacatgcagggaaactgaaatccagaatacataccctttgacaagtcagaatcaggaaacatttgtccttgtatccattaaagcctatttacccagttcatccaagaatttaggaacgtactcaacaagggcactcatgataaagcaatagttaaaaaaaaaaaaaaagcctaagatcagacaattgtaaacaaaaacaaagtcaagtcaatggcatgtcataatataattatatcataattaaaatctaaatatgcattctagatcacacagatatcatcagacattggaccattaagtattctactaagtcaggagaagtttgagaaaagtagttataaattgaaaactcacatcacagcaggtactaatttttaaatatggatctgtctctgaactttctggtagcaaacattcaagaaggaggataatttgggggagatcctactatgccctggaacttttgctttgtgtaaatcctgctcttaagcttcctcgaaaatttgtaaattctgtactacctccattttgaaaatgaagaaaccaagattaggagagcaaaaggagacatgccccaagtcacatctcacagaagtcgtagagatgagattaggagccaagtggagttttctaccctcaaaccagagtcatgacttgtagtttgacaactgccagcttcactgagtgatctctttggcacttgcagagacagatagcaccattcttcagggataacgtgggtaaaatttttatcattgagcagcgttactgacatggaatcagttagattcttatgaggtgttgggcttggtcatgatcatctaagtccagcctcacagtgaccccgtccagaccttatgtttgttactgaatccacttgactaatacattcctatattaaaacattttcctaaaattgtttaaagaattgtcaaagaaatctgtgtctgatagcatatattctcctttccaaactagacatctttgtctttaatcattatcaatccctctacaatgaagctgggaggaaaacaaaaaatacaaaggcaagatagtcctgaagagtgggaagaccgtgccacctcccataccctctattcatccaaatgcctgcatcagatcacctgcccagtgaatgctctcacagacagagtctgcaggaattgtccctctaggagcttcctaggaaagccaggctctacatggatggtctcatattcattattccttcctcatattcaatcttcctaggaaagattgctggaacaatctgcaagaagatacaaaaatgaacaaacagggatggcttctggtccctggctcacaacagggcagggaatccgaggtctagacaatcagcatctttgctgtatgactttgtgttgaagcaacctgcacaaaggactccagggctcatctcctgtctttgtgaccaaaatacacccaggagtacacttcttggacagagatgaatattgttttccatttaaagaaacactgaccttttcttcagcaatctgattttgatcttgccaccttgcatactgataatttttccctacattcttttgttccctttctggatacttcttcagctgttatccctgcatattgtgcttatgtcttcttcatcttgtgtattcatgtgccatcttctcgtggttcatttcagcccagagagaaatgccccaggagctgttttcttctgatgaggagaatggcccctgaaccccgaggcacatccctgtcgctcaacagacagaactcataaaatgatttctttggacacaagtcaggaaatgctgaagtttgagtctatcataggatggttgagcagagatggggcaggtggcaggcagtgtcaggcaaaatgcagcctgaattattttagaaatatgttgtataactagagaaattgacataggaaagatagattgggactttaaaatgttatggagattggagcggattgtggcaagctccctgaggtgagctagctacagaaatgaatcttggccttctctgggggtaactgttgacttgatgtcatgtgatgctaatgactgttagctccactagggaccttatctgggtctgttattttgctgaatagtttcatatatagtatctagacccccaaacatcatggctaggtcgaattgttacccttgttatcctgatgttataaataacatcatcattgttataaagacagcctaaaatcctaaacatggttcctgggtcctctctggttccttataagaaaacactctgacccatcggatactcattgacaatttatttatatgaatgaatgagtcaatgaacaaatgatgtaattgggattcatacgaagatgtctctaattccagagccttatacttttctcggaatgaatttcatcttccatgaacctgaaatctgccactataatttcaattcttttatttctgcttactcacctgtgtaccaatcagtagcccagtgctggctttgtctgccctctggtgttggatagggcaatggaatcaaccaccctcaccccatctatttaactgttagactgaagtttccagctcttcttataagctaaacaattccatttcagtcatcaggcctcagaatacacacccctgttgtcaacctgctcaaaacagttgacccttctatttactgaccaaattcatggacctcctactccaagctgggactcccagataaccatgaccctctacttcaggctgtgacttcagagagctgtcatctccctcacactggcctccaaactggcatccaaaatacactgtccatgtctgaatcaatgtccaagaatctaccacatgcctgcctactgtaaatgccctgattccagtgagggctggcatatctgtcctatgtgaaaatgacttttcagatccatagggaggaagaattgatgtctcatccatgccaagcccaccaagctatgtgctactctgactgtgtcagccaataacattatttactctctcgggtctggagtatcaacaacaacaacaacaataacaacaaaatgctgttcaaatttatgataatcatggttcttcttcaagaactaatgatattgtggctagagaggtgacttagaggttaaaaacacttgctgctcttgcagaggacctgggtttggttcccaatcatcactgagccctgtcccatgggattcagtgcctttttctggcctctgtaggtatcaaacatacctacagtgcatatacttgcatataggtaaaacactcatatgcataaaataagaataaaccttttaaaggtaattaatgatatattcatttaaatgctgaatagttaatattattaacattgttagcatattgagaggattaaataatgttgtaaactgattgttaaaagatggggataaaaaggccttaaaatagaaatgaatagaactcctaacttcatagctttaaatggtagtgttagacctaaaacataggtctgtctgacacctctgccccctagtcaaaatcactcctttacatggccttgtggaagataggcattattattgccaaagaaattcaagtctgttctaactgtatagaagtccctgagctgtatagactttgtgtctggttagttttgtatgagatattttaacttatttacaagtttataaacagaagaaaagaaaagaaggttcacagacattgagccatccatttaaagcataatgtcccaaagccctctctctaaaggagcaccttcagcttgggtagtgcctaggaaaaaacacatccaatatgccttctaggtgattccaatgatgctcaagtttaaaactcactagctcaaggtaaagccaaggtctgtcagacaccaaaactcttgtgcctcgcttgctaagttgtctctggtgttaacaaaattgtaggctttctgggtaggaaggctctgcctgctctcttccctggagtagatgtttccaagggacattgctgtcaagggttatttgacctgaaggctgctagcatttgtcaatacaaccaaggatccacctttcaagagttctctctcaaccatgtgggattttcctttctggttgacctggacagttaaaagcctaagggttgctgggcatggtggtgcatgcttttaatcccagcacttgggaagcagaggcaggcagatttctgagttcgaggccagcctggtctacaaagtgagttccaggacagccaggactacacagagaaaccctgtctcaaaaaaccaaaaaaaaaaataaaaataaaaataaaaataaaaccctaagagtcaggatggaaggagcagaaatttccaaggtgaggcaacaatgagtcagagcgtgaaaaccaagagccgacagggcctcatgcagaggaatgcaaacgagaagtgcaaaaactctgtgcaggaacaattatcttttctggttgctccaggattaaattgaatctgggagaagaattgaatgttacaagcttgccacctccagttttattgaatattttacagggattattgaatattttgcaatcatccacttgactgacagataaaggacacgcttattaaacctggaaacccagagttgggtggaactgtttgctctttggaaaaaaagaaatgggaatgtaagtattccttaaggaagtgaacaaattgtctatcgcaaacagtatggagttagagtgtggcaagttgctcagaagaatattgaacaaaaatggatgtaacacaatgaatagtaaaaattaagaagtgtctgagataatgtctgatccagccttcccatactggaaagtggaaaatttggtcctgggggttgcttttcttcagatcattcattaagtcactaatggaattgggagtcgtttgggggctgagacccttctagctcctgttcaatagtttcattcataggcttgaaatgctgtatagtcattagtggtttgtcttcttgtaatttccacatacacccccctgtcccaaatctgatttctgcacaaatagaactttctcaaattgaattatccttttcatctcctcgttatgggagtagctgaggtgttcctttaaatattcattgaatgccgactatagggggaaatattatagggattgtagagataaataagacacgacggtctctgccttcaaggatattagtctcctccacgaggagacttgtgagtggattcgtttcaataaatatggtaagtgatagaggaaaggtatgtataatgtcccaggaatgccaatcagaggttcagcaggtgattaactctgcctgagttagcaactgctcatttaaactccatgtaagagtggacttatcgtaggcaaaaggtacaacagcttaagatgtgcctggagcatcacaggctcagagcccagtgcattctgctaaaagcatatgacctgagatatgactgggctggcagttggaatttactaaggaaaggagtcaggggttgcatctgtggctaagttgagttcccattccaaggaggttatcctttctgagggctgaataaccctagagcgaggtgccctggcctcatgctgaatcctggcttcccaggctctgtgagttgcacactccattgcaggagtgtgcagtttgtcacccattgacagaccgtcactgtcactgtcactgtatgctggcgcagtcattcctcccagtaacttttcaaacggacttcagtaaagtgacaaagctgacaatttatgctaggccactgcatctccagaagaaaatagaatagtcctccatacttcacaggtggtcctgaattataacagggcacttagaaagtgcttcttatactaatcagggataaagaaaagatgctggaaatgtaaatatgtagttgctaggtagcagaataaaccaagtcttacagatttatttttttaatttcctcagctcaaagctgtaggttggaaaaataaaatcacagataattctactggctaagtttttgtgagtaattactggccaaagcacttcaaatggctcatttcgtataatattggaagcacttgtgtggtgcaggtaagacagaagcattctactgtcttctatcctttgcaccttagccagtttgagtctctgaattagtcaccatctactgctacaagagatccctgacaagggctgggagatgcactaatctatagatgtaattgttaattatcagaatttaggttaattatatatctatttagtagaataatagtgaaaggttctcccctaggttataggtcatgtctacccacaggttctaaccctggtaatggtgacacatctgcatttaacattgtggattgtaccttaagtcaatcaaaaagtagttactcctatgacattcatgacactattgcacagaggcatttcttggcaagccagtaactattggagatcagagtgttcactgctgggtaatactggcaattactttacactggtatcgtgcatagcaccttccagcactctataatctatccaggagcaatgaagcttctgcatcagaaccaacttgctgtttcctgttggtctagtgtatggtgtcttcagtgagaggttcttattgtcaagttctggagggtaacaaaaagcattgacaatggcctataacatttcaaagtttgtgagactccactggccaacaaaccattcatgacattaagctttttatttgttatcctgcagtgtctagtaggggcaatgccatcccgtaatagttatagggtaactgtgttccaagtcttttgctatttgagtgtgtttgtgtgggggttggtggtggtggtggtggtggtggtggtggtggtggtggtgtggtgtgtgtgtattctacagcagtaaggttctatctgacttctttgaaagatttttagagtaagttatatgcccatattctctcctctaccctgccctcccaaatatacctgcaatcccagcactgggaaactgggtgtggaggatcaaaagttcaagagtagcctcacctatatagcaaaattgatactggcatgacttatatgatatccttgataaataaaactagaataaaaccaatttttaaagacaacttaattctgaactctcactatatatagaacccatgtatttttctccatatccactggctctcttcatctctgcctgagtcatcaccatcctcatctctagcttcaacaaaaggtcatagtgcataaataatacataacaataaataatctctatttcccatcctaatctttctctactccattttcccataataaccagggatatcttattaagctaaacattaggataagatcctggaatcataaaccattcacatctcacatgctgtcacatcttactcccttttctgtgaacttcagctgtgctgtcttctctcacaggatttcatctatgccatctctctatctagactgtggtgggtgaactagagctcacaggacaaatctagcccaaggtattgcttaatacaaataaagttttatgagaataaattcattcttgttcgcatatttctatgagggcatttatgctgtggtagtacagttaattagttgccatagagaccgcttgacccacaaagcctaaaatatttactccctgacccatgagacaattccagcccctaattggttattttagctctctactcatgagttgttcccttgtgtgtgtgtgtgtgtgtatatatatatatatatatatatatatatatatttatcaatcttcttattcctttacccaatgtgttcccttttatcagcggtgccactgagttatgcttcctcatttttatcctgaaggctgactacagttttcagacacatttgtctaaggtctattttatgattgctccaagatggagggaagcatttatagtttattgttcccttatcctcagcatgcagtgcagtgtctgtaacagagcagctacccaaaactctctctaacaagtggatggatagataagtaaggattagacagagaaacactatgtgttcagaaaactataaggaatattaggcatagatggtaccgcatgcagttgcactcttttcaacatctataagcagatacaggtggagagcagaaatcaaaggatgtgcctttgtcagtcaggtgtcacccataccttagcgccagaattctaatactcaaggccattttacacattcattgtcatggttcctgacattctgggagttgttactcaaagaagcctttgaaatttagtcactgggagtctaggaatgtataaatcacacccccaatcccttgaacagcacggggtctaaaggggaggtcttcagtgcacacacaaatgagcgaatctcggtttggctgctacctggctctgccaagtagaagaggcaagagaaatggcaaagcaacatttataacagattggttctcacctgtctggttgggtgcatgtgtagacatggagatgtagcttatctggggggagggggaggctactgttgacaatgaacacctgttacacaggtctggtccatgtagtcatgggaagccagcttcccaacttgctctgagagccacaggctttctataattagtgtaacttatttaccagctaagtaggaaggcatttgggccatgttggtttcctaggtgctgatgtgcggatgagatgagacatcgaggtgagatgcgcacttgcaggagatgtgaggttcccttggttaaggacaacgtggtgcaggaattggattttacagaaacaaatgtcaagtcagaaagagaagccagtggccagtctcctcaccacatcaaaatgtaatagcaaggaaaacagcaggcactgtagtttgttcgtggtttggtgggccaggagtttgaacagagtacaagtgatgtttgcttctgtttcatggtgctgggttgtcctgagtggccaaaaatgactatgacaagctcccctagggccatatgtctagcacttcagttctttctcaggtagcatctgctggggataaaatgcccaatggctccagtgtttgcatctctgactcctgagctaaaatgactcaaacatctggagcaagctaatattgttctttccccatgcatccaatgggctcccttatagcatggagggctcagagcaatcagatgtcttctatcataatcagcttcccccagagagagtatttcaggaacatcaggaaatgcctattatcttaaaaatgaggtctatgtgccagcatcacttctgttggctgtcatcactgggagcagtcataggccaacttaacttgaaaaaacttgaaggacagattccatttctctacaagagaaatagcatacacatacaggagggaaaacgatcgatggtgttaattgccatctactgtataatgcagcttctcttgtgaggtttgagatgtactaatctgtaggtgtaacaataaatcgctaggagttgatttaacactatgcccctttagtagcaagctgtcccctagaacctctggccaatctagccatgggttcttggcctcaataacttgccagttaacacacagagaatcataactggtcgaaatgcagggaataagagattatgaaatgctccgccctaaatgggacatctgtaatgcacacactccacccagtttctagatttggggatcattctagaagaataagctgaaggttcatgggaggcagaggcagtgggcactttcaagaaagcggtggttttcagacacggcaaggtagtttcacatatgaagtcacagagagtgagacagcatgcttaagaccggcacaagctcaagccagaaaaattccggcatatttgggggagacagttatcaagtcccatttctatccaaagagctattagtaattgacagcttccaggaaaagggagaagtcattttctttaaagatatggcacccataggacaaccttactctagtggatggccccttatcccagagtatggagcccgaacaaatttggataagatgagttaaaataaagagaggatatgaggttaagtgtgtataggatgaggtgaaagggagagggcagacatgattaagcttaaagaatcatatgcccccaaattactaaaaatatgtagtttttaaaagattcaatggtagtcatcttagagacaaactggcacactattctaaaagaagaaaattaatacataggggtaggggttaggaagatgtctgctctctgctctcgctaggagtcagtatgaccaatatcaatagttcacaatttaccagtctcaacttttgttattgttaactctactgctaccaataaatagtttggtaaagtatctgcaggtttcctgactctagaaagtttctttttctctctcttgataaatacatactttcaaagagcagcccagcactagtgagatggcttagcaggtaaaagtgcttgccaacaaacgtgatgacctgagttctagtcatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnatacatacatacatacacatcatacacacacacataagaaatgtaattaaaagttttaaaaacaagagtctaaaagtattgtcttttcctagagcttccaatggaatacagagtgcgggaattatgtgtttgtttttatatttgtggtcttcatcctccctgaagccaagtgctccctgtaatctcattccagtggacacacctttgtgaatggtttggcctattgtggtacttgaactattagctccttggtattaagtggtaggagatgaacacagacaagtgaacaatgggccatgtcttaaagaatatgaaaaagtattggaatgcattggtttctgcaaggagctaaggtagatgttaaaaatagagagaaaggcttgccatcagttttgtaaaggtcatcctggtgactgggaggcaaatgtgctagaggtagagtagctgaaactgtgcaagaaagtcttagttttccccagaaaccaggcttctaggaaagtgcacaaaatgatgatgtataccaggaattttgttatacacacatatacacacacacactcacacagtctctctctctctctctctctctctctctctctctctctctcacacacacacacacacacatacacatatatatatatatacactcacacatatacacacatgtacacacattcacaaacatatacacacatacacacatacttggagaattaccagccaacacaaaaatctcaagtgaccacctccttaaaataaaggtgtaagagagtgttacattctttattttctcattaatttatttattcacactacatcctaatcacagcccctttccctcctctcctctgagtcccaccctcacaagcccctttccctattacctcctccccttctcagagaaggggaaccactccctataggtaccaaccagccctggcacatcaagtcacagcaggacaaaaggcatcctcttccactgaagcccaacaaggcagcctacctaggggatgggatccaaaggcaggcaacagagtcagagacagcctccgctccagttgttaggggatgcacatgaagaccaagctgcacatctgctatatatgtgtagggagcctaggtccagcccatgcatgctctttggttggtggttctgtctcagtgagcccccatgagcccaggttagttgactctgtaggtctttctgtggtgtccttgacctctctgactcacccaatccttccctccactcttccatcaagctctgcctgatgtttagctgtgggtctctgcatctgtttccatcttctgctggatgaagtctctctggatacagttatgctaggctcctatctgcaagcatagcagagaatcattaatagtgtcaaaaggtagttccctcccattggatgactctcaagctgggctgatcattggttgaccatcccatcgatctctactccatgtttattcttgagcaccttgtaggcaggacaaattttgagttagaagggtctatgggtgggttggtgtcctcatctttccaatggaaatctcacctggctacaggagacggccatttaagttttcttctcacaatctgctaggagtctcagctagagtcacccccatagacttctgggagcctttctgtcccaggtttctggcttgtcccagagatgcccccccactgatttctgttctcccccccaccagtcctcttccactcccatcccccaaatgctccccatccctggtcccttctatgccccttctcccctgctagttccctctctccatccagctctcatgtgtattttatttctccttcttactgagatttaagcatcctcccttgagcactccttgttacttagcttctttgggcctgtggattgcagcatggttctcctgtattttatggctaatgtccacttataagtgagtacataccatgcgtgtctttctgggtctgggttacctcactcaggatattttctgtttttaagctctgggtattgattagatcttctgccttgcttcatattttcttggttaatcgatagcttgagagcttgatacctgaagtctttggacatgtttgatttagcaatgagtgtcattattcagataatatctcattgggacagttcagtttttgctaggtgaaaaccccttttcatcttcagggtctttgatctgggttagatgaaattccttctgatctgtagatgtgacagaggcttagaaagtaagagactcattccagactagcagtcactcctgtccgtactgcagtggggaccccagtggtgactcttcaaccagctgtgccctgtcagatacatctacttgcggatctgatctctggctgttgtcactgtaaccttatcattctatcctgtcactatcctttcaagtgggtctatcggcacaggtttatcaaacaactcaataccattgctatactttttatgaaaatacacttggctagcctgtcctgtgacttaaagatgtaaatctcatcatgtgtgctcaatcagccctccccaccccaaaccattccctattgctcttagaataaagttgaaatgcttctcatagtatatagagacccagagtgagctgacatctgcttacatagttagtgggggggggggcatatgtgtagttacacacatgatcacacatatgtgtgtatgtgtgaggggatacacatacatgtaaatccacacatgtagagaccagaggtcattgttaggtgtttctttttcaatccactttattcactgattgtccagactgactgctcagtgagcccctggggcttgctggtctccccactgtgcacagctcttctgcgtggaagttaaggatctaaactcaagtcctcactcatccatggcagacagtttactgacagagaatcctctttgccccgtatacctttgtctagaggtaggacctctccttgaacctgtagctcactaatttttctagccttggccaatcaacaagctgcagggatcctcctgtctctgcttccccagggctgggattacaggcagggaacaccacacccatgtttgtttctgtggatcctggggctcaaatgagcatccttgtgcttttgtggcaagcactttaccagctcaacatttccccagccctgttgatgtctttaattttatctctagccactgactagcttgcttaatacaactagaaatattaacttttcccctgtgctttgaaaacacacacatttttttcactttttaattaggtatttacttcatttgcatttcaaatgctattccaaaagtcccctataccccaccccccaccccctgctcccctacccacccactcccacttcttggccctggtgtttcccctgtactggggcatataaagtttgtaagaccaaggggcctctcttcccagtgatggccaactaggccatctcctgctacatatgcagctagagacacgagctctgggggtactggttagttcatattgttgatcctcctatagggttgcagaccttgggttctttctctagctcctccattgggggccctgtgttccatccaatagctgactgtgagcatccacttctaaacacacacattttaacaacatggatgctcacagtcacaattacattgcctttttaaagaatattcttctcccttgtcttttaatttttagccaccattcaggtctgtgattaaatgtcaactttgaaggggggggttctaaatatctaatctaaacaagttctacttttttatttacagtttttaattttaattaaaatctaattatattgcttttcatcatccctttcctgcctccaaccgttcctctgtcatctgcctccaattcctcccaggtcttctcaaattggtggcctctttttacgtgattactattgttataggtagaaagtcagacagatgtataaatatgtaaatataacccattggatctactgggtgttgcttgtgtgtataggatttcagggctgactgttttatattggataaccagttagggactctaatcagtcattagtttcctaaagttctttctctagatgtaggaccctctaagacttcctcttccaacttatcatgattattggtactgccattgtttaggtcttttttaggcagccacattgttgaggtaacatgaatatagcatccctgtcatttctagaaaacacaatctcacagcaggcttcctggggtttggatcttacaatcattccatctcctcttctgtgacatttcctgggccttacgtgcagcacttgtgttataaacatatccactgggacaaggctctccctgagcagttgatctttgccttatcatcagttgtggctttctgtgatgatcttcatttgctgcaaatcaaggctttttttgatttgatgtgacagtatacttatctgtgagtacaagttttagaatgcaattaggaattttacaggtttagcaaaataagttctccactaaaatccatgacctcactagtcccagtagttccctagctttctagtaccagacatgatttctcttgtcgtgaggatcttaagttcagttagacagtggttgattaacacccagatataagtgccacttgtacctttatcttgccgtaatgttcattattgtggttcataggcatcaaaattgcataacggtgctatctgtgtactttgcctctcagtatatatcagaaatgccacatttgaaaagacttgtttattcttctacatgttttgtgactaatagcaacacctttagccagtaaaatcacaacatgtagaaaattcacttctgttttggccaccaatgcattcttgaagattatgatagtatatggtataaaatagataatagataattatgtgttccatgaatcatttgttaattttgcaatcaagatggaccatggtggttctttttttttttaagatttatttattttttatatatacagtggtctgtccagatgtatgcctgcagggcagaagagggcaccagaacttcttatagatggttgtgagccaccatgtggatgctgagaattgaactcagcacctctggaagagtagccggtgctcttaacttctgagtcacctctctagccccatggtggttcaatttaattattcaatattcaagcaactattcttaatgcattgctagaaatgtgaaggattgatgactggaagatttgtaaagttgctcctagctttaaatcctatagtagaggaaggaggatcaaagaagagataattatactggtctggaaagggcatcagatgcatttcttacaaagctgtcattcaagtatctttggctttgccagttctaaaggtcccatccccaaatgatcacttccttgggttccctcacataaaactcttcagaaccactttgtgggtcctactgctccctacttgtaacttctccctatgtcttttccaaggttttaaattgctaatgtctaatctttccccagtcacagattatccatcttcagttttatgcctttatgaatcttgttaatggctggcagaatctgaaaagttatcttctctttctgtattaagcagcatgcctagttgtgttataagaaggtattaacattcattgactcctaactatatgccaaggactgtgctagatcctgtcgtatgttacaccagacattcttcttcatctgtgagatggtggttgcggataagcttctttggcaagggtagagattgagattcagacaggctgtgtaacttcctccatgccacatagctatcaagtggcaaatccggtttgaaaactaatcttttggttgcatatgattctgctatgatactgacctctcccccagatagtgagaaataatcacataccctctcaggctcacgtagaacagtgatgttttcaaatccccaaatgcagtctattcctaactctatttgtaagagtccattaaacccttcagattgttgacatggtcacattcaacaatttttcttgggcacctgttcactacatactaacatgtcatagtttctgtaccacatcagtgaataacacagaaatataaggttgctttctgagtctttctgaaggccacattccaatagtggcaggaagtagagagggaatgaggaacaaacaataaaaaatgaataaattatatgacatgatagaaatgacaaatgctctgaaactgtgggacagcctgagtggtttagtcacaagtagtcaagggtttggtcttgcagaaggtgggatttcaccaaagactttagaaagacaggagatgtgtcagaaaagcatccctgctagaggattccaaaacaagtgtgccagatgtgttggcagagaatctagaaagccaaggtcctgtcttagctttaaaggtctagagaacaaggttttaatgataaaaatgtttgaaattgtgtgaacttatcagtgcagagagtggagcatttgagaaatagggacttctctgaattcagatacttccaaaagacactactgtgaagggattgaacaacaaagacacagggggcagaaagcgagtgagtcacccagggtaggaccatagagatctttttgaactccatctcctgtttagagtctgatacttccatgccagtcagactcactgtcttaatcctgcttggcaaggacccagcaaaatgctgttaaggatgctggctggtgtagtcacttccattgctgttttctgaacttgttgttgttgttgttgttgttgttgttgttgttgttgttgttttaactgaccagagatgtgctgggggtttagtcacaattccaagtcatttacttatttactgtggaaatttattaggtaagctgttgtttagcaaattcaaattcatcacattacactttttacttagcagaatcacttcattagtgccttattactggaattgactgtcaattatgtggttaatccatttacttaagaaatgaatttttttaatctaggcaaagtaattcaaagcccattgttaactcttcaatgattaaagattgctgtcaatgccaatttatgtcatcaggaaacttacacgtttattccccttgaaatatcagatgctggaaaaacactatgtaaaagtatagagagtgtagcctaggacctactataaattagaagcattcactaaatagaccaggagaactggcaaagctaaacaaaatcaggaagctttgcttgtacccattggaataaattattataataaaagcacacacatttttttaagtttataaatttttgttttaactgtacttttgggttctcacaaaaacattgtgagataattttaagatatgtgattggcagcctataggatgaccccagtgattcttgctgaatattctgtccatgtatcatccccttcctgtgagtgagggctacatctgtgactggcttctcacgcatggacaatgacatgattaaatgataaaaatgtcccttgggtccgaccatcagtatttgtgtgtcctcgagggaaaccatcagcttctggttgtgtgagttctatttggtcaccattcaactatatcacactgaacattttcacttatgaaagcagaaaggaaacatagtcaattttatgagaaactgcaggacactgcacaaacaattgtattatttcctagaagttccctgctgaactgtccagtcccttgccactcaaagtgtgctcgataactagcatcctcagtgtcactgaagggcagctagccatgcatattcttaagctccgtgccacatctacataaccagaatcatttcacactatctcagagacatagagttcagggaacattagtctaattcaatatactagtcaagtctaagataaacagagttgaggaaaatgagataattcagtggcaaactttggatgaagagtctggtcttggaattcctaaatggttctttctcctctatcaaagttacattgtctatgtagcaaaccgtacccacaaacgcttcctaagtatccagggtacagtttgaaatggacaaggaaatcttctaccttgttataaatttacattttctctcccgggcaaggttagtcatttcattttctctctttcttcccatcaataaaagacaaagtcacctgtcaaactggagattgtaaaacctgtcaaaattgaaactttctagtttagctaaatattactctgcaactattttgcatgtctttgtcttattacaattttgatgaatgagagagaaaataagcctgtttctttagaggaaaacattacttagaagtttattgtttcctccctcctatcagtgtgagagttttggaagttagagataaaacacacacacaaacacacatacacacacacacacacacacactgctgatctgagttttcagtgtgtacacagtaactttaggaccaatgagaaacttcagataatgtctagcctaagctgacatcacactgacatgagagatggatgctgaatctgggtgggactaaacccactagaagcatactttttggtaaatgtggcttgctcactccttcacactttctaagacaaaaaaataaaaaatagaagcaggagcattaagacagtagacagcccttgccatgttttccagcaggttagaggacagacctttggcagaacaatatactggtaccaactcatgtcccagagatagactggtgcaacaggtttgtggcatctattgtcacagagcttacagccagctaaaggaaacagatatgagacagcttcactgccagtcagtcactcttgctattcatgaagatgacatatgtccaaaaagatgcactgtaattcatgaatgtgatgcaattgtcagggtataatgtaggaccctcatatggaaacagacagcggtgtctttcttgatatctttattcagaaaaggaaaaaaaaagtagataatcatcacctagagtcttctgctaatattttactagacttattttgtcatctatctccttatccattaatccatcttgattatattatgcttgtcaaagagagtttcagacatccgtacatttcccctttcttctggtactcaactgtacatcactcaggaatctatttttttccctttgaaatgttttttttttctgaaaatagattcttctctcatatactacatcctgaccacagttttccctcactccacacctcctagctccctcctgcctcctctcttcccccagatccactcccactccatttccttttcaggaggaagatcagacccccaagagacaacagccagacaagacaaaacaagatataataagacaagtgaaaaccctcatattgaggccagataaggcaacccaataggaggaaaagagtcttcagagcaagcaagtgagtcagagatacagtctttctcactgtttggagtctcacaagaacaccacgctaacagccacagcatatatgtagagaacctggtgcagacccagggcatctttggaattgtggccatgatgttttcagccactaagagggacaggtaccagataggaccctggtcatggagagaaggatccctcttttccttctctgtcatattaacagagatatgatggccaaacatgtccctgtcttcaaagattttttctaattgaagtaacagcttcactcattatatcattttcaagtatatcgaatttcctatgcagattgttcaagttgtcaacagtctatcttagttacttttccatcattgtgctaagaaaccatgaccaaagcaagagaataaaataaatgtattgggcctacagttttagagagtgagtccataattatcatggcagagagcatggagcatgtaagcagacatggcactggagaagcatctgagagcttatatcttgatctacaagcatgaggcagagagacccacacttcctccaacaaggccacacctcttaatccttcccaaatagttccactatttggagatcaaacattcaaatatgtgagcccatggggtgagggtggttctcaattaaagcaccacacagtcctagcaaacacaggatctctcttggagaataagcaactaaggctgtcgtgggagcaatggcttggaccaaagtatataaggcaacatgaattttcctttgactatttattttaatgctggttgttattctgtcaaaaacagcaatgacatcaggtcccatctgcagtcccttgtgaagcctcaatcaatccttttatctatgactcattctcttcctcatataatctcattcttactttatacataaatgtttcctaaataccacccccaagttgtccttttgtgcttacagaaatatcaaaactgcacaaattacatgtcttcattacttctgcctgtagtaaattactgaccaagatatatttttcagatttccttgcagattttatttgcactagcatgtcacagacacatactgatgttccataaaattcgcagcgatagtcattcttctggtgttcaacaatgctacacttcttcctttgcacattccagtctcccctggtaaaccatacactctctgaaaggccagtccctatcagccaacatttttaccacatcttgttattggtttgtacagcatttttgaatggtatttcattgtctgctttggggtattttttttttgaggtgaaagttcagcatttttttcaggtccattattttctaacataaatgactctgaaagtaaaactgaatagagcacatacaagaatggaacagcagacatatcttactaaaaggactcttgttcccactgagctaaaacatcttaaaagcccacaattatagcccttcctctttgtggtccaacaatatgtttgcagactcccataggcaacctccagcttgattccttacttcccagttagaacagtaagtggttaagaccacagaacacccttcacatggcttctggctcaccgaacacccttcattttggcttcaattatattaagtgtataaaacccatgcggcagaacactggtattagctcttctgctatttcccgctgactttcatgaaattgtgacaaaaagagaaatcaaagttaaaaaaaaaaaaaaacgtaatagtgaaactcattcaccaaatgaaatcctctcgggaagtctatcttttaaaacattttataaaggcagttagatatggttagagcagaagtagaaggaagcagggcatactcacgcatgcacgagcttgagtgtgcgcgcgcgcacacacacacacacacacacatgcataaagcccttcccaatgccccagttcactctgctccacaaaagaacctctgaagcaggtctgctttcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggtgaaacttcttacttggatatctactcaaaacaaaacttaacaaccccaactgtcaatcgcccacaccagtcaaaaccagtggtctttaatcagaagcatgcgggtcactgggtcactgctgtcaaataatgaccacaatgtcagctgactattgtggtcccatgagagcctacatttgagggccactggaagagatgggaacccatctttgagaccctgacaacatggagtatttctcaaaaacacttgcttgttttcatcgttgctatagtcactagccctcagcgtagacacaggaaagaggcaccatggccagtgttaagttgcaggatagactcttggaacaaaaccgtctctgtgtctagattactgtctatccatttcctgactaaatgttctactatagttctgcaggtttcggctttgggagaaggtaggggaaggacatagagaagcctcatatctgatatcatcactatacattgcccatactgtctggccctgaccttgtccacagcagtactgtgtccagtatggctttcccttggcattcctccttcaccaactacgcatgctctaccactctagcattagctaaccagtttatctgtcattttctccacaatcatttttttttgtaaaaggtttgttattagtttactattcccaaagctagaagacaggtttgcttttgtttcagcctctttcctgtatccttaatgtctccctatcccatcaccttcatttcggggatgttttatatactttctgctctcaaggactctatttttcatctctagaagttggttttgtatttttcaagtctgcctctctgtctctgctctgtgtcttgtatcgttacacattcatatttcttcctccccccacaaccctcactttaatccatccaaatgtatttattttatggtgtctacaattgttttattattttcaattcttgggaggcatgtttcttagcatcatgtctacagcttctcccctcacggggataaacttgtcatctatattttatttttcaactctgagttcatctttagtggaggtggtgttgttccaagataaccaactaatgtgccttagattataaaagtgcctctacagactggttgctcatttgcctgtaagatcagcgagatttctagtggtcttggggtttataaataaattctaggtttacagtagctctgtcacacaagtaacaagtgttttggtgtgtgtgtgtgtgtgtgtgtgtgtgtgtgtgtgtgtgtgtactcacacatgccgcacacaccaggcacacatatgcactccagtatgtgatatgtactctagtgtgcttgtgctaacatgtagaggcaagaggaggtcctcacctctcctgctctaacacagcctatgccttgttccctttagacaggatctctcacggaacctggttagcctaggctgacagccaacaagcaccagaaatcttcccgctcctctgttcctcccagtgttaggatgacagctataaatagctatgccaactttttacatgggagctgggatccattcttgccctgtttgtgcttgtgcatcaagattgagcttgtctgagcaaccagaccacatatatatcgcccccagagtatcacgtgatagaacttcaacccagggttttcttccttctggtgtttgtttgtttgtttgtttgtatttgaaacctgtacgcttttcattttacatgctgatctcgttgacttacccaaatacaaatacaacatgttgagagaaattacatactctaacagcaacaatattaaaatattacacattgattgtaatacatgaaagataaaagaagtttacatagtttttatttcttattatacattgggttttactgataaaattagaaattttagtcatgaaattttgtagtattttttttgtatggctttttctcaaggttttgatcttcattctatttaacagtcaccatacctctatttaagctcatatctctatttaactgagttttcgctgtttaatgtattcgtattggttcttttttgttgttgtttttgttgttgttttttgattttagagacagggtttctccgtgtagccctggctgctgtcctagaactcactcggtagaccaggctggcctcgaactcagaaatccacctgcctctgcctcccgagtgctgggattaaaggcgtgtgccgccacacccggctttgtttcttttattagatgaattctttggttctttgtgtgtgtgtgtgtgtgtgtgtgtgtgtgtgtgtgtgtgtgtgttatgtcgttttgttttgtttcaattttaaggtctttttttttctggaattctatcttttgcttgtttctcacctgtctaacgctctggaaaagaaacaaccagtacaactctggaagctcggtgtgccagagaaggcatttctataaccctacacgtggaaaaagaacttatttcagtatgtaatcttggatccatgcctttttcccttcaagaactttatgtaaattacttctggcctttaagactgggccagagaagatgcaataatgctgtttcttttattttagaaattgttgggggttttagttggtttgcttgcttgcttgcttgctttttcagcctaaatgtttgtctgagccattctacatcatgacattttaagacctggattggatttaggttctgatttttaattttatggggaaaaactgtacttggaggtctttttttggtttggggctgttgggttttgggaggttggtttgggtgtttgtttgtttgtttgcttgcttgcttttctgccaggagctgtgtctacatggagctctgtctcataactcctgtccacttactctgctcttttcttttgtaacacaattacccattgtctacatgtctgttttcactcacacacacacacacacacacacacacacacacacacacacaagtataatgatgaaataaaagaactcgtgtgtacatgcacacatatatgcatacaaactgtagacccactaaatgttggtcaactgcttcttctaagtgtgaggcctgccttcctggagtaattgatatacctagtgttactcaatggagaaaaccaatctttcctctcctagaaggcataaataaataaattacagtttggtaattaacctttaccctagtggctagagttgcatttgttgtttgaaagaatatataataaaatataatagggtaaaacaaaaaccatcacctcaacattggacaggaacaagggaaagaaacgagccaaagaaagggcataggaatcaaagacccacttatttccatactcagaaatcccatacaaacagtgtgatggtttgtatatctttggaccagggactggcaccatttgaaggtgtggccttgttggaataggtgtgacctggttggaatgggtgtgtcactgtgggtgtgggtataagatcctcaccctagttgcttggaagtcagtcttccactaacagcctttggatgaaggcatagaactctcagctcctcctgcgccatgcctgcctagatactgccatgctcccaccttgatgataatggactgagcctctgaatatgtaagccagccccaattaacttgccttggtcatggtgtctgttcatagcagtaaaaccctgactaatacaaacagtaaactggaaaccatgatataagcacagaggacctggtgccaacctgtgcggctcctgtgaatgttgctgcctcagactctgggtttgtatgagctttgctcatgttgatttagacatccttattttcttggtgtcctccatcctctctggctcttacactcttcctgcctcctcttccacagcctttcctgagctctgagtggagagatttgatggagatatcttatttagggctgagtgtcctatagtctctcattctctgtgtaatgtttggctgtgtgtttctagatttgtccccatctgctctaggaggaagcttctctgaggatgtctgagtaaggttctcatctacaagcacagcagaatatcattttatcactatattttttaagaccaatattatttggatttaccttaagttcctgggatgactcgtctagggttcttggtcaccagtgcagtgttgggtatgcgttctaactcacagagtaaggcttaaatccaatcagctatttggtggttactctcacaagctttgggccaccattgtcccagcctatcttgcagatagtacaccattctgaataaagggcttgtggctggcttggtgtttatgttctttttttagagtaggcagactacctgcctgtacccaatacacaggaacataaagatgaaggctgtctgtaggcactagctctatcatggtcaacgaggtttgtaggtgttatcttcaacaatggggccttgctgtcaatttgtggagagcagcctatagtctggacaacctagttgtttattgattcctgtggaaccctttgggacaacaacttagctaaatgtaacccaatcccagtactggaagcttcatttggtgacaatagataggcagttgagaccctgccacctccaatattggcaacttcatttagtttgacttcatacgtgtatatattttaggaggtgtctactgttgtgtttataaaaagataaaggagaaaaggaatacgttttggtggatatgtggtaaggtgtgggatagggggtggctacatggacccatgctgaggcatcccttagccccgagggaccagtcacaaaatggtaaaatatagaatagagtttattctaccaaggcatgggaagggggggttgagaggatagtagagacagataaaggcagaggagaggtggggcaagaggggaagggaaggggaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtactgaacatgctcaacgggaaaaagaaactgtcttactaatcttgcctttcctttatttctacatatgctctcaaacttgactttctaagattttctaagattttagagatgcattttcaaaatgtattttgctttctatgatataagctaatatgctctaaatagaagaagccatgtcagattgactgcaatgaaaagttagtgaattgtctaacagtaatacaaaaatgaggatcagaatacgttccagatgggttttcaggacccaagttctttcagttcttcaaatagcatctcatcttacattggtgccaccccaaagctgtctcccagcatgaagacttgactattttagaagttttgttcatcagacccagacatgatggtatctaactgcaaagacaggtagctggataagccttctcagctataaaaatgttcctaagactttcctccaatttcattgactgggcaggacctataaggagcattaggacaccccaattgacataaagaaatcaggatattctcatggatcttggaataagttcctgagctatatcagggaggtataagcatccaaattaacttggggtccctaccagccagaaaagctcttcagcaaagagtaaacacaggctgctattcttctaaatagtgtgatttaaaaaaaaaaaaaagaacataaattttcttacagctagctaacatggtgcatttttcatgagatcctattcttgtctcatttgtgcttatataattttaaagaaaagaggagtttctctggtgtttgtcagtaaatacggcaactacgctgcctttgttttacactggtgacttttgcgcttcttctcttgtgaggtaagcagaagcaatggtcattcacagcccccatgccaatgcatgagccttgacccttgcccccggcacaagtactcaaggagcagtacaagctccccctcagaggagaggcatggattctcatcagaaagaacatcacaggattagcatcttggacacaagggtgctttggtcggtctttgtctctgtcaaagattgcagtggagaggtttgagggggagagaacaccagggcaggtgctacttctcatttggttgttggtgtctttgatttctctgatcctggaaagaaagaagaagttgagatgtttcttttctgttcttcagaccagtgatttttttttctttttaaccttgaggaacaaagacttttgatatgagaactcaaatatgtcatgatcatttcagctctaaaaaacacatgcacaccaggtaacattctacatgctgttttttacatgttcaattagacccatttggtcaagtacatgaaagcgatacttgagtctaccagaacattgagtgatagcagttcatcaactgggtatgagatagccatgtgtagtgagcggccctccctgataggccacaaatctcatgtatccatcctagaataagtctcgatctcaaaaaaaggggggggtcataattttgtataatatgacatcaaaccacaatccaactgcttcatcttctgatttaacaaaaatcaaacaaaagcaacaaaaaacataattgcttccaactcaaggtggtgggaagtcagaactgcctgaagctggaaagattattttatataaatgcagagattctaaagaaattttgacgtttttatctttgtgcatatgttaagtatgatggtgctataatacacagatactcctcccaaattctggcacttaggttggttgacagacagatttcagttctatggtgagtttatcatatggttgtattgctgtttgctgagagaggggaaggaagaaagccatctcctgctggcctggtactacctggagactttctacagtggaatcccatttaacctctgcaatgaccatctagatgataatggattgaagacgatgatggtgacatgtaatcatggtcatcaccatcagggattacaaacaaaaattttaggccctctataacttatttgaggtctcatagctgccaagttgtgaatttcctgtttgaagccaaggttttctcaaaccttgtgctttgactatcccactctattcccactgtactggttctgctcacatccccacagcaagcaggtgatccagcctcctcctcctttaacaccctgtctcctctcagactctgtgctcccagcaagtagtctagatatttgccatccagtctctgtgttttcctgccctaaagggcacatggatttgaaaagcattttgatagatgtgataagagactgatagtggtatcagaaattacaggaatttggttgactggttcagacatttttgtcttgactctgtgaagacttttggtgaaaatgacttgactgtttaaagcgaacctataaaagcagaaaagaggtattaggatactgagagagtgctcctgtcagaaggacccaaatcaggcagaagcagtgggaaaggaagagagcagaatgaaatcaaggataggagaaagaagctactctgctgtatttgtctttgttgttgttgttcattgctataacaaaatacctgaggctagatattttataaagcaaatcaattcattttgctcatttttggatgctgaaaatctcctttgctcactgctgagggtcccttggtaccccctaactatattttagcatatcagaaggtatcatgacagaaacacactcatatggtgagaaaggaaggcagtgaaagggtacaggccagttttgctctcagtaacaaccctctccagtattgaagtcaccaggaaactatcttctctcactattgacactttgaaaaccattggggaacctcatttaaaccatatgtaaactgaaaccaatgcccagaagaccacctggattccttccattgtgtgcattctcatgtgcctttgggacattgtgcataatatccctaacacagcttccattctttcatttggtaataggtattgtattgttcagaggagttatcaccctttctgtctttgagtcctcacacttatctctccagtgtggaggagaatgggcagagaaacggaggctcagaaaatctaccacttggcctaggtcacagaattatgattgctcaacccaggatcccagccctgttctgtcaggacccaaactcagcatctttcagactgtagactctgaccatttctgaaataattctgcaaacattttaaccaagactaaaatgaaactccacctgcccatgattttatatggtaccttcattcataatgaagccaagtttcaaaaatgactaactgctgtccaattgcagctagttacgttcaaagtcattgaaattacagatgtatgccttcagtcacattgtctacattttaagtgttcagtagctatgggtggcaaggagctgccttgctgaatggtgaaacgacacaagccttctgtcgttgtacaaagttttattgcagagtacttgggctagagctgtcttacataagaccaatatctctttatttagagtttactcaagctctaaataatccctctttaggattttatctggctctagataggtctctgtgtgcctgcattgtccgacaccatagccattagtcaccagtgtcttctgagccctggaaatatgacctttgtgactgaaatactccagaagtgtaaggtacacactagatttcaaagcttttctatcaataaagaatataacagatagcattaataattttacactgagcatatgttgaaatattactttacatgtcttgagttaaaaaaatactgttgaaattaatgaccgatgttcatttttaaaaaaaaaatgtatttaatgttgctacaagaacaatttcaattatatccatggcatgtctagtacttcctccagacaggctgctgtagatccctttacccatctatttgactccaaaacacaattcttttttctgtcttccttgagatctttgctgtccagtaggtacccatatgccacacgtgggtatttcttctctttatgcctgtgagtgaatatattcctatgtgtctgcaagggtgtaagtgtgcggggtgaggatatgagtctgtttgtaggaagccagaggtcaacactgcatatcttattctctcatttccactatatcctttaagactgcattcctcattgaacttggaggtttcttctctgccttcagccagccagcacagtccagccatctctggctccccagcccagggattccatatgtatggcaccttgtctggctgtttcattttacgtggattcttgggggaccaaacttgggacctcctgcttgttcagcaagcacggtactgagtaagccatctcttgtgctcctgcatgtggatgcttctagtgaacttaattgaaactaaacaaaatttaaaatttgcttcctctgtcacattagccacagttctgttcctcagcagttacatgtagttaatggctaccatattgcaaggcacagatggaaaatgtctctattgtcacagaaagttttatcaggtggtacccacatagattgcatacagagatatcacgaggcacagaggtgaatgatgaaggatacagctggtttccatggcatctaaccctgcagcacatagtcctccatctcctaggtacctgcttagcctcattaggctgtgtacaacttatctcttcatctgccttcctgcaagtgctttatctccactgcaacactcctcacctcacccacccaccgctgtgtcctgtgtgtacgtacatgtggctaacttggtgctttgaataagacaggtatataggaagtatttgttaactaattgaagcggcaatgttaatcaaatgattggaacacagtggctgaaactacatggaagactggtagcagaatataggagatagggggctagagggaaggactatgccaggatcctatggaggaaagaagaggagctagcagaaagacagaagagaggaaaacaaagagaaggatagataactgttaacccaaatcttttcagtatgacccaaagctttcttgaacccatctcacaagctccctacatagtgatgagaggtcttacacagactcagaaagtagctctgtaagaagtacagaagaaacaccaaatattatttacatgatccataaatatgcaagacctataaatgcagaatatgaaaattgaaggcctgatgaggagggaaaatgaaaaatggcctctccctgggccagctggtttgagttacattttatgggcagtgtgtgaattctggcgcccttgttgaatttgcggcagactcgcacattagttttaaggctccctctcgaataggaacatcataacgctttttaattggtgctgataaaaaacgtagcattacttgtaggttcctgagagaagcgagttgtgaaattgagttttcattaaacctaatgacggaaaattaagcatggtgcgtctggcgaaatgggccgtgataaaaggcgtcacttctgcattatcgaaggttaataagggaataggtgaggtaagatccatgggaaaggggagtccaactagttggattaataaaccttgaaaatcccttggttccgagtcctcctggcatcattagtgtgtcgacatcatcacaaatgttgcagcaatacaagtgcttacatttcaaatgcatctatttttccatcccactgttggttttgctgacaccaagtttacagtctgtctagcaatgtgtttaggggaaaatatccatattgatagcctttttagtttgggaacgtttggcgtgtcacaaagatttgccaggtgccaactcccaggaagcctgcctctgccaggcagctggtctcccatacagcctgcaccctgagtgctttagaaaagataggggcagggcatatctctataaagggcacatggtggtgtttatgtggaaaacacaggttctaggcattgacttgatgtcattgtgaagtgtggcatctagaaactcacactcagatctcccttcatgtccatctccactcctatcacacaatcacaggagtgatgctcactggaaagacacctccagtccatgacagctgcgacacccatgggaaagagagtgagtctttaaaaagtgggactctcctgcataaccttcaatggcttcatgctggtcctgagtcctcgtgttctcagcccttctggatcttcttcatgtcgtctgctacagcattataccatggctttgtttataactgtgtgtctgcttttacttaaatgtaccatcatctctcaggctctgatcttttcgcttcagacaatttttccttctagaccctctcataagtctaactcacaatggcaagggtataacagaggaggaactcaacctcaatatgtgccaggaattatatacaatcaatgctagtaaagatgtttcttacttattaccaagccaagggtgggaaggtagggagtactattctttgtgcagccagagagactgttttggtttgttttgttttagcatctcactttggtctttctttcctgtgtatgaacttgtatcctcagtatctttctattggatgattgggctaattccgagaagccaactctgtcttatctactcattgcattaaaacaggacatgttgaaaccatgggaaacacacacatacctcatccactactgaggtctgatccagtcagtgtctcaagcacagggcacaggctcatcaaatccataacttgctctcccatggagatgatagccagtggagtcagacagaaggatggaaagtgaagaatgtgtgtctctgacttatccatgacatagatgaacacatgagggtaaccaagacttgcattctcccagaactgagggggtttccctgaacaatatactttgaataccaatgacaagccaaagaggggttaggcaagtgtgaccaattggtcatcctgtgagccagacatgtctctccagtatcctatcctgtgaggaactgattttgatatcatcacataggagcagactgtgttttcccatagactctgtttgatggattattgtgacaggggagacaaacaagctgaaggggacatggcttttaaaaagacaagttgcagaaaaatctggaatatgcactaagtctctcagggaaaaagcataacacaggcttcatggatgtctgcatgggaatctcaatgtctgaaaacatctggatatacccatcatctgccacatctggaaggccttatctcgtgcatggtacaaacagaatggccccagggcacagactgtcagagtattgaggaggatataaacatgccaagcatagatggtctgggaaagagaaatggtttccaaagcgaccaaacaaccgaacgcatctgaatcagctcatgtagagagatatttttatgagggaaaagtctaactttttttttaataggtagggtctaatatagtcaaagctggcttcaaacttgctatttagtttggggtgagtgaacttctcatcctcctgtttccccattttggatatctaaatagcaagcacttgcaaacctcgtattatatagtgccagggaccaaattcagggctttgcgcatgctcagtggacactaccaactgagggaaaatcccattgctatatcaaggggtgtggaataggacgcccatgagagtgaagaaagaagtttagagaactctacaagttgggatcagaggcatatcagggtcagtggtagtaagggagcatatagatggtagaaagaaggtggactcagtacagagcccattgctacagaggggctggaggattagagggcctgctacctactgggtgcacaagactagctgtacttctccccaatgtacaatgcaaaggaaacaaactaggagagaaatcagatcatagatacacaatcccagaagcagtcaggtggatcttctggccagggacctgagactcccctcacccacagacaagcagctaagactatctatatccatgcctgcagtttcccaaacaagaaggttctcccaggacttagcctggcttcttactggttctgagattagctggtattggccaaggcatttaagaagcctagagaagggctaaggataggacgggcaagggatagtcactaaactgtcactttgtctttaagcaatcaatgagcccttgaagctgaaatgaaccaagaacccttgcaagctctggtttgtaattccaccattcaaatctgggcacaaggccaagtcggggaagcagtatcttttgtctttctatacttttctgaccagtggagtgcacagctccctctgccctcctggagcctcactgggactgggggtgaggtacaaagtacaaaactcctgaagtgatagtttctcctgcttctttttctttgaagcagatggcagccgtggggagctgtctcagcctaccctcaccattcagactcatccctaccggacttgtgaccctgtagagatgagctatccccgggaccagttccagcctgccatccgggtggcggacctgcttcaacacatcacccagatgaagagaggccagggctacgggttcaaggaggaatacgaggtaagagcttagcatgtgggaggattccccaatagctcctaggtacttttggagaactgaagtcctgcctttgaccgtgagcaacaacaaggcttgagagcatagtggaaatgccccaccaggcccacttaaacagaatttacattttaactaggacctagacattaaatttcataattatcattgtatagacgctgatgtgcatggatgcagatctgtatatggagcaaatacctcaggacaaggtgtgttgtttataaagacatgcacaatgttattgtagttggatgagcccttagtcattagaatttgccttgaagtttcaaatagcatcaagaaaactatggactttatcagaaaggtacatatatggccaaagcctaaactacctagtctttaaatctaaaattcaagaagagaaatatagatgcaattgaccattttggtacatttctttcagaacttacattttaactaggacgtagacattaaatttaataattatcatgctccaaacccctaaattttagagtcaaacctttctttactatgaagatcgccctcttcccacatgttgtagagaagccagcatgtctccctgccaatagtctctggcatgcctgctgcttcctgctcacttcttgcctggtgttcatgcttctgtgtgttctcactgtgctccaccaaggccattcaatgcaagtaactgctatgccctctctctatacaccctcattcctccattcctcatgcgttggtcacccctttccccctacaacccctaactccctgtatctctagtacaaaagatatgaatacatgttgtagttatttcaggagtttagtgtatcctttgcaggggttggggctgggggtgggggagaggagagcagtgacagacaaccacagcaaaatatgagaagcaccagagtccaacattattatggtatagattcctcaccatgcaggccctttaaggtctaataaatatcttctcctctatccagtcttctttagcatctttaagcaccacccgctgtgagactccgcattttctttgctttattgtaagaaacaacttctcttcctactgtctttgtctgactccttttgtttcaaatcttacctgctagatttcacctttacagaagaaaagaacaaaggaaaaaaaatccattaagatgttttccttgagcaaagagcagctcacttcctcctccccaacctatcccctaaagtggcacttctctcagtgacagtggagtccagctatagcaacttacttttgctttctctctcctcttctttccccaaacgcctcttcagcattttctatgtgccctgtactaaatggtacccactgggtttctcttcttcattccctgcctccttcctcccttctttatctttcttcttcttctttctatcacttgtagcaatgacccagatacattttgctcagttccactgtatgcagtgaaggcttctcagctcataccacctcagactcagtttatccctcggagtatttccctaggcaggctttctgagtactattgctgatgtcatgggagaacatgaaatcatgctaaacttgtggtccacatatctgggtttcagttgcagtaagcttggaaaatcactttgctatctcaattttcaaattttcaattagttgacacgtgtgcctaagtggctcctaagacctgtatgctcttaaagctttatgggagtataatgtagtggaggggaccatgtttgacatactttgaaaaaaaaaacattaataccagaggatgtaattactagctcaggagaaccagcagttaatttcaaatacagtctcagtcaaataccatatttttgtgtgtgaattcagtctattacatgcatctctgagattcaaaaatccattgcttctttttaaaagtatcaggataaatattgataaaggaaaatggattcgttcacagattgtgtaaaccaagaagaaaaggactcttggttgaggcctttcccaaagtgttgttaccctttaaaagaaaagatgaagcaaaagccaggaggtatgcctatgttcatttaagttgccagaatagtgtgtcctcatatgtcttcccaagaggcaagctcctcctgcggttggaggagccagccaaggctgatttggcctttccctccccacccccacctccccaccccttccagcctgggattcattgggatccatcatttcaagagtctaatagcaaaagggagagtacaaatctttccttcaaatatctcctctcctgccaggatagttataagactaccaattctggaggaatattggaacaagagatacaggtaatgctctcagcacatctgagtcttatttcttaaaagtaagaatggtcctgagcatggtatgtacactgatgcacatggatgcagatctgtatatggagcaaatacctcaggacaaggtgtgttgtttataaaggcatgcccagtgttactgtagttggatggacccttagttatcataatttgtcttgaagtttcaaatagcatcattaaaactatgtattttatcagaaaagtgcatatatggccaaagcctaaactcctagactatgagctttaattctaaaatttaagaagagaaatacagatgcaattgaccattttggtacatttcttaccagcatatttcttctaacgcatccatccctatatgctagttattacttggttggttggttggttggttggttggttggctgatttgctttgctttgcttttaaatttttctttatatctgtcagcatctcccaaagattctagcatggaaagaaacttattttatatcaaagaatacatgttattccatcatttgggcctcaaccataaatctctctaaggaggccagcctcaccctcagttaattcaaattgtattaataggctggctagtgtgtcttgcatctggttaatagcattgtatgattaaccaggagctaattagaagacattgttaattgaaatatcctactttgtagggtgtgctagtccagtttgttagaaagtgactgtggttttcttttatcataagggctcttatgatttctaggatcttcatcttgaacatgaattgcagatctgcttcaagactcagtgtagacataaaaccccgagcctccagctctgctgtcacacagctgctgtgtgatgtccttgcctgtcaccttcccattctcctctgcttttatttttttcataccaatgtgtggatttgacaagctgacatctaagagaccatcagctctagcaagttgtgccttctaaaaccaacgcagctgcagtcacgcccagattcattcagtaaatatttgttgagtgtttactattacccaggagaactctaggcatttgggacacaatagtgagtgaaacaaacccacaccctcatgaagcctgtattctaggaaatagaaaataagcacaggcttaaaaaacaaataaatcgcagtttgctatgttacaaactacctcaaatatgagcaagagaaaacaattgatttattgcaataatcggctccatggtttgggatttgaacaatgaacaagaggtacagtgatctctgaaatgcaaggctccagggctaggggctgaaataatctataacatctttactggtgtctaataatagaatgtagatatcatctaaggtctcattggcagctttccactagaatccctgtaagcaacctcctgagtagcctgggattcctggcagaatagtaacttccaaagcagttggacttcttctatggtgcctcagagcttcaaagacaaacctcctacctaacaaggtaaaaattgcataacattggtggcctagactttgatatcatgttgcgttggattacaagccaaggaaaagctaccctccttctagtgtggaaggtaattagactccccttctttatagaaaaaccacttgccagctctagaagagcacataagattgtagataacatgatttcagggcaatgtggtcttctagaaaaagagaaagtgagacaagggcaggaatagaataatccaggctgagacatgcaggcaggtccaatatcaattaaagtaaaaggatagtcgtctgtccttaggaaggatagataaggaaggagggatttccatagcaaaatggtaatattctggcatgtgcaaacaggagtaaagaaagctgatcaatgtatagtgaacctgtgctaagaatgaaataatcagattggataagtaaagagagacatggtgcttttgtacctctcaggccagtataaagagtttggctttctctctgaataagctggaaacttattacagagctttgagagttacaaatgccaatagtctgaatttatgtttaaaaactcattctagctactgtgttgagaatggaacctgggtaggcaaggtaaggccagtgatgtgataacccagatgggacaatggcgagcatcagcagaggcatccataagaagtggttgggttctgaatatgtcataaagatagacccaacaagatgtcttggtacacaatgtccatgtaaaggaaaggcatcaagactgactcagaagcacttacatgaaccaccagaaagatggaattaccaccaatggtagtgagaaggtacagggaagtccagactgaagcaaatggaagttcatttgagctcagtttgcagcatccaaaaaaagcagtggccatatggctctagagaataacattggtaatcgcaaagtcacaattccagatgaggtcctcggatgtgtcaacagagacaaggaccttggactcagccttttaacagtcccactttagaaagatatagaatgctttccataggctattcactgggcatggtatggggacgaaggagagcagtaaccatgaccccatctgtcaaacctgagcttatgataaagacaggtttatgaactaataattttaattgtaaaatgcattatgtggacaaaatgctacaataaaagaaaacccagaattatagtgacccctgtagatagggtatattcagcgtagcctaaaaatatacttgttagtgattttcataagtacactagtctcaaccaagtgtaaagaaataagaataataaatgaaaacatagaagaatgttctagagaggagctacaagtggtgtcatgggcaagtagaaagtgaattgagtttgtggtactataagtaacaatatataaaatagagaagggtacatggggacagttggggctggagctgtaacaactacatgtccaggaatgggttaatatttcacacactaaggaatttgggttttatttcaggggtcatgggggctatagagggggaagaacttttcaaagtagatttttacttaaaattttgtatcaaagaagagatacttgaggtaagaatacagtcagggcaataaaagatgggactaactggcccaaacctagaggctaagctcagagcccaggtcacacacacacacacacacacacacactgcatataaagctataataaaatcaatttggtctctttgacatgggaacatgagtctttcaatatccatcgtttaagttccactacttgaagtaatccatagatttgtcctgcactgtgagccaaatgcctggattcatatcctaccattttcataaatatgtaggtgaccaacagcaagccattccttgtctctgggtctcatttctgtccttaagcattgaggacaaataggttagtcagagtgatccaaaactccttttgtagctaatattatgagaatcaaactaagaacctattggctagactaattgggtttccttccagtggagtctctgtagctcccttccccattgttatatcacaggatctagttgattaaccatagttcaaagagctcaagaaggactaaggcaaattaacgtcacctgccatgcatatccagttctcagctgagatttttaatcttggcttcaggttagaattacctgggaaaaaatttcaaagcaccagtgcactggccatatttcagaccaattaaagcaaaatgtactatggtgggaccagagatcagtattcaacaagctttctagctgattaaaatatacttcaaaaattactagtcactagcctcaggaaagccttgaagttttcagagtgggccatatctgtgtccacagaccatcactatgcctgtcttattgtctggccctcaaatctccctgtgatagaacacagccactttcaatcaaaggctgtgacacagtcatgaactacagagcctcttcttcttccccattctcctaaccctcgtcaagatgaccccactttttcccagtaaaaacaaacaaacaaaaggctccacagtacaccagaaaatgtgcacagacgttagctagagagcagggttgtctctgtgccctgtaaccagatgagcagaagggcagcaggtttggggaagatgagggagaacaggaagaggtgactttgtgatacaaagaagggaagcatgttaattcccgtccaacccagacagcctgtcactgtaatgaatggaatgagcccagtagggcgaccagaaggtatctgcttatcacagctccattaagactatttaaggaaacaaggaacagctgtgtggaatatgatgtcgtctaataaagagcaaacatgtgttcattttccagctctggccggatgcaccatgtgcatgatttttgaggggagaggccatcttgcttagtcatctgtgggtgatatcagacaggcagcctactaatggagcataaccgtagcagtggaagtttcctgaggagggaaggagtgtaccccagactggtaacagattaacaggacatcttgttcctgggaggaccttgatccagttccttgatttatagatgagagagtttctggggacaagcatgaaggattagtggcagatgctcaagtcataaatggggaaacacggtcattcttctactctgagaaatcataatgacccaaatggaagagccaggctcccacctgttcatctcactctcctggcagggttaaaacaggaagaaaatgagccagatcctggaagtggccgaaagacattgaacccatatggtgtcaaacttggggaagagctcgtgcaggttgacgttgtgaactcagtccctttagtcaatttttatcattcagcttataataatactcataacatagctgaaagcacttgtttatgtttgatatagaaaccctcccaaatgactgcgtgattcccattggattctgtagaaaagttcttgaaccaaaaatcaagacctgaatagtcttagaaagactctttcctgaggtgaatcctagttctatcttctgtgaaatgcttggctggttttgcagtgcttttaaagtttgatagtatatggccttttctaaacactcatcagaaacaccaactgaatgccaaaggtgggctttgtgctattccaggcactggaaattgctaaccagaagaaatgaagaccccatgttaacaaagctcatgacttcaccatagaagagaattccatagtttaactctgtttaaaatgcttcagagctgtagttctcaagcttcttactgctatgagcctttagttcctcgtgtgctggtgaccccagctgtaaaattatttttgttgctactttatagctgtaattttgctactattatgaatcatattataaatatcttgtatgcaaccccgcaagaggttgtgacccataggttgggaacccctgctttagaggagcatggtgtaagcatggtaggaaagaggcaggtggttatgaaggccagtgttattactttatttggacttcttcttacctgtttctaagataaataagaagtgtcccagaagatgtgacactaagctgaagcaaagtagactatgggataaactgtgtgtctgtctgtctgtctgtctgtctgtgtctgtgtgtctgagcatatgcatgtgtgtctgtgtatgtctgtgccatgcctgtggaggccagaagagggcatcagatcctgtggaattacagttgtagatggttgagagtcccctgacttaagtactagaacctgaacttgaatcctctggagaaagagtacccacttctcaccattgagctcttattctgtccccactactggaatacacaaggttataatcatcatctcccacaatgtcaccatcccttctgacgttaaggaaagagtcgttggcccagaaacggcctcctagatgctcatgtgtggtatgtataacagagaatgggcttggagatgggcagaggagacatctgctaccttggagctggaaggatatagaggtgatggtacaaggctctccaccagacttgaaaataaggacaaagtcttaggcttttccccctcaaacatctggaaagcaacatacaaatgtgaaatgtttaattgtactaggaagtactggaaaattttaagcaattagcaatagctatatccaaaatgcaaatcaaaaccaaaatgtgcctaccccagttagaattactgttatcaaatggcaagaaacagaggtgggggtggagcaatatcttgacagttaagaacacttactgttcttgtagaacacctgggatcaattctttagaacccacataacctccagtaccagggcatctgtgggtaccaggcatggatatgatatatatacatgtaggcaaaacatacataaacataagtttttattttaaggaaggaaacaaatgctattggaggatctagaggaagaggaattcccatattgctggtggacatgtaataaacacagccattatggaaaacagtatagatgatctttaaatagctagaaatatactacatacatataatacaatgattctacattgagttatgcatcaaaggaatttaaatcaatgaatagaacagacatcttcactcacaatagctaagatatagaatcagcctagggggttcattggcagataaatgataaaaaaaaatgtggtatgcatactcaatgaaatattcatccatataaatgaaactgtcatttgcagtaatgtgcatgaacaggagaatactgcgtgacgtgaaattagtcaggcctagaaagacagatagcacatggtctcacctaaatgtagaaactaaaatactggttttaaggaagtagagaccacagtggttattagaacctgggaagggtttgaaggagagaaggacggagagagggtggtttgtaggtatttgggctcagttggaaaggaagaacagttttaaaaatctacagtagtgtgactgttttgacaacagttgattgtgtatttcagaatagctacagaagatttgaatattcccaacacaaagaaatgacatctgtctgaggtgacagatatgctaattccccaatctgatcactgtgcattgtatagatggattgaactgtcagtggatactccatagatatacataattagggtgtgccaattaaacataagaatataatttaaaaaaaaaaaaagaatagctcacctcaagaaaaagatactctgtcttatggaaagaaagcagtgcagaaagatcttcacctgtgtgggtggtccctcgggatgggtggagcacctttaactctgagactgagtctcctctcccccagggcatttgctacgtgaaccttccttcttgcttacaacagttctcaaggtttaatatatgttggaagcagccagagttaagaaagggcactgaggcatagggttactgatgccagattctatcaactgagggcatgtatggttgaggggacagcttttattatggataccagaggaagtaaagccagagaaagtgggacgagactggagcagggagaaaaagtactaaacagaacatggccagcagacaggaccaggccacgagagaaatgaaggcaggggatgggagggtgaggagaaaaattatatgggaatgagaagctgggggaagggatcctgtgagctggagtttaggatagggcctgggtgagaagagccaggataccagcttgaactcttcaacctgtatctgtgatggggaggaagcctggagaccagcaggtgctttaggagctaataggcactgcagatccaggttgtgtgtgtgtgtgtgtacacatgtgtgttcgtgcatgtgcatgcacactcatgcatgtgtgtgcatgtcttaagtacacacattttgtgcaggtttgtgtgcatgtgtttgcaatcctatggaaaccaggcgtcagcctcttgggtgttattcctcagtatgcatttccatcttcttcctggagacagagttttccacaggtctggaacttagtgatttcattcatcatcagaccatcaagccccagagatccatttgtctctgtgtgcccggcactgaaaatataaggttactgtactggctagctttgtgtcaacttgacacagctgtagctatcacagagaaaggagcttcaggtgaggaaatgcctccatgagatccaactctaaggcattttctcaattagtgatcaagggggaaaggccccttgtgggtgggaccatctctgggctggtagtcttgggttctataagagagcaggctgagcaagccaggggaggcaagccagtaaagaacatccctccatagcctctgcatcagctccagctccctgacctgcttgagttccagtcctgacttccttggtgatgaacagcaacatggaagtgtaagctgaataaaccctttcctccccaacttgcttcttggtcatgatgtttgtgcaggaatagaaaccctgactaagacagttaccatggccagcttctttttttttttttttttcacatgggttctaagggttgaacttggatcctcatgtttgagcagtaagcattctaccaaattagctatctccctaacccgtgttctttcctgtaacttgaaggtaagatcctactgtataacccaggatggcctcgaactctcaatcctccttgcctcaatctcctacatacaggttgtcattgggccatttaaagaatgttttatgacacatactcaaccattctgactttatccaaggtcccatgacagatgaatacctgcatctttgcaaaaatctgatttcctacttagcttcaccagcagaattcataaatttccctcaaatatttagtgacatggtatgcaataacatttgttctcctgatgccattctgagtagccatcgttagtcatcccctcctgcctcctccatccacgtttataatccccaaggcatatgcttttcagccacagtttgttaaaagcttagcctctgccaaggccaccactaagtcacacagcacctcaaggagaaacagcagatgtagctgcctcaagacacttaactgtcaccttcaaaaatgttcataagatgggtatgtagaaaactacactgtctgtcacaagtacagtcttccttatatctagtggtcctgcattgtcccccacctgcacagatgtccacagtagcccctactatctcataaactcccccagacttcggtagattgaatattaaatgagtccatgaatagactgagactaggatttagactcacagtagataacagaattctccactacctgaaccctatatcttacttagaactcaactcaccccagattcctagagctgcccccactttaaaactaaagacctatattcctaaaatccctttgatttgagaaaaactcagacaggtgttgccaggagtcctcacctttatacttataccaataacttagatttttttgtaggggacacacagtaaattcagagagaaagctactacggcctagcatccacctttgtatgaaggatgatggaaatagtctgtaaccaccttatgcctcaggcattggtccagatgttgtgtgcattacctcaggtaattacaaattgtcacaaagctctgtggaacatgcttcttcatttttacattcaataatttatattttcatttagagaatgcccatgctgtgttttaacgaatgcataggaggatgtaagtaccagcaggatcagtagccctaaggaagaagtaacaaagctgctatcctgctcctcctgtaggctggacgctactcctccactcacaggaagggggtattattgccttagtttccaaaaacagcattgagtcttagatgggaaaatgacttccagtgaaaatattcaggcaaggtagtcagctcacctttctgcctttctgcctttcccccattcacgtgcatagttcaatacgctcaaagcagttcttgacaagcaaggtggatgaccggccctagtaaaatgattccttccttggtgaggactcgggaagtttccttccacagaatacagtgggaacaggaagcaatcctgatgggctgtactggttatggaggaggcaggctcttggctgtgccctgaagcagcatccaggaactggctgatcagcaatcctgaggcctggttttgctgcacctcggggcatttcacatccaattatctcctgggatacaggcaagccaagggaaataaaggaagggctcactcctggcagaagccgccgggttagtggtactgtgggtaaatgaagtggactggcacacctcagcataggatcggaagtcagctcttttctgaaaccgtgttctgaggtctcaccatctggggcttgggtccaaagaagaattaaaagcattataaaggaccctctcagctagttggaataatccaactggtagaaagaaaaaaattagtcaagcaatcattagggataatttttgcttctaaggggagattaaaacaccaagcagggaaacagaggcaggtcactcagacttatagactaagtcagcaggacagagcctaagaaggaatagtctgtgatcgtgtggtctgagcctccccctgacactgtggcatggcaggtgagtcaagagaagagtgcctagtgtaggcgccaatgatcatttcatcatgaaatccatctgatctgtcaacaaatgtgaaggggagtggcaagtgcttcctgctcttatcgcgatgtgacaatggctgtgctttctcccaaagcattcctattgactgagtaaaacccacattctgcccgtgacctgaaagtcttccccagccacacctatgtgctatgtgtccacagaatgtacgcctcttgctatttgtgccctggagagcctccctcaagttctagaataccacaagctcgttctaactcagggcctctgctctagctctccctcagcctggaacacgccacccaactcttgccatggctgacatttgcttatcatttagtttgagatcaaatatgtcatccaaaggcatactccgtgttgaggaagttggggttattgaatagtccaggtgcagtgtgactttccctagggacacatgaacaaatttactaatcccagatagataactgacaataggccaaagaaatgataatggcaagtctagcttagtgaaccattaagtttattgaggttacttatgggagtatgggtgagggttcacctacaggaatatgtatgactcaaaggtaactgtatcataaaaaagaagcccacattgcatactattgactcatagaagccccacccctagttttccccataggatctatagccaacttgactggttggagaatcttctctctttagcaaatattattgcttatatacctttggagaagggccttgtgaatcctctaagtttcagaaacttcttaagacttgtgagatgtttactccttgggccttgtaacatttgctaccttgagtcttgaagatattccctctgactttgaatgtgtcagtttggaagaaatcactgtgcagcatggagagagttgggcctctcgggaaaaggatgtcagaaagggctccaaaatgtgggttgtgctcagtgaaattatagatgcagattgggtgctagatgtggtgttattggacagtttgatacatcttaaccgagagaagaatgtagctggcagaaagacagtgggcatgcctgtcaactgggattgagcgatcgttaggcattttctttgtgctcataaacaatgctcacatttttgtctgtgtttagatgtgactgaagaaaggccttgcaattgtcccttcccatcctgacattcagaagggctcttttctctgactggtttctgtgaaattttttatgctcagcagaagagccctggagctcagttgtgagtaccaggctagcttgccagtatcaaggtccacttttctcctcgtcaaatgttaccttttcaaacaatcctgcccaaacctctctatctgggttgttctttatccctggttactgtctccctgtgcaccctgctcgtggtcttcacagcatacatcgcaaacggcaatcacttgttctgtgtgcatggcatctgcctctctccccacagtgaatgtggttcatgaaatagcatcatttgcatctaatgtcatcatcatctctagaacctggtatagaacctagcctcaaatgcccacagaggaaggaggtgcatgcaggagaaacacattctcccatgttgctgagcaactgcttccctgcctccagacctcacttcctgaggttatgcaataatctaggtttttttggttttttttctctcaaaagaccttttcaaatcagacttttgaggatgttgtgaatacccaaggctcagctctccagggacaaggacatcctcaaacacatcttttgagcagaaattaagtgactgccttgggaaaggaacactgggggagagtgggaaatagttctacactcagaggggaatgcaaaagtagggcttcacactttaaggagaaagaacaagaaaagggaaccagagattgataatagaggagtataacgaggtggcaattttggtttcaaaagaatgtgattagctcctaatgactgccaccattccctggtcaatctactgtaactagccactaatgtaaaaataatgcccctggctccttcactttgaagactgagatgagtctccctttcatgcttttacccctcagatttgttttcttgaagagattatctctattagactgcagctacctaagaagggaaacatatgggtgatcaaagtctgccaattaggagccattaccacctctctctcgggtggctctattaggcacaccttctatatttgtcaacaccatcacacacacacacacacacacacacacacacacacacacacacacacactatccctggtctccttatgccttgctaaggggagatagtggttcagggtctgtagtgggtacctgtgtatatttctcatggggaaagagcccttaatcactataattgttatgttgagcataggcttgccctgggataggtttggcttggcttgtccccaaggccatggctttaatgttaagcagtggttaggatggacctccttgggctttgcagtgttgccatacagagggtttatgcttattctgtggggccccaggaggcaggccaaggcaaagcccagggccagagtaagaagaaatctagtcagtgatgcttctcaaaagacaggcaggaaactgtggcacagagagttgtctatcactgagggggtcccagcaattggtactgttaatcacctgatcaggaagctgcctgaaggccagtgttggcagggcaattctcaaggtcaccgatggctctgcaactccaagatcttgccgtccacaggcacagaactcactgtgttcatttgtcatttcgttcattccaaacttgtcattctaacaatatgaagtacagtctcagcagtgggccctggaaacagaattagaaatgagatgttttgatccttttcctgaagaagcccgtggccaagctggaaggcaggcttttgggttattgtgtgtagagttcttcgtgtgaaaatatctagaagtgactgactccatctgaggacacaaagaggaagggcaagcagaaagactacacaaagaagaagaagcttggacggggtcttgaagatactttgagattttacagaagtaggcaagaacttcaagtagaaagaatatgtgaaaagtctcatggatctgaaggcctttgtacacagcaagaagtaagggtgaaagtctatttgggttgaagtcataaaaaagccagctaatgaaacaatttggaatttatcctgaagacaatgaaaagaggaataattgggcttgatcacgttttacaatgatccctctgattataatggagggtaaatagaaggaacaaaaccaatgtcagggcactgaagagaagactcatggaaaattgtctctgccattttcacaagaaatcccatgggagctttaatcattgactgtgtccacagtttatcacagacagtgccctagctgatctggaacaactccttggccttaagcgattgaaaccaccccgaagcaatattaacatgcagccataaagagaacttaaccttaactgtcaccgaaattctgacacatagcacatactaaacatattttctcattagatccacatgaaaatagtctgccccaccaccatgttggaatgaacagtgaacttttatcacagagaattgcaaacggataacctactgcccccaaatcagcccaaatatcatgaaagacaatgttgtcattaagaccctgacacacagaactatacctggcaggctcaccggtgggagtggggcttcctggtcaggagacaggatgggcttggaagctgagttaggcatgggaccaagaagcatctgtgagctaaagatagcctaagccaagggatgaatggttacagggatgcttggtacccagagggcaatttgccttgtttcccctttaagaaacctacctaagggtgtgataaacacaaagagtagcattctgagtcaattgtagctgaaaagataccttagagctcaattggagagtgcagctttgcacaggaagcccaggcaaaggcctttcacctgtgcctttcagtggctacagaaggaatcaatgacagaccccagttctacatatccatccactgcatagatgaagcccgtgatcatgctaggaaaataaaggtcagcaaaccacagacacaagataagcccatatttacaaacacctatgcttataaatatacatttcctggaatacagccatgtctgcatttgcctatggctgtgactactctacaaccagagagctgggtgtgattataggctctggccaaatatgttatatagattttcacagacccatcttgcaagttacccttgctattagaagacccaccaaagttgggactttgaagtgcatatgggacttgaagcaggaaaggttccactgtgcacaaacactactttttcatacccagtggccctgcctatctctgagaccatgatctgctgaatgactgaacttctggctaatttgtgagggctaattagacctagtaaggaatagatgggtacagctaatgctgacttgcaaattctgtgtcccaagtaatacaaggaacatgggcaggacattcgtcctgtcctcctgtggggaaggatagagaccctcatcaaaatagggtttgtcctgcatactgttgtaggcttcataaagctgtttccactatccataaaggctcatttatctcgtctgtgaggggactggctacatattccctttgttctagatcacttggcactcaactcccttaaaccatccacaagggtgatcacctggctgtcagtaacattactgcaccctctttaactgatagatgacttctgccccctacccctctttaagctgtaaagctttgtatcaaacttcctgatcaacagctcagcttagatgtcttagaggcatctcaaagttgggtgccattatcatttttactcatctcaacatattaaaaagacacagtacccactgtggagcactctttaagcacatcatgtatccaaacctcagggctaaattcccacccaatccatcatgcttctcccacagacttctccatttactgaagtaaatgacattcctctggttcgtcaaaccatcgccctagaggccagccttcattcttctttcttccacagttcctgtctacaattcatgtgttagtgccctggacaaatctacacattcatggttctcatgcatgcccacatgatggcttcctctaggaagcatctatgttttgttacctgagggtttcctcgagaccaaagactatccacgttacctacaaagcatggcagaaatgagggttttctaacagttattctccaacagtaatcaaaaggaaaaggaaatactggataagcatttcatctccctcccagttcttcctccctttctggaacaagagccttgaacatgagatgtgcttgtgaaataagcctcagttttgctcctcagtgctacagtggcattctgccctgtcagcttcattctcttgatggactgcttcccccgttctcctaatcatactctttgattgcctccaaatccagccacttatactcaaagccttctctctgcttttgcttcagaggcaacctaaatcagaaacactcaactgaaccaaataagattgcttttctcatgaccactaccactacctactctaacagtccaaatgccatcatgacatatgattacagtaaattcatagccaatcatcctgcttcttctggccttctgagagcctgtgttccacacaagaatatgatagcatatgagatgacctccttgttcagagccctccaatggtgtcccatcacacttctaacaacatgatatattaaccaggaacttcaatgctgggggttcatctggattctcatatcctctctatgagtttccagcttcccattcctccctcactttcatctgtgaacatggttgcttacagccctctgtacctgttcctttccctagaaaatactttctgcttttttcaatgaaactggcttctttaccctatcaagaaatgaatttggatgtgagtttttcacagaaaacttcctaaactgtaagaaatttcaatctttattgctatccacttaccctgctttatttcttcatatcttcattatctaatattggatttgctttgtcctctgctacattgaatactctggagttcttggctactattatgcactctgatatctagaaagggatctaaaacatattaggggatcaatgtgtatctgttgagcatatgaatgaatgaatgaatggctccttactggactagactttaagctcatgatagccacaggatataacaatatttgaaccaatgaacaaaaatggaaggtaccattacaggataaaagccctttatactgagtgtctcacagtaatacttatttcctgttgtttcctcatcaacacttgagaagagttaccatctcatagcatttcaggctatgctaaccactttgtctttgcattgtaggccttaccagaaggacagacagcttcgtgggacacagccaaggaagatgaaaaccgcaataagaatcgatacggaaacatcatatcttgtaggtttccttcagggatgttctatttgttagattttgggaaacatgggagcaacaatggctctttttttctaaggatttgatataaaataatccttatgtttccagctttgggttagtaaatttttacaatgatctcaggaagggatggtaaatctcaaataaagtcggtaacaatcctaagggaggagggaagggggagaggaatagagggactgccacaaacctgactgtcccttactgataatacatctagcacttccagatgatggcatagacagcttgcaaagtagctgacagtttacaagagagcagagttacccccaccaaagtattgagtcaatgatctgataagagttgcccacttcagccttcctgtgatctagtgtagcgcagcccaggccttttgacatctagcccactgagtgaggagcattccttaagatctcagagtaccccaatttgggcaaagaaaggagaaagtggagaatcctaagagacaagttatttctagcacatttcaaagttttgttttaactgtctagacatcaccatagaaaaaaaagctggggaaagaataagacacgggcagattgtaaaggaagaaagaggcagaagttttcgcttagctgtttcctgtgctgatttaggaatgggctctgaatagtggaactaatcagaaaacatttataatttctctcttgcttgcagacagcaagattttttttttacaagtggagtggcagaaagagatattgagatagtcagcaaacatgtattgaggcgtgatgtgtgagcctctgcagaatacttcctgtgctgggcactgggaaatgcttttgttctgggacaggtagctattcactgtgacttgttccccccccccccctctgtttctgtgcattatccaatgtccttgtcaggttgtgagctcagagggggtcccctatctaaaataggtttccaatgccctgttcctagtgatattgcacaaatgtgtaaaaatgcctagagaataaggaagagagcctgactcattgaagacagaaagactcaggccaggggacagaagtcaaaagaagtcaaaatgtattagagatatttaaaagattgtgtgtgtgtgtgtgtgtgtgtgtgtgtgtgtgtgtgtgtgtgtgtgtatggcctcctccatccttgcctgggccatcaacaactgtcccctggatcatgcttagcctcttcccgtcccctccatatccaagtggcccaaactttctacctatctgatccatggcaggacccatgaagatcttcacaacatgacttagataatgccatcttcctattaaaagctcgtcagatgtttcctttcgctcttgagttctcctccttgcaaggccttttccagacccattcacttggactcagtccatcacaggctccttgctaagccacactggctgttgcataactcatgaggttcccatgtctttctacacttcaaggtcaccttgacatagtccattttctctatcagagtacccttcccttctctttgacttgcaaatatcacttcttctctgactctcagctaaagtcactctctaggggaatttctctgaccctaatcatgtagacaagcccccatttttcagccccagagctcggtgtcttctgttcaccttggccattgtcatccttgtaccttgagaggcattcatctgagcctgcctacttgcctcctagatctgcttcacagcagcagaaccacagccatcttgcatttttatttccccaaatattctatatgacagagtctaaaaataagaattgaatataggaccatcctataggtcatgagcgttgggttgttctgtgctatatccccaaactgatagtgaacaccttggaaagacaactgaatgaggctggatggagccagcagtgggatgataagtcccaagacagaagaccagagggaatgcaggacctaggaaggagagagggacacactattcctgctgaaggccccagttgagagtcaagaatgcagaaagtggcatgactggagttgaactccattgctggggtgacttcccaggacctatatccatatcacttgctgtatagaagcatcaatggcagaatgggtaccagaggcagaatcatgataacaggaatcaggtgtccagggccactactctaggaagctgcaatctagctgtggatgctctatgtgagatatttaaaagattgtgtgtgtgtgtgtgtgtgtgtgtgtgtgtgtgtgtgtgtgtgtctcctttttgaagtatgtgctccacatacctcatagttctgccctgccctgttcatatctctttgactaaaggtcttatccaaaggcggggaaggatgctatgcccaagctcaggacagacagcaaatatgaagaatgcacgtgcctgggagaaacctcagccctgaaactcccagttcctcatcagcccatagaaggcttcttccacatctctttttagatttccataaagatcacactgcagttgttcacagaagcagtgagctttacaacagctttctgggatgcctttccccctacccccagacttccagtgggaccctttccttctacagacatatttttgtttaagaattcttgtcttatacccacccatagagaaaaaaatagagatggagaaaatttagaagccttagtagtatccccttggtgatttaaaatgaaacctaatctattttctaattgaggttcaatagctgtagcacatcaggtctagtataggtctgtactgaacccagcagagtcagtcaagataacctgtggatctaaagagcaacacaagacatgaaggggaaccccagggtggggatgaatgcatcctgagttttaatggaacaaacaggttaaagaaaaacagcccaggggcctggaaattgcccctgcccttatatctgtccctctcaaagaccatgcctgcccagccttgataaacagaaatattcttggcacaagaagaaaaccagctgtgattatcatcttaagatacctaggtccccaaaaggccagagtggaggtccaaggcccaggccacaggagcacagaaaagatcaaaaggagaaaggaggagggcaggggctgccatcaaacaacagtgaaagagaaaccttgttaaaaagctctttcttcccaatgaccctatttagaatgtagtaatggagactggccttcccagggagtagaaatggaaaggaagtaaacagggggaatgactgagggaaatgagaacaaagagccctttgctttcaggtagctccagggcagagaccataagcaagaagaaatttcaatagcaaagcatccctctctcactccagccctatgtggactggcaggaaggaaatgactacagaaaaggaaggtgcgaattccataaaatggtacggtcctcaggatcccagcaggaattatatggggcccccagataacatcctttaaagacaagtaatgacaagaaaaatcttgtcattacttctaggaacagagacactagaaagcaccaaggagggagaaatcaccaggacctggagacagaggctacctgagcacaaggatgtcctctggtggcaactccaacaaaggcagctgaggaatgaattccctgaccctgctctcttgcctccacctactctgtgcctttccatcagctagctgaacccagcttgatgccagagagaggtcaccggccagcccagtagctttcaagcttggtcaggagtagctcactttgaagctcattggaatcgctaataatcaggtacccccctggacctccagcatcaaagggcatggggacgacacccaacagttttatttaagctctctagtgatactttgagaatctcttatggtcctcagagaccagcctcctagaccatagagccaggcaaagacgataaagcaggaatgctcacactcatttgctgaggcttttccttaagccttaggggaaatcttagaaaagttgctggggttctggtgtatcggagtcttggacaggaggtcaataagagaaacaagttgtagtctgttaacttcttgtgacctgtagcaagtcccctctatttctctgacctgtttctcacctatgaggttggattccaaggcagcaaacccatattaaaaatgaatggaaatgaaatataaatctgacatggacttttaatgtagagcaggctagcctctgagtttgcaggacaggacatatgtaccaaagatcgtgatacctaaggtcacacagctacacaatgagtctatagggctgccatgacccgagctctgatatatcacctgccaggatgctacatgcttctttcctagggatctccccttcatgaaaccacgtctttgctttccaggagtgtaggttgccaagggactaacttcataacagataatctccatagaatggtgttcccttcctgagatgcagaaaggtcacaatatgcagagaagactccacttccaagaagaactcaggctcagaacatgctgggaggccctctcatacaacaggattccctaaggcttcctggaaaaaaaagctaggatgatgtaatggtcccctgggtcattgctcctgactctcgggttctactctgctttgtcctttctgagggtggcccttggtgggtcctaccagcttttcctagtacagaagtcactggtatcctgccatatcccccagatttccctgttgtccatgcccccaattctactgtcagcatctatgtctttctctgaggatgtatgctggccactggacattcactctctgtaggaaagatcacagtgctggggaattaaatgtcctcaggagttgccttcagctgatagctggtgcaagtggatgtctaagaatcccagcttcccctctctgacgttcacatttcctgtctcctcacagagctctgcaacagggaccagggggacttaatcctgtttgtccagttctggatgatactctcttgccaggttcctttcttcctggtaattgcctggaaatgccctcccaaatcactaatttatttcaactcttccactctggttctgcttcctcagttcctccagaaaggcctcctggtagggcactgcctggtaatgtgcgaaggatgccaagagatgcaatgggagcgacactgtcctctgtcctctctgggtactcttcctttctgtacttctccttccccagggctctgcagtgggagctgcccaactttagctagcatctagcgtggatctgtcaagtccgagagattcacagaatgtatgtgtgtcctccttgtgtggtgcccaagctataccttctgtgtctcaataagggtaattcaatcaagattgaatgtttagacctttagcttcgatgaggtacccaggcagtccctgtggaattacctgcctcctccctacccactcgcgcaagatgatagcattaacatttccaatacttctaggaaatggtttttcagctccacaattcattgtaatgagtcaaatctcttttctctgaaaaattgcacctgtggtttttttataccctttgcagtgcccagaagacaggaggaaagattataaagtatgcaaatgatattctctcccagccccacctctctgaagtgattctctcttgaaacggttgtgacttgtaatgagtgatttattgagttctgtctgatgacagagaaagggagaggaagctgggggcttttttcagttagaattgtgcaaaggagcaaactgaaccctctcctctgtagtaggtgtgaaatgacaagctgtggacaggggaccagtgttggggactgagatgttggtgggaaacaaggaaagtaggtcttgggagtcagttaagttcaccactacatgaagaacctgtcaaccttatactgtgtctgaagtacagaactcatgaagcattgagtttcttatccatgaagtaaggtgcgccatatatatctgagttgctttctttttatcaaatgccacagtgtccatgcagtttccagaataattcatggaacaccttccgctctgcatatagttaagtccctatcccttaacatctgccactgagggtctttggtccacttccagaaaggtctcctggtctttcacaagagagagtgattgatgacaagcttgtcctgaataaccaaacattgagattttcatgctaaaaacagggcatgcaccatcatcatgtgaagaaattgctaagacatataccatgctcagcctcacttgcagtttctgattcagaaaatatggagcagggttcaatgatctgtctgtctagggatcacacttggagatccattggtctataataataataataataataataataataataataataataataataataaagccaattttatatatttgtgttgattcttatagaatatcagatgttatacttgttttcatttcatctctgctacaagtctgcaggaaaatatggttttgaggttatagttgaataaatcaaggttcaaggaatgttatgacctaagccaagtgatatgacaacatagtgaaagagtaggggagtctcaggtttgctttcacaactcagccaatcctttagctctcttctgataaagccaagaactgtctttcagtcttgggataggacaggctgagactgttggtatgatgagggtccagccaggaggagaggaagaattcgatcctgatgcactgccttagatgagtgtataccttagcacatgtaaaggctctgtgacaagaacaaacaactgaagggtccaggttatcagggcagtgtgtggagaggagaaaatgacatgacagtaggttcccaggcaaacagagcatgcctggctttgtggggtgtgataagagtctctgttagtgatgtactttagctgattcatgtcagtgaacaaaagtaaacataatttcaacataattttagtatatctgtagtttgaaattggtgatagtgggaatatttacaccctagaaatcagtaggtatgctatatcacaactctttcttcccttggagagtttataaaacatctgtcaacatcccattggtccacattctaaaacaataaagaaacagatagattgaaggcagagggtgatatcctcccacccctgcagctgtattcatgggatatctccaagtccttcatgtcccctgtaccatctaccaatgcttatttctttcctactcctcatctccttggagaccctgggggatctgggctcttgcaactccatctcccctcacagttggggagcttcttctcctccacatgactcttcataactcttccctttgtctcgactctcaaacactgcatgctaaattagctgtttttcaagcttgcaaaatgtagatagagcataatgaacattctgggctgcttgtaaattacctcgtataagctccttcccatcgttggctgccccatctttctctatgtgcatgtgagtaaacagaattttttatctttctaattacataaagttagaagaagaaagggacacagaataatattagcatttcccagaacagataaataaaccatgagtccactgccactctttgcatcgcctttctggtagacgtgggtctgaattacgtcctctaaggaactcagacatcactcttgtcctctacagataaacagattcatctttgggcagatggacagatggggaagcatcagctttctagattgtctctactgtcaccccaccatgtacctcatatgcagtcccaaacctccattaattgagtccctgctgtatgcccagcactatcctttatttctttaggagcaatttttagctctatagatagtcagtgtggcaggtacagaattgtgtaccatttacatactgtttgccctttcatcaacacttcacactagtgcaaaacgttggttgcagttgatagaccaacattggcccattcttattagttcaagttcataatttatactagagcttgctttgtgtgttgttcagttccagaaaaatgcatatattctaattatagtattttataaaataatttcctttccctaaacatcccctttgctcaacttatttaaacttccttcctcctcttctcagcttccaccaatgactgaggtttttatagactccatggttttgttttgttttgttttgtttttccttttttggagtattatatagttagaaccatatgtaaaatcaacattcaatgtagcctttccagtttggcttctatcacttaacaatatgggtttaagtctcttccatgtcttttctaacatgcgagttcacttctttttatcactgtataatgttccagcatgtagctatggcaccctttatttatccagttcccttctgaggatatgtttgtttgtttccatgcttttacaatcatgacttaatctgctgtaaacatttctgtagagctgttaatgtagacataagattgcagtacattgtgtaaataccaaaacatacaattagtggatcccgtagtgaatggattcttaatcttgtatgaaaaggtcctactgtgtgttttcatcagcaatgaatgggggagcattcctgatccaagcattggcaagtacttggtggcattgtggtcttttgccactgttacatagataatatttcactgtttaaattggcaattcccatagatccttgggtcttggtgatttaatgtgtcactctgctctaacctggctttcttctctgtctcctctgttactgttccccttcataatcagtgatcccagaacaaaagactcttcacaacccaacccccattgagcctactgcaatgccttggctcttttgggatcccctctttcatagtttcctctaagagaaagacttccttgatgcccacggatcaaaccttccttacttttaattcctcagtcacatttcagtacatggggctctctatttcttgctttctataacttgatgtcccacttctatgcatgatttacttccttgaacaaattgccccaaatacttaaggatgaagctcacttgctgtaactctttcttagttccttcaactagggtggcatatagaaggaactcaacaaatatgttcttaataaatgtaaatgttggtagataccctgatggttggagacacatttaatctttaaggatatctgactaaaaatagtttctttcttttgctttgtgtctaatgattttatgcattaaaaaaaaattccctttcaacattttaaaccagaatctctgttcccactgttatggtttccaggcaatcataattcagtaagtaaggagattttgatctgcctccttagcatagcaggcaattcatcagtcttataaataaaacagatttcaaaccactaagtcattaataagaacattgaatggaaacagaatacacatttcccttgtctgcggctttcagattctataactgctggtaatagggcttaatagcctgggtcagaatcaggtctcaatcctactgaatggccatccccaggaagtccccctctctttggtcctgagggtttggggctggggagcactcatttgcacagactccagcagtagttacctctgagatacttggaattccccaggacagtacatcatgttggtagaacagagtggaccttagagagtagctatataatcagttgaagtgcttaacctctgttagcctttcttccttcctgtaaagtcagaatcataatagcacatcactgtgaccatagtaaaatgaagaactgtttgagggctgagtgaataggtaatgtatctcacactgagaacatctaaggatttcaggaaagttttaagttcaaactctcctcaccccagaccccacacttccatctcctgcctattcagagttgtcttctacttactcctccttctagtgactcccactgaaatttttcctccttggagaacagaaaaagggtatccaagcatggtaactgctgcctgttgatgctcataactgattctgagctaatagatatgaatagagtcttatgccagtccatgacccggtttgttcatagctggaccaattcatggcctttcaggaggtgtcacattgcaaggagccagtctgtgcaaaattacttctttgcaaccagggattctcctctttgtgtctacctcctgcccaagaggtccatggtatctctagtcatagcaagttgtctcaactctacatttctgaaaatgtcatcccatgtttccgttcatctgaccttgcaagggtagggaccccttgttgcttttctaaatattctcacttcttaaaagtttttttccctcgctcagccaacaacttctgcagttatccctgactgtgaatactcaaaaggtttgtagctcctagttggagtgctttgaataggagcatgtgaactcagagttaacaggcccccaacttttttatagtcccttatgcagtggtcatatggccagttttcatgcacctccatttgctcatttgtaacaagaactaagggcaccattctgcctctttcctgaggtcactgagagcactcagtgatgtcattcacttgtacactcaccagtactcaatgagtgcctcttgtgtgctaatcgcctttaggggttcaagggctggaacaaggaacaaggtagttaaagcacctatctcaagactctggagcaaatgcgtttgtaaactgaggagtagtgtaaatgtccaaaaggaaaggctagttgtcctcattaaccccaggaggacttagaatgtccacacctctctattccactcactgtgatccccatatctgccctgcagtacgatggaattgttgggggtgggctatgccatagcagattcacaatgatccaggcagcagactaagcatccttccttcccagcagaccaaatcgagatattccttagcacgtgtatattagcctgtcagaattgactttaattaattgcaaagaattagccagccttttctgatggaccatttaaaatgattttaacttggtgttatttgaagccagcatgctattgactaaagccagtacatcttgtttacgtctagattgtgtttgaaaaggcatcttcggcaacatgatttttagttactgatggcctcttttctaatgattcaatcctcagtttaatgatggcattgataacaatatgttaccaacaacctgtctgtaccagtgctccaagggacaaacataaagtagtttgtgtccacggtaaacaggtaaacttactgttttttaaaaaaaagcatgtaaatggagcatatttattctgactccaagactttatgtgcagggtgtacttaggtcacccactcttgttttgtcccatggagcaggcatttccattcccaaattaatgatgaaatcactaagacataggaagcaggagacacacctgctcagatgatgatgagaacataatcaaaataggaagtagaaaaggggtcctttttccagacctgttacctctcagcacctctacttcctgatctgtagttagcataactgtgagaaatggcatggtacctggtatgcagcaactcacaggaggcaactctaaaggagaaaaatattgactccttaccccatagtttctcatctaccactgcctgctttttgtcctctctacagatgaccactctcgagtaaggctgttggtgctggatggagaccctcactcagactacatcaatgccaactacattgacgtgagtatcttgatggagctaggcagctatgacaagagttgactgtccagagctcaagatctaacttataggctgtctttaacttgcccactagaaggtagtcaaaacatgtccaaaggggtgtatttatcccatatattaatttgtatgtgtctgtctgcgaagtcattcgtttgaaggtacaaccatggatgcaacaaaatgttcgaagttctcatcatatgctagatattaccaggcccataaatctaaaattgtcaaggtctctaccctcaaaaataccaggagggataagctaggcacatctgtggtaaactagggtaaactagaatgtgatgattggtataggttcagataaaatactgtcaggattcagagatgggaaagtatcacatcttccatcaggaatgcagacaatgatgtgagtcaaagcttcaactgtaaataaacctcaaaatgaaagtgagggatgatggtcctcacttagagaactgctcttgccaaaaggaaggcacctggaaggaaagaaacaccatctctgtctgagggtgatgcacacgaaacactgggaacactggaaaatgaggttggcacgcgatccttgcttaggaggttgaactctgaaagcaagagaagctgcttttcaaggaaatgcttgaaggtgttggcacatgggggatcccattcattactgagctttataatttatctgctacactggagaaaagatagatcagagagaggagagcctggaactaacaaccaagtaagagagaggctgtccccacattccagacaccactgagaaagagactcagatcaaacaggaagtttgagaagtgtgtgcacagaagtgaaggagtctacaaaagaacaatggccgctctcaccaggtagacatcccagcgtaactgatccaagctgacatctccaggtctcagctcagagcccagagaccttgaagaatgactaaagagattcccactgatccccccagtctctaaaatatatttatagaccagctaggaagtatagtcacatgtcctatgaatagcctcagccagatggtttattagttcaacaagtatttcatcagccttgaacctgacactcccccacttatacagagtgaacactcagccagcagatgccaatccagtctagattggttcacttccttcctcttctcctctatcttgattatggcttggtagatgtgactgacctaagggtgaccaaccacatagatagagtcaagcatgcctgagttgctgaagcttcctggatttcattatgtgaatggaaacacccagcaaaatcacattcctaaaggtactgtcagtccagtgtgggtcatctgtctgttcatcccctcgacattctccactctcttttgctttgcagatagtgattgtgcacttgtgagcaggggcatattgtttagggaaggaggaccgctttctcagtaagagggactgataagacacccagggatgactagaagggagaagccaggaagactctgttctattccttcatgaccacattccaactacacctccagcttccatcagtttgagttccagctccttccaggcagcctcagatcctggactcttttgattactgtcttccattgctcctctaggggtttctgggactgtttttcttaaggttcacccatggttcctctctgccatcatactcccctagaaccagtaaaaccaattctctatgttgtatttcctctgtccaaaatgcccacaacacttttctcttccctactgggtcctgcctaacaaaggacctactgtgtgatcaagatcttgggctagagcttcagcagagataaaaaagaatagtctttgtctctgtcacccttcagttgactctacacggaggaattcagttgtgagcagcttgtctccagcaagaatgtgttgctccaagcatttactgaccaggctattagctttcctctctaataatcatttcacaaatatcaagccgaactttcaccatgtgctagaaatactgataaggattccagatacggattctgttttgtaagaggggtcagatgagtaaagagactttcccagaacagacctgtctgactgaagcctcaagagggagtctgatgaaaagtttcttgaaggagatgacttctcagtcctgcctcagaaagtgacagagaatgagctctgcaagaaagtgttacaataacccaagatttagtgattgcttctcatataccagtatgttaccctaagtagtaattcaactactggatgactctaagtatctcttgccagatgaagaagctgggtctctcatggtaacatatccagaatcacagccaatggtggtaagaaaggagaagttacagtttaaatcaggagtgccaggttttcttctagtaataatatcagtgacagtggtggtagcctattaattcctgtgatatatgctttaagtgagccaacttactaagacttcttagtaatacttcacagtggttcttatcattcacacttagcagatggggaaacagacgtaaagaaattgaaaaaagaaaaagtttgtccaatgtcatatagctggacacaacctggttatgaaccatagctgagtgtcccaacccagtgctcaatcttctggttctgcatctactcctgacatcattccatagcctgcatttagtggaccctcagttagcacatgttgatacaggttagactggttcctttcttttcttccccaccttgaatgtggtcagatcgtattacaattctaaggctatagcacatgtctcaggtaccccagttgccatatctatctagcatttaatatctaaatggaaactccataaacctactttttctagatactttctcatctacggtacagtgaattgctgaccacatgtagaacagagaaattttcatgtcatataggcaacaaatgaaattgctttaaatgcaagtaattctacaataccagtcttaatcaggtctgcaatttctgtcctgttatatcattatgaagtatttttgccagcctttaaagacaggaaaccaggaattgaagttaagagccctgccctaggtcacacagctagactttaattctctgcacagcaagaacacagcacagccccctccctctctttataagaaatagactgtacagactggccaaatgtctctaccacatgctgtcctaataggcagtgtcaggccctgagctatgtctcagtggttagcatcaaggactaatgagactatagtcatgaatcccatccttgttgagcctgttgaatacaggcctttctgatgactaactttgtgactatgagtaaagtatttattcactctgatagctgcatgatgcaataaaaaaaatgccagcctgcaagtatgtggtaactactataaagtactttaccaggtttccaagagaaaataagctggctcacatgtatcaatcagggaacatttactaagagccagaatagtaccaaagcagattaaccagctggactgtgtggggcatcttgaggctagagatggcagagatctcaggagttctgtagctagataagagagtggctataaatgggatagatctgtaaggatactgtaaggatcaggctgtcttgttcttgccaaggagaaatcaacccttgccgacatggcaaagaagaaaccaaaagggtgtatgccccagcctccaactggcctctaagcttttgcttactctcttggttagaaaataccctatagaacccagaagatatgggaacctacattgcaattaatatggtcatttgactaaactgctttggctcccagcaggttacatgtgtacacctgcccaggagctatctggatttgcaaatgaaagacacacacacacacacacacacacacacacacacacacacatgccagttaattgatgatatgtcatgactagcttaaaggctgggcccacttaaaccttcatctgctaccccaggctcaattacttactcgaattcttacattattgattggctttctctcctgcagattttatgtcccattcttctccccctccaatcccaacctgagtcatggtgattctctccttcctttctcccagctcctagccctcaaaaggtcccacctcagtccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgggatagatctgtaaggatactgtaaggatcaggctgtcttgttcttgccaaggagaaatcaacccttgccgacatggcaaagaagaaaccaaaagggtgtatgccccagcctccaactggcctctaagcttttgcttactctcttggttagaaaataccctatagaacccagaagatatgggaacctacattgcaattaatatggtcatttgactaaactgctttggctcccagcaggttacatgtgtacacctgcccaggagctatctggatttgcaaatgaaagacacacacacacacacacacacacacacacacacacacacacacatgccagttaattgatgatatgtcatgactagcttaaaggctgggcccacttaaaccttcatctgctaccccaggctcaattacttactcgaattcttacattattgattggctttctctcctgcagattttatgtcccattcttctccccctccaatcccaacctgagtcatggtgattctctccttcctttctcccagctcctagccctcaaaaggtcccacctcagtccattggcccagccattaactattggttctttattggtttatcaaaagccaactggagacaaggaccttcagcatttggaaacatttattcctgatattggggccagattagttcatagcattggaaacaatctccaacatggttacctcctgtggcacagagcagaggatggaaagtagaacaagggaagtgtggggacaaaaaggtatagaactcaagtgccctcttatgatgttaccaatatggggcaggaaaaggaaaatctcattaactgtgagcctacctgaaattccagtagaattatattcctgtgatctcctggggatgcctgataaccaacagaggtgaggtggggggcgggagggtatgaactatctagtcttcgttgctttaccctgatcttcacaccagctcaaagacaagagctggctatttgagcgagagtcccttttccacaattgaatcttgacaatttattaaaatgactctttttggataatgagctggatgaggccaaccctgaccgagcctctggaggctgtgctatgctggctgctgtctaaaaccagcccactggcttgtttgtttgcataccggaaaatgtattggccacttgattctgttataaattaccagcctggaaataaatatcatagctgggtccacagtaagtaacagatgccggaggagtgcagagtgagataaatgtgttttggatgcaaacctccttccgattgttcacagacagatggaggcaggcccagtgctggtttgcagtcgctctgtgtgctgtgtaggtgggacttaaatgaactgaaagttcttttaaggttaggaagttttctgcactcgttcttggcaaatccccagaggagacccatttgagcaatacatttccttttatctccttggctgaggaatctcgtggtttgaatttttcccctctggggactttgtgggtttctggagtccagagaaagtcgttttgcttagatgcagcatgaggaccggcacgtggcacacatgctttcagtggggtttagcagggttggcagccaggacaaacttttcagtgcttgagagcatagcctggagcaagtcaggttgagccctgccctgtactgttgaacaaccctaagatgggaggagacagacaagggtgtaaatgaataagccatctggtgattcatgttttgaagaaaagaaagccaagcaggctagagagatggttccgctggttaagtgcttgccatgagatccttaggttaatccctagcattcacagaaaaggccatgcatgcttggcaacactgctaataatcccagcaccaggggcgggggcgggagcggaggaatagagatggacggttccatggagattcctgggccaaccaagtgagccatctccaggttcactgagaagagtgattgataaaaacctctgacatcaacctctggcctatgcacattttcacgcatgtctgcatgtgcctccacacacttgtacacacatacaaacacatgcatacacaaacaggaagcatgaaaagcaaactgggagtaggggaaagaagcagagatcagataagtgctgtctcagacagtgaatggaagtaaagccaaagcccaagcccaagaattagagagaaacactttattacatgggaacaggcaaagtggccaggtgctaagtcttctagtcaaatgtccctactgcttctgaagaggagctatacgtcaggttaggcagactgctaaaggctcaaagtgggaattcaggaatgtcaaaaggccaaaactggaagttaactaaaccatcaccacctcagggaacagctttctgacttcatggctgagtcagttcccatgggtactctccagagccccacaccttccctcggaagttcacatcccagtttgtaggtgtctgtgagctgctccaaaggagggctcatgtctgtctggttcacttgcgcttccagcactgtgtctagtagaaagtgttcctgtgatgcttgctggttgaatctgaaatgagtatgcaaacaaacaaaagcaaaagtagcgagcctcagcagctcaacctcacaattgatgtgtgaatttcttgcccattttttttttttaccattaaccttcaagtatatttgattctttcaaatgttagtctcctccaaggcctttgccaatgcaaaagcagacttaggcatgcattcgactgaccaacctttgcagaaagctgcacccagctctgagtggcatgtctcatgactgaggagaagacgaatgcaaaaactcttagttctgctcatatccctgtatttgctggtcatatatgaagtccagtggagtctctcatgagaaaggagcatcatgatgaaggagttccctctgtatcacagaagaggtcatgtctgaagtcctgggtagtgaggctagaacacaggatgtgtgcattgagagaataaatacagagagacagacggaaaaaaaattcaagatgaggatgagatgtgtggttggtgtaatgtggagcaataaaaaattattgtgcaagcagagtagagtcagtatagactcaaagacccaacacccttgggtgtatactgagaagtccactattgctgaaagcagatgagattcaaaaataaaaaaaaaatgggttcttggagaacatggaaagttgatgctatggcccagatagggggattgaaggactgtgagaacacctgataacatagcttacagaagagtgtagacataagaaacctcatcattttctctttccaaacctactcaaagtgttcagaatctaattcttctatctagccatcatagccctgtccatcttgacttggagtaacagatataccttcccattgctttgttcttgggagaggactcagtttctcctaacaaggtaggactcatctgccaagagatctctaaacgttcaatatgcattgttaatcatcaaagaggtctcaataaatgtttgccaaatgagaaatacaattataaaatcaaaaacacaatgtgaaatcttagaattgtatccaatacgtattataggaactgttgcatattaactttttaaatattttaatatactttaaatcgtctgatagcctttttataacaatatctgagacccaaagaaattaattaagttaacctaaatgacccagccttgggacagagcccaaaattcaaatctaggcaactgagttgctctatggtacatataacccacactctgtgtctttctggttagtttgtcatagcttgcttatttgctatttgctctgtgtctgtataagctcctggagaatagtttctatttctatagaagtcaggtgtgtcaactgagtgtcctcattaagtatgggattccttgcagtaatcgtggtgcatggttaatcttactatgttgggctttctcattgctgtaactaagtatctgagtaaggcaatttaagtgaggaagtatgtattttggcttacagtttcagaggtgtcaatcagtctgtcttaacaagagggtgtggcagaatacaacagttcacatcacagccaggaagcagagagagtacgttataggaacagaacaggatagaacaagatggagtccccaagatctaggcctggcctcctacttcccccttctccaaataacatgattacattataaatctatcagaagtcactccattccttggtccagagtcttcatgatctactgagacagacttacttgggggaggggtttcattgatcctctaagcatttctccatccagtcaagttgacagtgaagattaactattgtatagagaatttatggtcataatgttggtcttgggacagtggtggtaggtactccagataaagtatgaagagaaattgggagaaactttccaaatatttaccaaatggatgaaatagtaagaccttcaaatgtgcaagggacccatacactaattttggaatcatcacttggatccagcgcttcagagctaccaccaaaaactctagggcaattctggtttacttcttatggaagactggagatacctcagcttctctaatgtaattttacaatgtttaaactgaagcagctattcaccaaactttagggcttacaatgttcagggacagttaaccctaagtgtgaagtatgtttcaagactgtcaacaattcattctatctaagactgtcccataaagtgcctgccatacggtcattggggttgagttcagacccctagcattcatgtaaaacctgggcgattagtgaccatctataagcctagcactggggcaggggaagaaagttgatagaagatgccttaagctcactggacagagaactgaatcctgaaatccaggttcagtcagagactctgtctccaaaaattaggctggagagctattaaggaagtcacccattccttttaccttaatacgcatgtacacatatattcacaattcattcaaatatgtacacacatatacatacatacacatgacataagcaataaaatttaactgtgtccctatccacccatccatctagtcactaaatgctaatcatgtttagtgatcaatactaaacttaagcttttcttcaatataacacactagagacactgttcctctataacaaaggaggtccttccctccatttcactcccaaagaaaagacagtgacatctacaacctcttctctcgtgattaggatgttattaaccagcaagttagctccatgccagagcacagtagggcttaggggagcactctgaaatagctagggaaatcagaaaccagtcttcagattagttcttggctaactgagctcacatgttcacatggtcctctctgtacccagaacttttctatcaccagagagaagcaatgtgaaagccttcctatttcctttctctgattgttaacactgtacagtcagaaaaaaaaaaaaaaaaaaaaaaaaaaacaaactggccttttcagtttcctactccaggtgccctggtaggcctagcattgggatctgtatatgattgtggctcaaaaaagacttggtggtggttgctgtgcaccataaacctggaacaccttctcccctgtatttttgggttgcatacacataaggaatgcctatggcaaacctgtatgggcccctcataggtcatcacaataacagccaatgttgtctccatgctctacacacagtcttatatggtctttaatactcctctgaagatgctatcttcattttgcctatgagaatgccaggtatttaggaagaaatgagtattaatgttgtgttgttttcaatggaaacccttcactgtgtgtgtgtgtttttttttcctattatccaggggtaccaccgaccccggcactacattgcaacccaaggtaagtgtcttggagtgactcttgagtcactcttgataccctcaggaatatcaaggaagagggatttaaaaataaaatcaaagtaagcctttttatccactcgttctctctctgttttcaccaaagtctttctacactagtggcctggcttctcctgaaggaaggggggggagattttgcagatagagaagccagtgagacaggggcaacttggcctccagaagttcttgaggagcaaggtcatgacaagtccagcttagaatagcagcagaaagagctgtcactatattagtaagagacaagataccatgcatgggtgaccagaagataaaagtctcaataaatcaccgaaagaggtccccatccatcttgcgaatgcttgtctacaaaagagatacagccagttgccctagaacacagtgtggcagtatgctatcagaaggcttaaaattgacgatgccttttaaagcctccatgggagaagctctgcagataattacacgtgtggaccttgacatatataaaaagctttcttcacaatgttatcgtgtcatctgtaataggaaaaagtgggaaaatcttaaatgcccaataataaataggttggttaaataacataccgtgtctctatgttgtagtaaactctgtaactatgaaaaaatgccatttttgaggacatgaaaaaatacttatgatagacctggtacttattgcagcaaatacatttgtacacacaaaacacggaaaaaaaatactattcaaattttctttcaaatgcataaattgcttttgtaattttaaaaatgatgaagacctagaatcttaagagtcattttctaggaaattgctttagactgtcagatcctatcttccactctttgcttttcagtcctttcccttttttctttctcttttgttttctatgttttaatccttcctttcctggtcaagcttcagatgaatgtctctagcatttgtcaaactcaaaacgctgccccctcttgcttttggcagctccaccctccctaccctagctcccttgctagctctccttgagatcttgctgtcccttgaacacaatctacactatagtccagataaagtgctgaatcgggaaaaagtgaaactgctaggttgaacatgagggtgaggatgaggatggagaggatgctgcagacaacgagcatctaaaaatggggcttttcttatctctgctgtgttctggcccccaaagactcatctccagcctctgtctcagcaacttggtattccactagggctcctctacactcgttcttgcccacctctatagaaccttgattaaacagccaagagagttaacctttgagcagccgctttgtatctgcagtctctaaccctgtccccctttctgtcaccaggtccaatgcaagagacggtgaaggacttttggagaatgatctggcaggaaaactctgccagcatcgtcatggtcacaaaccttgtggaagtgggcagggtaagcctccccttcagtcatgtggacagagggtggtggagacaaatgttggggcacttttgcagtgtgccaccagcttccaaagcatcagcacacccttacagcagcctacagggatgggggatgccattcctcttacttcacatctgagcagcatccattccttcagctctcccatcccatctctatcctctctccgttgacaatgtcacctcatagattttgaggaaatgaaagctatcagatgtgtactctcttcccaacccgttacagacctacaatcttatttgtatcagcatccatcttcatatccttcctttctattatcaggtctagccaagagaaagggttgttttggttgacacccctaaaggctgaatactggccatttcttaggacaaagcccaatatgacaaacactaagtacctgccttttgataggccacccctgggaaggtgctttctgagaagtcactgcaagcctttgtttacctaccgtcctcatccgttagcccaacattctttatccattaaagaacctagtcttgcctaaaagaagagaatgagcttgcactaacaaagacaccagatggacggggcagggaagcaaccagaagttcctgagaagcaagtgacatgttcagctcttaagggaggtggaagggacctgtaactaagatgtgtcattgaagggaaggagccaggcaggacagatcaaacgtatcaatatcaccatgtgcaacccaccaaggctcagagattttcacatattcccttttcccttgaaaaataatactgttcctcactgctgaattatttccttcagtgtatgaatatgctcaaaaggacaaaaaccacagcacatgagtcacaaaacagaaacaaaaatcatcaaactgacaacaggatgccaggggttgggagggcagattgatggagaggaggagaagaagggagaggaagagagtaatctgaataaattatatttattatgaaattgtcagaaaaaaacaacccacaaaaatgataagactataaaataagttaaaaccttttgaaagccaaacaaaggtgcctgccctgttcccacttttctgctgaaactcaaggacttacatgatgctctgtgtctccactgggttctcctccacccacctcaacatagcaggtctctctcttcccccagccatgatgttgccaacatggctccctccctattgacaaacctggcctccacatccctctctccatctgtcttctcctctcaacagcctgttcttcctcccctgcctatgaaccttcactgttcttgagggttcaggcctctgtctccttctgttctatctagattcagtcctaagttgtccttagcaagagcttgggaaagaggctactatttccaattttgcttttgttcctttgattaactgtggcccgtgggtcagtgggcaggctgcacagttgaaaggttgatgtacaaatatctagactcaaagggctcccatagtgtatataaactatatcacgagtggacaggtaagttatgggtagtctattaggataaagtgtgctggtcgcagtggtggggcagaagaagctctccattctgtcatactgtattgaaagagtgtagatatctcatgggtcagggctaaatgagtcagtatccttgaacattcaccatctgaccaattgtccagttttacagataaagcacagatggaaaagggtggatacttgaaccaatcattatagtcctactcttgactcttattttaatacttgaaaccctgctgatcagactgtcccccactattcagacttcccccactattcagactgtcccccactgttcagactgtcccctactgttcagactgtcccccactgttcagactgtcccccactattcagactgtctcccactattcagactgtcccccactgttcagactgtcccccactattcagactgtcccccactgttcagactgtcccccactattcagactgtcccccactgttcagactgtctaccactattcagactgtcccccactattcagactgtcccccactattcagactgtcccccactgttcagactgtcccccactgttcagactgtcccccactgtttagactgtcccccacttttcagactgtcccccactattcagactgtcccccactattcagactgtctaccactattcagactgtcccctctgttcagactgtctcccactattcagactgtcccccactgttcagactgtctcccactattcagactgtcccccactattcagactgtcccccactgttcagactgtctcccactattcagactgtcccccactattcagactgtcccccactgttcagactgtcccccactgttcagactgtctcccactattcagactgtcccccactattcagactgtctaccactattcagactgtcccctctgttcagactgtctcccactattcagactgtcccccactgttcagactgtctcccactattcagactgtcccccactattcagactgtctaccactattcagactgtctaccactattcagactgtctaccactattcagactgtctaccactattcagactgtcccctctgttcagactgtcccccactgttcagactgtctcccactattcagactgtcccccacttccagctgctccaactgttcagctgcttccccaaggaataagcctcaggctgcaactctagtgaagaacagcagctgcccagaatttgagcattccagtctggcacacagcacattccacattctgaaatgaattctcctgatgctggactgtgaatggaaaccaggcaacttgggagaaagagcagtttcataatggaactccttctagtggccaacacacacacacacacacacacacacacacacacacacacacacacaccattatatttatggctcagtaatcacacaaggcagtgttcctggttatgagtcagacagtctgggtgtgttcctcactccattcctcgccagctgttgactgtgaacaattttctcggcttccccatgtttaaatcctcacctgtagaatgtggggcaacatattnnnnnnnnnnnnnnnnnnnntgtccccccaactgttcagactgtcccccactgtttagactgtcccccacttttcagactgtcccccactattcagactgtcccccactattcagactgtctaccactattcagactgtcccctctgttcagactgtctcccactattcagactgtcccccactgttcagactgtctcccactattcagactgtcccccactattcagactgtcccccactgttcagactgtctcccactattcagactgtcccccactattcagactgtcccccactgttcagactgtcccccactgttcagactgtctcccactattcagactgtcccccactattcagactgtctaccactattcagactgtcccctctgttcagactgtctcccactattcagactgtcccccactgttcagactgtctcccactattcagactgtcccccactattcagactgtctaccactattcagactgtctaccactattcagactgtctaccactattcagactgtctaccactattcagactgtcccctctgttcagactgtcccccactgttcagactgtctcccactattcagactgtcccccacttccagctgctccaactgttcagctgcttccccaaggaataagcctcaggctgcaactctagtgaagaacagcagctgcccagaatttgagcattccagtctggcacacagcacattccacattctgaaatgaattctcctgatgctggactgtgaatggaaaccaggcaacttgggagaaagagcagtttcataatggaactccttctagtggccaacacacacacacacacacacacacacacacacacacacacacacacaccattatatttatggctcagtaatcacacaaggcagtgttcctggttatgagtcagacagtctgggtgtgttcctcactccattcctcgccagctgttgactgtgaacaattttctcggcttccccatgtttaaatcctcacctgtagaatgtggggcaacatattttctaaggttgtggtgacatataattaacaccatatacgaaaataagccatggaacatttaataggcaatgctagacaaggtaagtatgagctctcattagctgtaggagtctgaggctctttctagaaggtacttagctccaaggtctcagatcccagcaatgtccatttgcctccaaagcctgttgtgtactgagtgttcccctaagtgggttcccagggatgctagcctacaggatgaggagtgagcagagggttccatggttaaatacgcttgggaaatgctgtgtcctctgcccggttgaagagtcctaagatacttattaacaacattagtacttttgaagaactaagtcatcttttaccaaagcagcttgtttatctttgttgaaacaagcatttcccaaactcatttgaccacaaaaaaacctctttttgttttgttttgttccttgttttgttttgttttattttattttcatttttgtttacctaacacctattagcacccagcggaacacactgtgggaactgccacgctaggccgtgctgcatcccccggaatggtaataatgcttttgttattttaagggggaaactatgatttctttttctctctgtggaacttagagccaaacatgggactggcttgctgttagcatagacacctaccgctggggcagagagtagtggtatatcttccctttgagctcaggattgtctgtgtcttccccaactaagaacctttctccttccagcccccagggaccctctcctaatcgcttctgcttctccctccttgctgttccccacctgatttctcaacctcactcagatgataatgcttagcggctccacgctgacacagcaggaaatgaacaagtcaccagtctccagtattattattcatctgctaagtggagatgatgaacctcccatcttacctagttctttctgacggcttagtgtagcaaggcagcaggaaaccacaaggagctgtaagagaagatagtgctgttgttataatggccccaatgactctggcagtgagttaggccctgcacaatttgctgatccctgaccactgagtgccccatgggctgaaatgggcctccaaagtcacccttgggtttattcggataggaaagccaaaggaggtggcttctcaccctcctccctatcctctccctgtctatcactcggccacaggtgaagtgtgtccgatactggccagatgacacagaggtctatggagacattaaagtcaccctaatagaaacagagcccctggcagaatacgtcatccgcaccttcacagtccagaaggtaagtttccctttccacggaagtccctctttgaagccaattggttggtctattcattcagagagtgtagagcaaacgtctgatttgtgcccagctggcacgatacaacagtcagaatagactttgcaaccattcctcaaccagagagatgaacagacttcaacagacaatgtaatagactaaggatgtgatacattctgatgaaagctatatggtaccaaaggatagaggccaaaatgaacaggggcacaagagatttaaatgtaccccattgcagacccccagatccaaagtaatttgtagagaaaattgggactgagaaggctccggtagaggaagggatgagaggaatggtatccttggccaagggtcaaaaacatgtagtgtggagggcaaaacgatgtcagcatttcccaggctgggagtctggtcaaggattgatctcaatcaggggtgatttggtcctctggttggtgtttgtctgatttctcctcctctgcagttacattagataattcctttctatactttaatatagtggttttcaacctgggtaatgccatcagaaatatcagatatttacattaagacttctaacagtagcaaaattatggttatgaagtagtaatgaaaatagccttatggttgagggtcaccccaacatgaggaactattttagagttgcagcatgaggaatcttgagaacctctgccctagtagaactatccgtgtagaagtcttccttactcagtgaggtcatgagcgaatccaggagcaggaactatggcttaaatcaccgcttcaaagggcctagcacacgtccagggaaagatgacccttggtaagcaattacctaacttgagataaaaaataataataataataataataataataataataataataataaaatagatgtttcctagctccagctaggaaatgccatgaatgtctgctgaagacatgcaagcaaaatactcagacacgtaaaaataaataaatacattcattcatttttaagatgtttttcaagcaactactggtttcacgttttccaaaagcaactgggccgagtttccatgagttaacacccattcacacagcaagggcctcacccttccccgccaccccacgtcacactgggagagtaatgaaggaagcaggtggagaaacagaggcccattctctcctcagaaaggctaccatgagatccgggagctccgcctcttccacttcaccagctggcctgaccacggtgttccctgctatgccactggccttctgggctttgtccgccaggtcaagtttctcaatcccccagaagctgggcccatagtggtccattgcaggtgagtcaaacctccatccctattcttcaatcaacgggacctctagggatctgctctctgggtgagggtgatactatcctgtcccagggccttggttttatggctttaagactcctcctcctatgccctcccccgccccctcgagccttgccaccttctgaaaagacctgtccaacaacaatggcagtaatggttaagttactgttaaggttgttactccaagggacacaatggggcttagcagcagctgctatgcctaccacgtatattatttcacttcgcatccaagcttgataggtgagcaatattcttatcactcccactttacagatagggaaactgaggcacagaactagtagagagagctgggaaatgtcaaagctggtattgttaacatgttctctggagcttcctggcagcaacttgacatgggacaccttggtataagaatgtgtctctttactcctattatttgtaatatcagttgcaggcctgcagggtctttaatagagagcgagtagccagcatcaggttccccttattactgagatggggaacttttagctttgacctagaaagtcactttgaacataagtggcattggattcttctaaatggagatgaagtattgtgtcaagggcatttggaattggaagaaggtagatgcccagagctgaaggccacagagtccccctccttcccaatgcccctcagtttcagtatgaccttgggctcagcatgtctccttacaccttgtatgactcggccatttcatacttcctggcaatacctgtgtcagtccagaggccaggggagactctgcgaatgtctcagagccagctcctcccacacatggcatccctttgtgttctccacggcagcagatacagaaccaaccacacttcacagggaaaacctgagggtttcgccaaagcctctgcactgtgaacatctggcatggattctctgctttgtctttctctcattgcgaagagcaaaaggtccgttagcatctaagcttgctatctatctcctaaagacagccagagatcaggaggtagagaggaagtggaacaatggcaagtagtcatgagaccctctgccacttgtggtcctgagtgtggtctgcgcttgcatctccctagcaattcactgtaaagtgtcggagcagagtgataccttctcctggggatgctacggtttggctgatgcacactaagtgcctgaaaggattccaaaccactctcccagactcttaccattacccaacaccccagacaatgcgtaacaaatactttaggacagtaagtgtcttttactaatcttcctttccctactcttaactgtggtatccaggacatcaaggatgcttgataaatatccgtggagtataagtagccaggcacaaaactaagcaatttacatgcattatgcctctaaaatgcaatctaatgcaatttacatatgttgtaccattaatactaagaggtctatggcctgtttcattttatggatgagaatagtgaaacccaaagagatgaagtcatttgtccaaggtcacacagctagtaagtaacagagccaagatttaatctcaggatctcaaataccatgtgtttaactactagtttattctagaaaaacaaaacaagatgcatgcacacactcatgcacgctcacacacacacacacacacacacacacacacacacagctcagacttttcaaaacctctctcagagggcaggagctgaagttcactgacaccaggcaccttattcaatgatgttggaggcaagattcaaatccagtgataccagttcattcccatgagataagtggggggtgaggctttgggaaacatgaatgaatgactatctatctatctatctatctatctatctatctatctctatctacatctacgtgtacttcacatctacatctatctatctgtatgtttatctagatagattagattggatatagagagagaaggggaagggaggaggagggaaagagagagagagagagagagagagagagagagagagagattccttcccaagctccagagccagttctgttcaattcttttggaaggggtcttgagttgcgtggggacaggtatttggaggcaagattaagtcagactacactcggtttgaatgatggcagcttgtcacagatgaggactgcttccaacgggtttggtttccagaccaccattgatgtgggccccggttggccattgcttcatggccagtgttgctttagtatgtcattgatttgtttccacggggcaagtaaagtgtgaaagcaccatcaatgtgggcttactttacagtctctcctgcattcccttccaaaactgtgcacagtacaggccagcgttctgtgattctgccctattgttttatatcccagagataatctgggaagatctgtcctgttccagggagttttgtgaaatcctcttgctattctgtgtcttgtctgagattcccctgttaaagcttgtcagtaatgacaaactgattctctgcccaggaacctggtgtttgatgaggatctcaaggctgtcagctgctccagtttgatggtgtgcttgactcatgaccccgaagaagccatcataaatgggtcaactgcagggccttgaataggagactccagatctactctctgcctttagacacagctcagagctctctggtctctgtctatcccactctctgtaacctaattaaaaaatgaaagggagaaggagaaagacatgtttactaggaaggctccagtatgccaggcacactacacatcttattaagaaaggtagtagaagctctacactgtctcagagaactctcagctctcccatttgccagttccatgacttcaggctacaagttctctatgcctcagtgtctcgacaatgaaatgggataagaaacttgactatcacctcctatcaaatttgtatagcaatgtattgtacaaaaagtactccataagcatttgctatacatatacaacaaaataaatccttgaaaccacctccaatggtaagcattgctttccaatctaatataagaaaatttagtcacttgttcagcatagcttagcaatgttagggtcccaaccattccatctgacttctgtaaccccctgcctttcagcaaggcttttgagataaggtcaaatggtaggggccttatcaccataatccatcccatcccaagatccctaacacacacctaacttctcttccagtgctggagccgggaggactggctgcttcattgcgattgacaccatgctcgacatggctgagaatgaaggggttgtggacatcttcaactgtgtgcgtgagctccgggcacagagggtcaacctggtgcagacagaggttagtcctggggtagtaagccagctagttaccgaaaaccttgaccaaagagaagcatggtgggacagaggctcattatggagaagtcctgcagaaagagatgttcctgtataactactggtacagggtacctatataactcgatatggggagatgtccagaccaatgctgggactctctggtataggaacttctggaagcattaactggtgagttctctagctctacagtcatccaagtaagattgaataacgttgttagagatgatgtttgagccttggatgaaggaatggagagggagaggaggtattgatatttatggaatgccttctttgtgccaaacgctcggacagaccttaatagaaatggcttaaccaacatagtgattttttttaaacatttatttacttcattttatgtgtctaagtgttttgtctgcatgtgtgtaagtgcaccacatgtgtgcctggtgctcacagaagtcagaaggtcctgttaggtctcctaaagctgaagttaccacagttatgaaccaccatgtgggtgttgggacccaaaccctggtcttcagcaagagtagcaagttcttttaactactgagaaatctctttagcccaaagttcttgatatcaatgccttgagccaaaggctgaggcatcctagagaggcatacatcatccttgccttcaaggaagaattctgtctagatggagagcccaatgcctgaggataatacaactaagattgtctgaactgatagagttaaaacaatactttctggaaagaagaaaacatgaagatatagaaaaggagaggaatttcatcagaagagaaaagtgggtcccaagaagcaggatggagaggatggagcacaaattttaggatcagaccctgagatgcaactttcagcacaagctgtctctttggaggcaaacccaagacactctggttgttgagtgtaaagtgggataggacagaaataaactaagtgtaatttattgtgctgtaacatctggaacccaatcctgctggcaacccctgagagacaatgtagaccacatttctctaaactgtcccatagaagaagagtggagccttggggttttgtccccaaccctgcacctgtcttgtttgtttgtttgtttgtttgtcctaagcgtaagactaagtacactctgggaagtaggaagaaagccccccagagagaagagcaggggtttgcagctagcagcttctctgtgagagctgacgatgtgagtggaacccctggagcacctgtgatggcatgtgcttacatttctcacccttatcagtgactctgctgtcccatcctatatgagagaaaaatgtgctgtatagctcaatcactgtagaacactggtgacttagacctttaggttacaggataaaaactaaggattctgcagtataaatcatgtcttcctttgttgctgcaagattcgttccatgtggacaaatgctcacaggcatttgttctgaccggagccctcttcccctccccttgaccttgcaggagcagtacgtgtttgtgcacgatgccatcctggaagcatgcctctgcggcaatactgccatcccagtgtgtgagttccgctctctctactacaacatcagcaggctggacccgcagaccaactccagccagatcaaagacgagtttcaggtatggacaaagccgatgtgcagggacttggttgctctgagttgtcctaacaaattcccacagcctgggtgacttacatggcaggcatttgcttttcacatctctgaaagcactgaagcccaaaagcaagctaccagcaaatgtagtatcaggggagagctcagacacgactgtggtttgtgagtggctgtttccttacaatttcacatggtgtgtgtgtttttttcattagggacactgatccccaattatttcccaaagaagctacatcctcgtatgccttgctgggagccaggatagcagcatattggacaggggtgcaggaggaagtgtgtgtgtgtgtgtgtgtgtgtgtgtgtgtgtgtgtgtgtgtgtgtgtgttttcaatcaatagcaatgacctaggaaacttcaaatgcatattgcgagcttttcttcatgagattggtgtgtgtgtgtgtgtgtgtgtgtgtgtgtgtgtgtgtgtgtgtgtctgcagtgcccagcagctgtggaaagcttttcacaccatcagattgcacagtcattagcaactattaaccaatcactcaatgatggctgacattggtttttctgctgtgattatgctattgaactgaggtcttagttaattcttgttgatgttgtggaatggacagaagtttataagctggtgtgaatttcatgcttccttgagtctggggagactgtagcctcggtgttttctccacaaattccattgcatggactccagaacttcttggaaatgaagactcttaggccccacccaaacctactgaatcacaaattacaatttaacaggatctctgtgtgcttaagccttaaaccatctcttagagcatggctcaggtactgcagatccacacctttgaaaccaggatgttcaaagctgcagctttggtctgagaggactgagtagaagacactaaagtcctagacatagcactgagtaaaaagctagcgttcagcccttcatcccatggccaagaccatgacatgtctgggcaatggtgctgtttgaactgggcagtaggtaaacaaataaaacctggttcatactattccagtcaggctgatattttagggcttctttaaccaagtaatctttattgtctcagagcagggacatgtcaagtgtcagagcaatggaaggcacacaaccctggacattgcacataagatctagtctattggctggtacagatctggtccctaactgtgcgacttactctacagagcacaaaccttgcaattttgtagacctactcattttccccacaatgccccttatccaccttgagcagcacatcctagcatccatccatcgtccttccatgttaacactgagaagaatcctggtaaataactttcttccttccagggtacttcaagtggtgtttaacattcattagggattctccaacccattccctgccatatgcccttctggctggcctcccttagtgctgtgctaacccagttgaacaacagtttgaatggttggcaggtgttgttagcccgtggcttaccctgtgtttgggcaccctgcccctgcagccttggcaccttgaaggtatcacaaagctcctggcaaagacccttagtccagaagtcctatagcagcaagcagggtataatagaatatcactgtcatgggaggaacatgggtttggggaaagaggtagcaaagccaagcttggaggagagacaggtgaattaagataagctgggatatcaattcccttcgcttagatacagtctcctctattcaccgttgtacccccacagacactcaacattgtgacacctcgagtgcggcctgaagactgcagcattgggctcttaccccggaaccatgataagaatcggagcatggatgtcctgcctctggaccgctgtctacccttcctcatctcagtagatggagagtccagcaactacatcaatgcagcactgatggatgtaagctgagccctggcagaaagcccttgggagtcattatagaaaaaagcccatcatggagatgactgaatcccagagcccaactggccaccttggttctgactggtggcttctgagaccatagttgccctggagcctcatgtccaaacccagatacattgtgtgcttttgtctctttggcttaaaaaaggtggacagaatggatcaaaagctggaaaaaatattcctataatatctcaagatgagttctatcctgcatgcttctatgtctggcaggagttcagttctggccatattcctcatgccaggccttggtctgggaccttgggagacaagaggtagtatagcatcttggagttccttctggtgtatctcaaatgagtcctcagataactcctgtgcagaggcaaagaggaagatagcacacagtagatgtttagtaaatggctgctgggcaacgagtagaagtaataaaaagataaagaagggaaacgggacatgtcccagatttccttgctaaggtaccatgcttcctcagtggcatgtcccagaagagaactgctccctgctgtggtttgaaattagggaaatattctgccccagtgttcccatgcctctgcctcatatgctctgcccctgtgtctttgggcattttctggttataaaattgcaccttcagggtctgcagacacttgtagcagtgtgaaccataggcattccagtctcacccaagtgctttgcagcagaagagactaagagactgaggaagatgtactcagggtattccagagaaataatggcaaagccagagctccagctttcactccagaattcatttattgtccctcccctgtttgtttgatcaatccactaagatgtgtgaaacttggcttctaaggctcaagaccaagagcgctattgtctgattggggatgcacaattacaagatctctcctcccctttccccacttcgaagtcatgttcatccagcccatgaggtcccccatctcacttacagacaagagagtagccacttcctggatcaagaccattacttctctgacctctgattgtcccatatgttctaagttttggaaacaaagaagtaatccaaggtcaattcccaactaaactctcaaatgacctgtcctgacttcagctcacaggtgcttatattctcctggctgagtgtagaagtggagagttgtgcctggattgtgttaaatagctagacttgctcaaagaagaagtaagtcttctggtctttctagcctaaggccttctaagatatctctctctctctctctctctctctctctctctctctctctctctctctctctctctctctctctccccctctctctccctctctctccctctctctctctctctctctgtgtgtctatgtctatatgcatgctgtctctgtgtgactgtctctgtgtatttctctctctgtgaatttgtcttcttatctttctcctctttctctctctctctgagtctgtctctgtctatctctatgtgtatttctctgtgtgtatgtatgtatgtttgtgagtaagtgtgtgtgtgtgtctctgtgtctctgtctctctttgagtctgcctgcttatctctctctttctcagagtctgtctatctctgtgtctctgtctttgtgtgtgtgtgtccctccaatcactgtctctctctccaagccacccctatcattatcccccaccttcccagcatcctctctctacattcttcatccaagcaagcatcaaggaagctcctgacctctgctttgcaggttagatgctgcctggagtcaaatgccttgtgccaagctctgattctgattgtcttctctttgtccacagggcatttctcttttgagtcatcactgcagcctttgcctttcttatatttaaaaaaaactccttatctgtattccagctcagtctgtgcattatctggtaaccatagcagctttgcctctagcagaaaaatatgaagtcctctgggttaatttttaatgtttcccttggtaaaggatgatgttatccacgaaatggattgctggctgatccctgaaacccggcaggagcgcagatctcgaacatattttcagataagactttgtcaggcgtgctggcctaatagagcatttatcatagagacagagaaagcaactagaaagaaaactaacattccctgcatgtcgggttctggacttgagttgtctcatctggcactggggtattactctccccattttttggagatctaatgagggtcagggtattttcattacttgctcaaagccaactggctttgagatggtggcaccaaagacccaagccccatccatgcctgctgtcttgaaagcctgagtttttaatttaatattattttactttatgtgtatgaatgttttgcctgaatctgtgtctgcacaccatgagtgtacctgaactggtgcctgcagagaccagaagaagggtgtgtgtgcctggtgcctacagctccctggaactggagttacagacaattgtgaacctccatgtgggtgctgggaattgaactcagatcctctgggaaagcaaccactgctcttaactgctggatcatctcaatagccttaggctggatttttttttccagtgtagaaatggctgaaaggccatgctgacataacctttgagcttggagacatttaaagggtctgtcccccaacacctattgttagaccatccactggtcaaaagaaggccctgggaaacaggaatccctagtgtagacgcaataaacatgtctataaggccttgccgtgctatttctgagcctctgtccttctcttcccatttccttctgacttgtgactctagagcaacagctctgactcccacctttcccggctaccttgataatggatcgaaacaatggctgattttcaggttgcacaagctaccaatgaagtggagtcactactcaatctttccaaatatcttcccctttggtattgtgtcacatggggcccaaatgaagctctcaagtttatactgggatcctcccaacctctgggtctcaatgtctatgtctgcaacacaaggacaaattaatgtatttactaatgctgtgttgtcgttgtttctaatgtgaaattaatgtatttactggtgctaggctatgattgtgtctaagtgtgctacccagactcatcactgatgccgaggaaaaaacttaagacaggaattgatccaccctgtagtgaacttgcttaccatgttttttctttttgtttttttagatttatttttattagttttgattgtgggtaggtgtgtgcatacctgcaagtggtgtgtgcatacctgcaagtatgctcacgtacataagtgtagtgcttctagagcccaacggtatcagatcccttggaactggaatacaaatagttgtgagttgcctgatgtgtgtgtgctgggtgccaaattcaggtcctctggaagaacagcaagtgctctcaaccactgagccatctctttagccctaattgccaagtgttgttggtttatttggttttaatttgcacaccacatacattgtacgacaaccatcccttttgatttaagtttcgttttccagaaaaagagctttgaaaccatctagatttaacagtgtttactgcctgactctccacaatgatatttaaaaataagaatggataacaaatgggtgggtagtgctggatgaatgaacacatgggtgagtcataatttatgggggacaaaactgggtttaaacctcaggtccacatgattctaatgactggctaactctactgccttgtgggctaaaggacataatgtcacctctggccaagctagctcagctctcaatccatcccaaagacaggaagatccctgctatcaggcccctctgaagccattggtcccctcctcagcatcataggcacaggaacttgtgggatccctgatatgacaagaggtgctaaggccaacagcacggtaaacctgtatccaggatttttcatttcacattgtaatgatgatttgctgagctctgagacataaataatttatttggataatccctatcctcatgacactttcctaatgaaatgtcttagtttggaggagaatgtgttcattatgggaaggtcccctttgccgccagggcacggagagataacagagcaggcaggtgctgtgtgaaatctgtttggcaggctcagggcctctggcagtcatcccagcctcatcatgatcagaatatcactgatgggtatatatttgactaaacctgtgtcactcttttgtcagagccacaagcagcctgccgccttcgtggtcacccagcatcctctacccaacacggtggcagacttctggaggctggtgtttgattataattgttcatctgtggtgatgctgaacgagatggatactgctcaggtaggaggcgaccgtggggctgctaaaggtgggccccagtgggtcatgatctgtatgctatagacttgcaaggagactctacaatggcccactggtgggcattgtcagactgtcaatactattccactgcctgcagagtcaaagagtctcctactgaatcctttaccaatgactcccataaactagtccccttgactatgggctttttctgagtacaccaagaacaagaccctgctgtctaagccttagacactggttaaagccttactctaaatcatgcagagatcagaaaaccaagatctcacacaaaacactgaacaccaccaccaaccccaaaggttcctcgccatgtagcctctgctggcagaacctggagtctgaacctgggaatcttcgctccctgactacatagccaagccttgactttatgccatagcccctctgagtcttttagttcccaccatcacgtgcctatattttcacacacctaagacattggacactcttttgggacagcctctggatacattatatgggatacaggagatgaaggtggcctttcagatttttgccatgttgtcttctctgtgccttgaaggaaacccaaagtcatttggtacactcttgtgtgagtgctggccttgcactggccttgggtgggaataattttctttctaaatgggcttgagctatagtttcagccttccaggagctgccagtcttgctacagagacagatgggcaagttatcccaggctcttgtggctgtgctataatagaggtcagcaatgaagtgccatgttgacctagagcagagagcaattaattctatccagagggtgaggaaagacttcaaaaggaaggtgatttggaccttgaagggagcaggggcgatctgttcatacaggggatgaatggctggagaaagacttctacatagaacaacagaggcaacagcaagtcagatggacatacagatagttgcttagagccagctttggttccagcaccctggggctgtatccatagggaaagaacgaggtaaggctggaacaagacagcagggctcagacagcagagaagttccctctgcaggttcaggagcctgggccttgaactaaagccctgataaaatcagactgttgtttgttaagtgataagatcctttccaccaatgaagcttttatgcaaacccagtgaatgaagcaaaagtaagcagccaaggtctgagcctgttaaagcaggaggtggggaccctgagcaccacccacactggtctttcatctgttcctcatagcccttggctagtcagctacctgagtccctttgcagtatgcttcccagaggctccaggataattagaaagcctttgctatccatgggggtggtccaaaggtttctaacttgtgttagaaagtagaatctaggaccagagagcacaggcatagagatcagagactggagaaagatgtgagttacgtttagagactgaggggtgggggatctgaacagaggaagcagcttgaaggagaactcgggctagatgtaagatcattttccagtgtgaagtccacacagttcaggtcgcagctgcatgcgaatgtggacaaaaagtcacagatggtggcaggtggcttgtctgggtgatcagacatccaggaagcacctggccaaaatggaaatgcaggaagatgggaggggtgagcatggacaggagcagagtgggggtgggggggagaggtgagtgtgtgttggaatgtgcccatgcgagttatccagaagaggtttcctctattcacacaacccatatttgttgagcatctgctactgctatttgctggaagctattctaggttcttggaatgtatcagtgaacaacacagacaaggtgaaatgagaatattcccgtcttccatgctctttctattctaaaggggagagactacccataaacaacaaatgctctataaggaattcaatcatatattgagacatgatgacaaggaagcataaatgaatattgtaaaactgtgttgggactcagatggactagggtagtcaaggaagggcttgagaatatgtgagcacagagttgaaggaagctagagagcaagccacaagttcctcccagggaacagtgtatccaggcagcgtgataggaaaatacctgatgctctcaaggagcaacagagtaatctgaggccagatcagggttaggtagtgagaatcagtggtgatatgagaagtgtaacagggttatgtgccatgtgaccttagtcaccatggggagaatttaggacttcactctgcaaaggatagggaaagtgacatgatttgacttttaaaagtatccctttgtctgctatgttgagactagagggagggaggtgatggtggttgatcataataaaagcagaaagcacacagagtgacaagaacagtcaggcacaggtgatggtggcttgagttatctagtaatatggtgtagagtctacatgtatcccaaaggtaggaagacaaaacgtgctttctggttaaaaatgggaggtaaaggatgatgccaatgtctgggccctgaagaatgaatggttagggaagagagataacaatagggaataaagtaaatccccctaaaagagagttctagaatattctagaatcggaaattatcaccacctgctctactgtttggacaagtaaggcaactcacctttatgaaattcgagcaaggtgggacctataaaagcctgtttgcactccttaaagttgtagttcaatggcagagcaagtgaccagcatccaagaagctctgggttcaatccccagctgaaggatgaaggtctagttgctcttttttctgtccccacccccccctttttttttttcaaaattgaagcttgggaacagaatgagaattgtgaaaacacttacttttggacctataatatcaaggtcactgacgttagcttgctcttttaaagagtagtccttggtgaatgatagatcttttagccccagatgttggcacagcctttgaaaaccaagtctctgaatgtaaaaacatcaggctccgaagcaccctgagactggctgctatacacagctggcaagcatcccctgaaactggcagatgagtagagcacttattgatataaatatcaccacagcagctgggtgccttgcaaaaataaacagtgataaagcatgagcaccagaaaggccgccttcggcacctggaggggtgtgtctttgaagtggtatgagcatctgcctgctagcatgcttttgccaaggcagctctacatgtgggccaggccagcaaggtggacgggtctactgaggccctaagcagctctcagtcgctgccaagagaaataacagttcagcctgtggcttgaccgtgaacgcctcgtggaggatggtcaagctacagatgggatgcaggaagatacggatagggagaagatgcgagctcccagaagcccttattgccttgtatcgctgtgggaatgagctctaaatcctatgctccttctttgaatgggccatctgccgtcatagtattgtttttcacagtagctgctaatcagagaattatgataaaattctccatgagagctgttgataaaagttgtcaacccctggagttatttctaactcttttgactctgagggctgggaagtaacttgctggataaagttcttgctttgcaagcatgaagactagagttcatacccccagaatcctgtaaagccagacgcggcagtgcaatctgaacgctcctacccagaagtaggaagcagaaacaggagagtccccagatgcttgttgtgggccagtaagcctggtgtgttcatggcaaacaacaaaagaccctgtcccagctgagctaggagatggggaccaacaccagagactgtcctctaacctccacatgtgcgcatgcactgttgaacacttgtgcccaaaagcccagcatatcagtgtacatacatacacacttacattgacattttttaaaacctttattacacttagttaaattgttcctatattatgcgggtgtcagtctctctgtctctctctgtctgaacacatgtatcatgggtcacttgtgaaaatcagagtacagcctatagaaggcagctttctttctacactgttagtgcccaggatcaaacacaagtcatcaggtttgttggaaatctttatgagccaactcaccaggctacataatttaaaaaaaaaaaaaaaaagcttcaaggtgctatggtcaactaggccaggcaaagtcctagatagaacacctaacatgaggcctgtaagtgagagatcttgcaagaaaaagccttttatcatttttataagcccatgaccagaccatagtacacaggaaacgggcatcagaaagaaacctgttgttgcttgggtgtgttcatgtttcaacacttgatctccatctggtggtagtggtggtaggaaagttatggaacctttgggaggtggcaccttgctggagaaagtgcctgaccaagagccttgaaatttggatcttcttcctgttcattttctacttcctgactgtgtcatgcatgtggccagctgcctcccatccctgtggctctgtgctttccctactaggagccaaaataagccattaaactgcatcttgttggggggtggggggggaggcttgtagctgtgatgagataagttctcctgtgtggccatggctcactatgtagtgtttagaaagctttggggattgtccataaaaggagtagattctctctctacctacaaaggactcaacatgcggtatcaaggtgagtggtttgagttggggcttgagtggcttccaacccagagggaggctctcaaaggccttgtcaatcattcattcatctacatacctttattgagagcttatcatgggctgagcacagacctagacacaacagaagaccaaagaggcacccaaatctgtgggtccccgggtggcacatattgtgcaaaaggaatgaatcccttgcaggctgtctttgattaaaagtaaaatctccctaggttgaaatcagctcagtacgaaccttaagtgaccgaaagacacaaagcaaacacaaagagagtttctttggtcaggatattttactacagaacagaaaagtagctaagatataccccagccacccaatctgttcccttttctgcaaaattcagctctttccctctcagtagctcctctcttcataatctccccataacctgcctcacacatactgagttcctatgggtaatgccctaaaccctccccttccttcccaggagaaagttcagctttggctttcataagagtaagtgtccacgccccatgcagaaatcacattcccacttagggggatgaggtgtgtggatgtcttttgatcaccatccgggtatttctttctgtgtcccctatacctttcacccctactcccacactctctcatctttaactggccacagtgccaaagccaattatgtaattctatagactctatttaaaggaatgttataatcatgacccagaattttaacaccaactcaggttattacagtactctacttaaattccacctaattcacttcgctgttaagtgacccacagttaatcctccccccacccccaccctggaagatcccaggaaccttgtgagctagagtcattcatttctgagactgtgatattacctaccctttcctacttatcaaaggattttttaattaacaaaaggcataagtaaggtgaaccaaaatatactttaaaatcgtttttccaaaaatagaaacatctgctagctttcattcaactatcagagcgtgtttattatcgtgatgactaacaagctttcagattccgagatgtttaatgagggaggctacctctgcctttgtcacatttcagacctgaattttcgaccctccccccaccccaccccacacacacagaggacttcttttcatggccttaacagttatggagatcactaggtggcataatgcacagcagctgatccaacactgtctacactgcctgcttgacttttgctgggtttaactcatcaacagacaacagaagtcctctgccttctgcgaagaagtgtgagcatttctaaatcatctgtcacaatgaggctggcttctctcctagagacaatcatgggccttacctatgcacatctgcagtggaaggccctcccttctggcagctccatcctccctagaccacggggaaacaagagtggcagggaagaacatctggtccaaactacagacttttaatcaacccatttgggagcatctaggtgtgtgggcgtgtacatggaggggtcaggggtcaattctgggtgcctttagcattctctacttcattagtttgtttgttgctttgtttgtttgtttgtttgtttgtttgttttgagacagggctcctcagtaaaccttaggctcatcacacacacacaaacacattcaacatacacatacataccgatagtaattaaaaaaaaaattaaaagaaagacatagaaggtacttcaaataggaacttcaatgcatttatttccccatctcccagccgcaacaaaaaaatcctctttggttttccaagtttctcttgagaaaaccctacatgcaaggtaaccaccttgcccctctgaccataacaatgcctgtctccacagctaccctgagctgactcttcaggaatttttgcaatgaagtcgagcctttgtgtattaatcccaaagataaactttcaaaatgactgaaacagaaagaaaaaaataaaaacctttctctttatccatcttgtcttaaataacgctccctaatggtgacagctcatgtgcccagatttctcactggagacatccctatgcaaggagacattaatatgcatatcccctcataataaactgtaggaattaagagacttggacaagttagcaagagaaaaagtatcaaagtggaatccaagcttttcatttttataggtgtaaatagaggtcattgaaactaggaaagagaaaataaggagggggggtttgaggaccacaagaatgatagaatacatgtgacttgtaggcaagaaggataccagagaaaggaagggcaagagaatggaagaggaggaggcttaacaaaactagttatgtctgaaaatacaggagacaaggaaacctgttacctctttgtttgcttaatcagtgtataaagtaaccaattagtgtttgcactcttagtttgccctgctccccacgtgatactctccaacccccagtctctctatctcctcccctctgcattcctaacaatctgccccagtattctccttgttgtgtgtgttgttagtctcttcataccacttattttttatttttattattattatttattattattatttagatattttctttatttacatttcaaatgttattccctttcttggttcccccttcaaaaaacccctatactctcccccttccccctgctcaccaacctcccactcctacttcctggccctggcattccctatactggggcacagagccttcatgagaccaagggcctctcctcccattgatgaccgactaggccatcctctgctacatatgcagctagagccatgagtctcaccatgtatactctttggttgatggtttagtccctgggagctctggggggtactggttagttcgtattgctgttcctcctatggggctgcaaaccccttcagctccttgggtcctttctctagttccttcagtggggaccctgtgctctgtccaatggatggttgtgaggatccacttctgtatttgtcaggcacgggcagagcctttcaggagacagctatatcaggctcctatcagcaagctcttgttggcatccacagtagtgtctggatttggtggttgtatatgggatgggtccccaggtggggcagagaagcacctaaaaaaaaaaaaaatgttcaacatccttagtcatcagcaaatcaaaacaaccttgagattctacctcacaccagttggaatgactaagatcaaatactcaggtgacagaagatactggtgaggatgtggagaaagaacactcctccattgctggtggaattgcaagctggaattggaaccactctggaaatcagtttggcagttcctcagaaaattggacatagtactaccagaggatccagcatatacccagaagatgctccaacatgtaataaggacacatgctccactatgttcatagcagacttatttataatagtcagaagttggaaagaacccaggtgtccctcaacaaaggaatggatacagaaaatgtagtacattcacaccatggagtactactcagctattaaaaaaatgagtttatgagattcttaggcaaatggatggaactagaaaatatcatcctgagtgaggtaacccaatcacaaaagaacacacatgatatgcactcactgataattggatattagcccagaagctcaaaatacccaagataatgaaactcaagaagaaggaagaacaaagtgtagatactttgatccttctcagaagggggaacaaaatacccatggaagaagttatagagacaaagcgtggagcagagactgaaggaaggaccatgcagcagagactgcttcacaccacttcttaaagctcttttcctttattcctcttctggaccctttctagcttcctgacctcttactagacttacacacacacacacacacacacacacacacacacacgtataaaattaggaactagaagctgaatatgagagagcataacatttgtctttctttgtatgctacttaaaaaatagccttgagaaaaaccaaataaatagattttaaaatatttttaaataaaaaaaagaaagaaagaaaataaagaaaagaaaaacaaaacaataaaaaaatcaaacaaaaacaaacaaaacaaacaacaacaataaaaaccaagggaaatggatccaggtaaacaagctcagtggataactggctggcagtgaccatggtgggggaagaaaactgaactctgaaagttgttctctaaactctacaagcaagtgacatgtgtgcgcatgcacacacacacacacacacacacacacacacacacagggaaatagagtgtactttgatcatgagccctaatgcatttgtttccccagttttcctatgcttcatactcaggacaaaatggcagccatgcgtttggacccaaagatggtcttaagctaaaccgagaggacatttttgctgatgaaaatcatttgcaagcctggaagggtcactgggtatggagcacttggcttctctccacactgtctcctatttcctgtttcatgatcacgtacagctatgagaagacccagaccccaacgatccctggcagctcagatgcacatctgttcacacattgcccaggcaaatggcacccagtactgcagttgtggtctcacaaactaggaagcccaagtgaaaggatggcactgctttcccattggaagggccctgcaaccttttccagccctctgggcattatgggaaaacaacctggaaaatcaaatgcagagaagagtcctaaaatttaggtctcttgtttgaggcatagtagaacctattagcttgagaaattggtctggaaatcttattaaaagagacaaatcattccacattctcctcaggctgaaaatatcgggggtaatagactctccccagtgcctcggacccatacgcctcatgtcaggatcacagctgaactctggcaaggctaaattcaatgcaggcaataaaggcaattattttttttaaatgggaagttctgattaattccagtttctctggccagtcacggacttatcgggaccagtccctcattactgtgaaggttgcaaggcagaagagccggtggcaaagagaaatgaagttcaaactgtagatctgtcattactgcacagctatgctgcagcagactgtccagctatggaggcccctgtgaccggccctcctatattcacattgtttctcagtatgcttgattaacccttggtggagagtttaggcaagccagggaccaataccttataaaacggtacctgtgcatctttgttacttggcaggacattcaacttgagaatttttgactttacagtgttaagtaaacaatacacgcttgatagacgctatgtagattttgatttgcatgtcatcctttggctggtgacatgtagtactctttggtgatgcttaggcagtagcagtgagctgcagatcccagacacccagaatcctgcagagaaacaactagccctttacagtatgcaggccttcctcgtaaagccatgaaggcctgtaggttatgtgtgccagatgccgtgtttgcagccctggggattgagcatacagcctcctgcatgtaaggcaagtgttctcacgctgatctatatcccccgttctaaattaattttctcccttatgatgtcatcagccaatgatacatttgtggagctgcaaccaaccccatcataagccaagtaatatgtgagaatgataataaccatacaatagcaataactggcctacaattggattataaatgcaataatgtcctgcagtgccaaaaaggtattcatttcatgccttatacaggatcaaaggatctattttcatgaattatctcctttatccccaaaacaaccctaatagagaaagagatggcaaacattggtgtgaaaggctagacagaaaatcttgtaggtgtctaaactactcagttctgaagctgcagccctgggtggcagcactcatagacaataaatgagcaggttaacatgtaagtgtcaattaaactttatttctaaaaaaacattttgtgagctggagagatggctcagaggttaagagcactggctattcttctagaggtccttagtccaattgctagcaaccacatgttggcttaaaaaccatctataatgagatctgctgccctcttttggcctgcagacatatatgtaggcagaatgctgtatacctgataaataaataaaagtcttttaaatattgttttttttttgttgttgttgtttgactatttaggccacagctgacaatcacagctaaagttaaatgatggtattcctaggcaagaatttctggtttctactggtaaaaggcaggggacttgatgcttcccttaggcataccccatgtcctattctttctttatcattctagctttggagtgaagaagagaataaaaagcatcatgccatgtgactccccagggtgaacttacagttcactaccatcaacaaaggagagagcaagtcttccttcccaggaaatccctgcctcagaggaggcccccttcactttcatggccacctctgtcaacatttacaagctggcatgggccatggttgaccttgccctgtgagacactcagtgcagaactgctgttagaagcttcagtgggtctttatgggtattgactatgccttcttaacaattcccaggccaccagtctatcacatggcctctctcctggcaccaatagctcccaaaatcctgtgtccccagttgtcatcctcctgtgtcccaaatctaagacaatgactaggcagggtccatctcaaagctcgtcagagaccaaggaatttgagtaagcatgcttttcccctccacagatacccagactcaagtcacccaatagacacaaaggagtgaggtagccatcctccttgatgatgctcatacactgaggaccaggactcctcagtctctccagggctacatcagattgacatgattctcaagaagtgttgtgtctattatggtatgcctagctgcatcctagcctgtgctcataactgttcccatggctatggcgaacaaaactggcttcagacgctggaggacggaaacaaatagcctctagctgcgagacaccgtcttagagtaagaagtgactggctacaggctctaaactctgtgtgtagttcccaagtccagaaatgttgtgaagacagtcaacaagctctcttggcacccagtgaatatcctcatggtacaagggagatgcttatcctcagtgtacacatgagagcagaggtctggggggaaaaaacctatatgcttagagcctggatttggagcaaagactgtcagatgccaaaccctgtactttataaaacagtctgaatatgacggggaacagtcaccgtagacttctctagaatgggaaatagtttcctcgattgtagtagaatgaaaccagattatgcctacctttcacttctaggtcctaaaattctgacagaaacattgacaggtagatgctcttttccccatttaaaagatgagaagactggggtccagaatattaaaaaatagtttgaagtcagcatagcaaatgtttttaagtctgcctctatgctcaaagagtttaacattttagaaccaaagaaattggacctgtacctcaataagaaagctaagtacagtttgcttcctggtcacgtgtcctgctcataagaagaaaggctccgtgataaatagcatttaatatgcccccttctttgccctcagccttctgtgacctcttcttttgcttcagctctgtatgcagtactggcctgagaagacctccgggtgttatggtcccatccaggtggagtttgtctctgcagacatcgatgaggacatcatccacagaatcttccggatctgtaacatggctcgggtaagtacagagccaccatggctcactgttccccttctttgcagaacagatggaggtggctgggagaggatcccactaagaccgccaagagtctgtgtttctctctcctgataagctcttccttggggaagtgatgtctttgctgactccagagccagcaatggctccagcacagttagatgcacagagccccatccaacctgccagctgcctgtttcctgacacgctagcaaccgtgtagacaaaacttctcagacattagctcttccccatgctggcacatcgctctggtacccttcagttgggtcttatgagctttggacaaggccctacaaatactgaacatggaaaaaataattagtgactttcaaagggatagttactggttaaacactgggtaggagagagcacaataatagtccatgaaacaagtattgctctctactgagaacctagaaaaatggtccttaggcactgccctcagagtttactatcaagtagaaacacgagataaactgtaacagatgagcttcagagagaaagacttctgcttggtagaataaagaaaagcattgctaaagaaagggacatcgggatgagttggaagactgacaggagttttcaaggcacagagtaagttaagcagagtacacagtcacaacattaggtataaggacactctgagcccatggtggcacaactgagaccccactcaatctgacttctactctattacagtcccctccaccccagccagaatctaaaaggcttgcatccttaggtacctcccagcagaacagccctaaccaatgctctgttctcagccacaggatggttatcgtattgtccagcacctccagtacatcggctggcctgcataccgggacacgcccccctctaagcgctctctgctcaaagtggtccgacggctggagaaatggcaggagcaatacgacggaagagaggggcgcactgtggtccactgcctgtgagtgctgtggagctggggtgatgggtgactgggtgtctgaaagtgctgaaggctatgctggtggcatagccagtctgaggcatatccagtagtttctcatctcaacagcccttatagtccattgataatgcatccataggaattagaatcttttgatgaactgaggtgcccatttttttctaaactgtggctacatgacaggctgctgaagcagaacatagtaggcagattgcttcccagtgctcccaacacagatatgagttctacaccctaaagtgggtatgcatatcatcctgctaggcatagaaagcttgggataaagtggctcccattgaccagagtacccttgtgttatttcctgaagaagaaaaaggacagtattttcttagcttaatttaagccaggcatttaaaaatgaatcattttatcccatctatgaagcagagactatcattttgcagtaagaaaactgaaagcaaaaatgggtagggaaccaagctagttgcagaagagactcagatggaatccaccagactgagacctaacatgttgtctactgtcccacagtgtgtctaggaagagggaaggtggggaggagcattcaggatgaggacctcctgggcagggtgagaacctcttggatttgctcattgtgtttgcctcctaggctataccctaccttgtgcttagtaggaacagggacacagagcatgaggaaaggacactaccgcagtagatggcttttcagggccctggaatctgtgtctttctgtgggtgcagtgagctcaagaccagttactgggatggtctttgtttcctggcttaggatgggaagagcaggggaaaaaaagtacttaattacatgacctttggtttccccatctgtccactggctaaagtagattatgtttacaccctgtggtgtttaagcataaagattttagaaaagaataatgtatctgccaacagagagatttaaaactgccataacagaaaatatacaattttaagtattgtttcttaagagcagatgtcacagcatccactatgaagaagcattctatgtagagttcaaacccatagaatatctgcagccataagagacatacataggatgttagatcaacaactatcaactctttagagaatcatttgtggggaagagaacaaggggcccttcctctttaaaaatattgtatttcagaaaatatgaaccaaactcctctctttttgtcaggataattctttctggagtgaatggaggcattaattacctttcattgaccccagagttggcctgtcttttacaaagctgctaattgtccacttccttccagataggtggttcatacatatcaggaaggtcagaacttagagcaggttaaacacacatgtgcacactcagagctaaaaagctcccaccagtagaaacttttctctaaggatacagaaatgcagactctagatgtggtgtcagacatgccaagctgtctctaactatacctcgtgactggtttccaaccctgactccctccagttctttcccacacattatatgccccctcattagtatggcacagcatccattccttgagactccagaaggccctgagatgacagattctttcacattgtcttcttggtccttgggttcttatttcaaaagatattaactctccttgctaggaaagcttcctactctccagtaattttatatcctagcctatttgggaggggtggtttggttggttggttggttggtgggttggttggttggttggttggttggttggttggctggctggctggctggctggctggttggttggttggttggttggctggctggctggctggctggctggctggctggctggttggttggttggttggttggttggttggctagctggtttgttgggggattatggttgttttcacccctatctctcctaccctagccattcaggacaagtgtgtcagtctaccaatagggacttgggcatccttgggacccgcaggtatcatgacagtcactgaaattcagggacccaccagttaagggaggataattttctatatttgacacatctggttaagtttcctgtgggtgaaacatctgggagattgactaagtactttagtgtctgcccagatgttccttagacacagaccattacatgaaatcattagctgcctttggcagcctgcccaggagttcagagtcaggtaagttcctgaagattatttctgtaaggataatttacagcttcagaaagaaggagcaatggaggaatggccattccaagaacatgcagtccttatatctaagacaagtaggatcatatttaaagaagatttacaagaggaaccatggaattggcctggtatttcagaaacactgagccaatgtccaaggaccacagcccaaagacaggactagctagctcaggactcatcaattattgtctttattagaagataggaagaaatactaataaaaccacctagtaatgtccactgttttcactggatgtctggtagacctagagtatccttttgggcatggataaaggtaccacatgtacaaagacataataatgcagatcagtgtgccccaatcaagcataaaatgcttgtagagccaaaaaaaaaaaaaaaaaaaacctaaactcccaaaaagtcatataatctaacctcttaattaggtaaatggggaacttggaacactgactaaggagtgtctttcccaaagtcaaagaagattcacagccctaatgggatttaaactcatggctcagactaaagttcgaatggtcgtctgaccacactaggtctgctaggacaggtactccttgctccaaaatcctgggacttcgactcacctgttctctctttgtttagaaatgggggaggccgcagtggaaccttctgtgctatctgcagtgtgtgtgagatgatccagcagcagaacattattgacgtgttccacattgtgaaaaccctccgcaacaacaagtccaacatggtggagacgctggtgagcatccaggaaccattatccagcacccaaagtcttcatgttccccagacctgaaaactgtgactgggcataggacacaccttcaataactgggtctcatttgaatacctatagtctgtgtttctttttctttccaaccttagcaatttctctttcctgcagggcaatctaaatattaatcccagtccacctactttgttttactttctgcctaccccctaagaaaatgtcgttaattcagacttcaaggaaagattctggaatagtagtttgtgaattatggtttcaattcagcccaagcctattctaattcacttatgctaatattttacaagatcaagcattaaactaggggtgctttggataaaggatagtgaagctagaaggaaggcagagcccagatgggaagacctgctatagtggtggagatgacccatacagagaacttgactatacatctttaaagtggatgataagatctcacacagaatgtggctcaaaggctggtagagcagcattacctgggaagtgtctaggaatgcagaatcttgagaatcccaaacggaccgagtcaggatcttcattttcagtgcacacccctacatgttctgcacaaagcttatagactgagaacctttggtgtgtgatggaataactgaaagtgagcaatcacaggtggggattctgggaagtgtaggcagaatatgcatcagtcaggagttgaaggatgttcagacatgagatacggctacttacttgatttttagtatgcttacaggtagttttctccaaaatctgcatctctaatctaatgcattcttttcttttctttctttctttctcatctcctcctcttcctctcaggaacagtataaatttgtatatgaggtggcactggaatatttaagctccttttagactgattggatggggagcctgccagagttcagcggcggctgcagctgcccctctatttctgtgactgacaatgactggtctcaggagctccgaggtggtacacctgctcagctccaggaagaagactgctggtctcatgctctgcagcttctgtgggggtctgtagctgtgggagatgcggttctgatggggactagcatcccttctacacctgacagcatcaggcccacagaagtctacccacaagcaaggccctggacttccgattcccagacctcttgcttttgttcgttctgagtttgttactctcatggcaagctgactgtgcaggtgctggggtgtggggagatggccagtccttcccttaccatccttaggagtatcaggggtggaagttcttctccatgctatcctgcaaaagcatggattgtagtttgagggatcactgtgttattggttcctataatctcccacaggggcctctggcatgagacagctgccaatctggatcagtgtgactcctggataccccctaggccaagcagaaagctttttcatcttacacctaacccatcctgggttctactcactacaaccatctccagccaggccttgaccctctgtaatctcccggccaacctgctgtatctgtatcacacttcggcaaaggtttcctttgcttttccatagtctgtagggagaggagggctcataggaaatgttacagtatctctttaatctttgtagaaaaagccactctcatggggcagggctcttgctggcctttacagtacaaccctgcgcttcttaggtggtgctttctgtgggaaagacaaacaaaaaaagctttgagtgttttcccaagtacatgtgaaaagaaactcttgtgagagtgtaaaattctgtattctcttatgtcaaaagaagaaaaggataggatgggagtttggatgtgtggctgtcagataactctcttggacttttatttcctggtcatacccataaaaagacccactgtaggatgacacagccattgaacacatgaaatgggacctctgggatcagtccctgggttgtgggtgtggaaatacagaagcacctttataatttgtctctccaaatttgaactctttccttaaaaaaaaaaatccagctgccattttgaaattggctactggggccccagcttggtttatgatagaataagcaggtttaggctgggggccaagtcttgctcaaagcatgaattaagggaaaggagagaacattagtgaagtgtttcctgcaagccaagtgccatggttaccaccttccatgtgacatctcatatagtcagtagcacccctaggaacccctagagaatgctctcatcatatccatttggtaattgaagaaacctgagcatcttcttcagtgatggaattctgggttccaaagacaggtaatggcaccgaaaccccccccccaccattttcctcatgctttctcagccaagcaattatttttatggaaccaaaataaggctagaaactttggagcagagagagagaactccaggagtagaaatttaattctttctttctgatagcagttcttcttggtagcccacactttcagatatattttattaactcattcgcagttccccagaaaagctagtcttatctaatttcatcattgctaaaaacaattcccgtgctccctcaggctacaagggagccagcttgggaagctctgtagcctgggttgagccacaatatctgacagccttaatagccagaggtctaggaaggtctatcttgcagactgatccagtctcggtgtatgagggacacagaatccaataaggtacacatcttgcccttcaggcccactgtattgtagagaagctga

SEQ ID NO: 126 - DNA, 6191 bp, Mus musculus
ttggcgcgctcgccctctgcctgctccggctcctgctcctggggctgcagcggccgccgttgcccggcgccggagcgcagagcgccgcaggtggctgttcttttgacgaacattacagcaactgcgggtatagcgtggctctgggaaccaatgggtttacctgggagcagattaacacatgggagaagccaatgctggacccagctgtgcccacagggtccttcatgatggtgaacagctctggaagggcttcaggccagaaagcccatcttcttctgccaaccttgaaggagaatgacactcactgcattgacttccattactacttctccagtcgagatcgctccagcccgggagccttgaatgtctacgtgaaggtgaatggtggaccccaagggaaccctgtctggaacgtatctggcgtcgtcactgagggctgggtgaaggcagagcttgccatcagcaccttctggcctcatttctatcaggtgatatttgaatccgtctctttgaaaggtcatcctggttacatcgctgtggacgaagttcgggtccttgctcatccatgcagaaaagcacctcatttcctgcgactccaaaacgttgaggtgaatgtggggcagaacgccacgtttcagtgcattgctggtggaaagtggtcccagcatgacaaactttggctccagcaatggaatggcagagacacagccctcatggtcacccgggtggtcaaccacagacgcttctcagccacagtgagtgtggcagacacctctcaacgcagtatctccaagtatcgctgcgtgatccgctcagatggtgggtctggtgtgtccaactatgcagagctgattgtgaaagagcctcccacgcccattgctcccccggaactactggccgtgggtgccacctacctgtggattaaaccaaatgccaactccattattggggatggccccatcatattgaaggaggtagaataccgcacaaccacaggaacctgggccgagacccacatcgtggactctcccaactacaagctctggcatctggaccctgatgtggagtatgagatccgggtgctgctcacacgaccaggagaagggggcacaggaccaccaggaccacccctaactaccaggaccaagtgtgccgatcccgtgcatggcccacagaatgtggagattgtggacattcgggctcggcagctgaccctacagtgggaaccctttggctatgcagtgacccgctgccacagctacaacctcacagtgcagtaccagtacgtgttcaaccagcagcagtatgaagctgaagaggtgatccagacatcttcccactatacccttcggggtctacggcccttcatgaccatcagactgcggctgctactgtccaaccctgagggccggatggagagtgaggagttggtggtacaaactgaagaggatgttccaggagctgttcctctcgagtccatccaagggggtccctttgaggagaagatctacatccagtggaaacctcccaatgagaccaatggggtcatcacactctatgagattaactacaaggctgtgggctcactggatccaagtgctgacctctccagccagaggggaaaggtgttcaaactccggaatgaaacccaccacctctttgtgggtctgtaccctgggactacctactctttcaccatcaaggccagcacagccaagggctttggacccccagtcactactcggattgccaccaagatttcagctccatcaatgcctgaatatgacgcagataccccactcaatgaaacagatacaaccatcacggtgatgctcaaacccgcccagtccaggggagccccagtcagtgtttaccagctggttgtcaaggaggagcgactccagaagtctcggagagcagctgacatcattgagtgtttctcagtacctgtgagctaccggaacgcctccaacctcgattcgctacactactttgctgctgagctgaagccctccaacctgcctgtcacccagccatttacagtgggagacaacaagacctacaatggctactggaaccctcctctctccccattgaagagctacagcatctacttccaggccctcagcaaagcaaatggagagacaaaaatcaactgtgtgcgtctggctacaaaaggtgcttccactcagaattctaacactgtggagccggagaagcaggtcgacaacacggtgaagatggctggcgtgattgctggcctcctcatgttcatcatcattctcctgggggtgatgctgaccatcaaaaggaggaagctggctaagaagcagaaggagacccagagtggagcccagagggagatgggtcctgtggcctcgactgacaagcctaccgccaagctcggcaccaaccgcaatgatgaaggcttctcctccagctctcaggatgttaatggattcacagatggcagccgtggggagctgtctcagcctaccctcaccattcagactcatccctaccggacttgtgaccctgtagagatgagctatccccgggaccagttccagcctgccatccgggtggcggacctgcttcaacacatcacccagatgaagagaggccagggctacgggttcaaggaggaatacgaggccttaccagaaggacagacagcttcgtgggacacagccaaggaagatgaaaaccgcaataagaatcgatacggaaacatcatatcttatgaccactctcgagtaaggctgttggtgctggatggagaccctcactcagactacatcaatgccaactacattgacgggtaccaccgaccccggcactacattgcaacccaaggtccaatgcaagagacggtgaaggacttttggagaatgatctggcaggaaaactctgccagcatcgtcatggtcacaaaccttgtggaagtgggcagggtgaagtgtgtccgatactggccagatgacacagaggtctatggagacattaaagtcaccctaatagaaacagagcccctggcagaatacgtcatccgcaccttcacagtccagaagaaaggctaccatgagatccgggagctccgcctcttccacttcaccagctggcctgaccacggtgttccctgctatgccactggccttctgggctttgtccgccaggtcaagtttctcaatcccccagaagctgggcccatagtggtccattgcagtgctggagccgggaggactggctgcttcattgcgattgacaccatgctcgacatggctgagaatgaaggggttgtggacatcttcaactgtgtgcgtgagctccgggcacagagggtcaacctggtgcagacagaggagcagtacgtgtttgtgcacgatgccatcctggaagcatgcctctgcggcaatactgccatcccagtgtgtgagttccgctctctctactacaacatcagcaggctggacccgcagaccaactccagccagatcaaagacgagtttcagacactcaacattgtgacacctcgagtgcggcctgaagactgcagcattgggctcttaccccggaaccatgataagaatcggagcatggatgtcctgcctctggaccgctgtctacccttcctcatctcagtagatggagagtccagcaactacatcaatgcagcactgatggatagccacaagcagcctgccgccttcgtggtcacccagcatcctctacccaacacggtggcagacttctggaggctggtgtttgattataattgttcatctgtggtgatgctgaacgagatggatactgctcagctctgtatgcagtactggcctgagaagacctccgggtgttatggtcccatccaggtggagtttgtctctgcagacatcgatgaggacatcatccacagaatcttccggatctgtaacatggctcggccacaggatggttatcgtattgtccagcacctccagtacatcggctggcctgcataccgggacacgcccccctctaagcgctctctgctcaaagtggtccgacggctggagaaatggcaggagcaatacgacggaagagaggggcgcactgtggtccactgcctaaatgggggaggccgcagtggaaccttctgtgctatctgcagtgtgtgtgagatgatccagcagcagaacattattgacgtgttccacattgtgaaaaccctccgcaacaacaagtccaacatggtggagacgctggaacagtataaatttgtatatgaggtggcactggaatatttaagctccttttagactgattggatggggagcctgccagagttcagcggcggctgcagctgcccctctatttctgtgactgacaatgactggtctcaggagctccgaggtggtacacctgctcagctccaggaagaagactgctggtctcatgctctgcagcttctgtgggggtctgtagctgtgggagatgcggttctgatggggactagcatcccttctacacctgacagcatcaggcccacagaagtctacccacaagcaaggccctggacttccgattcccagacctcttgcttttgttcgttctgagtttgttactctcatggcaagctgactgtgcaggtgctggggtgtggggagatggccagtccttcccttaccatccttaggagtatcaggggtggaagttcttctccatgctatcctgcaaaagcatggattgtagtttgagggatcactgtgttattggttcctataatctcccacaggggcctctggcatgagacagctgccaatctggatcagtgtgactcctggataccccctaggccaagcagaaagctttttcatcttacacctaacccatcctgggttctactcactacaaccatctccagccaggccttgaccctctgtaatctcccggccaacctgctgtatctgtatcacacttcggcaaaggtttcctttgcttttccatagtctgtagggagaggagggctcataggaaatgttacagtatctctttaatctttgtagaaaaagccactctcatggggcagggctcttgctggcctttacagtacaaccctgcgcttcttaggtggtgctttctgtgggaaagacaaacaaaaaaagctttgagtgttttcccaagtacatgtgaaaagaaactcttgtgagagtgtaaaattctgtattctcttatgtcaaaagaagaaaaggataggatgggagtttggatgtgtggctgtcagataactctcttggacttttatttcctggtcatacccataaaaagacccactgtaggatgacacagccattgaacacatgaaatgggacctctgggatcagtccctgggttgtgggtgtggaaatacagaagcacctttataatttgtctctccaaatttgaactctttccttaaaaaaaaaaatccagctgccattttgaaattggctactggggccccagcttggtttatgatagaataagcaggtttaggctgggggccaagtcttgctcaaagcatgaattaagggaaaggagagaacattagtgaagtgtttcctgcaagccaagtgccatggttaccaccttccatgtgacatctcatatagtcagtagcacccctaggaacccctagagaatgctctcatcatatccatttggtaattgaagaaacctgagcatcttcttcagtgatggaattctgggttccaaagacaggtaatggcaccgaaaccccccccccaccattttcctcatgctttctcagccaagcaattatttttatggaaccaaaataaggctagaaactttggagcagagagagagaactccaggagtagaaatttaattctttctttctgatagcagttcttcttggtagcccacactttcagatatattttattaactcattcgcagttccccagaaaagctagtcttatctaatttcatcattgctaaaaacaattcccgtgctccctcaggctacaagggagccagcttgggaagctctgtagcctgggttgagccacaatatctgacagccttaatagccagaggtctaggaaggtctatcttgcagactgatccagtctcggtgtatgagggacacagaatccaataaggtacacatcttgcccttcaggcccactgtattgtagagaagctga

SEQ ID NO: 127 - protein, 1431 aa, Mus musculus
GALALCLLRLLLLGLQRPPLPGAGAQSAAGGCSFDEHYSNCGYSVALGTNGFTWEQINTWEKPMLDPAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTSQRSISKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDADTPLNETDTTITVMLKPAQSRGAPVSVYQLVVKEERLQKSRRAADIIECFSVPVSYRNASNLDSLHYFAAELKPSNLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRKLAKKQKETQSGAQREMGPVASTDKPTAKLGTNRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQLCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF
